United States Patent 8,781,750 (CELL-TYPE-SPECIFIC PATTERNS OF GENE EXPRESSION) - sequence listing, part 41

SEQ ID NO: 37713 - DNA, 156814 bp, Homo sapiens
gtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggaggtgaggccggcggcagggcgggggccgcgggatccgtctccgggggcggccggggcggggtcgcggcccggtcggggactagaggcgcgacgggcctcctggagggcgggcctgaggccgatgccccctgggaccgatcccggcggcctccaggtaccccgggagccaggccggcgttggaagccgaggccggctactgagtgtcctgggaagggagcgagatggaggaggcagggcccggggaggaagcggcagcctggcctgaggacacctggggttggccaagggcggagattgttgggtgtctggttgcttcttgttgagggaagtttccgaccaccgtgggatagtcagatggcggttcaaagttttacccttggggagggggacacttctgccctggatatgtaacttccgctagttccagtacctttccagggggttgccttgctttgggaagttagagatctccctctttcggtcagtttcttcttgacgttttaatcttgttgagaaagacgtcttattttatgttctatgtgccttggttgacactttgtcaacttttagatgttgtgtggcagtactcaataaatatataaacaatttcgttggtatcccaaaccaaagcattcctccgtatcaggttgtaaccttggacagttcccttcaaaaaccctccgtttatttataaaaaggattggggggcggggttgggaagatgtaggtgacagttggcaacactttttccgtctgagtttccttcttagactgctgtttatacgtgcatttggccacctgttaactctagcacccgagcagtgacctgggcgccctcacctcgactctgtgaaccttttggagttctagggtgcaagtgataggtccttggcttcttgagactgacaaggagtttagctttcagcctgcgttggcgttatttctgtggaccttatcaaaggcaggtgatgtgtcctatttttgtttctcaagcacctagcacacctgcttaaatacatggtgatcaaaggaggcgaaataactaattattgaaggaatgacatagtatttttcaaaaagacttgaagagtttttaggatgtgaggtttgtagctcatttcctgacactgaatagtaacaccattaaatttttgttttattttgtcacgtatacctttgcatctggttaaatagttctttttccttttttaaaagcttgactgtagtgatgatttttagttctgattgtgggatccaattttctcaaaggaatgctattgaatttgccaaacaaaattgcctttttttttttttttttttgagacgtagtctcactctgtcgcccagggtgaagtgcagtggagtgatcttggctcactgcaacctctgcctgccgggttcaagcgattcttgtgcctcagcttcctaaggagctaggacaacactccccgctcatttttgttttttgtagagacaggatttctccatggtgcctaggatggtcttgaactcctggcctcaagtgatctgcccactttggcctcgggctgaccatcccagtgctgggattacaggcatgagccaccgcaccccgccagaatggactatttcaagagcttttcctttcatatagggaaggaagggatgaaaaaccaaataatgataggatcacaatttccgcttgtttgttagcactctttatagaacagaggtcaagtgctacttgctgcttcatgctcatatagccccttgccagtgtgtggatatacatggaagtgactgggaattaaccacatgtacacacaggtgacaagcaagcctgacatgaccttttacctcacgtaaaataaatgctccctccagccttaaactcctgtcagtccgtgtaaatatgggcaaaatgccagggtcacacgtgccaagaaaaccatctgccacaggttgcagaatcagaaaacaaaattgcccgactgctagactctgggttccctattaatttcttgagtaaatgactctaaaaaaaataggttatccaatgaatttatttgtagtttatattttttcagttacatctgtaaattctccatagtgaaaccattgggcaaagggtcatgacctgagaacagagaacatttatgaaatgctaaatgagcccactcccaggccacaaacataaacacaccttgttatcagttttcttttctctttttttttttttttgagacagagtctctctctgtcgccaggctggagtgcagtggcacgatctcggctcactgcctcccgggttcaagcaattcttctgcctcagccgcccgagtagctgggactataggcacgtgccaccccgcccagctaatatgtatatatattttgtattttagtagagacggggtttcaccttgttgcccaggctggtcttgaactcctgagctcaggcaatccactcgcctcagcctcccaaagtactgggattacagatgtgagccaccacacccggccatcagttttcacataagatcataaattgtgtgttgctcagtatccagaaattgtctccctttggccaatatgtagagtgaattctgtgtttagttttctgtgagtgctttgtttgcgccttttttttttttttttttttttttgagacggagtcttgctctgtcacccaggctggagtgcagtggcacaatcttgactcactgcagcctccgcctcccgggttcaagcgattctgcctcagcctcttgagtagctgggattacaagcacgtgccaccacgcctggctaatttttttgtatttttggtagagacggggtttcaccattttagccaggatagtctcaatctcctgacctcgtgatctgcccgcctcagcctcccaaagtgctgggattacaggcatgagccaccgtgccggcctgtttgtgtctttaatgcggagaccaagagtcttttataccaaagtaagtgcctcagggtatttacagcaaaagtgatttgaaagcatggaaattatccatcaccagagagagtaaagtaaattctgagcacctctgtggaaacttaggtgggtatgtagatagaatgttttaggaatgtgtgaggtgctatgatctcttgcttgcaggaattctcagcaaggcatcaaaaatttaatctttatattgataggacatattttgaataccttctgactttttcctttgcttttatttgaatttctagtgtggagctagtctgctgttttagggattctttaaaaacaacctaaagaagggctaattttagatagatttggaccggtttcagatgctaatcaagaaatctgtcatcttatcgcccatcactctctcctttgggctgcctgtgacacacctctccattctttaaccaagacccgtctgatgcctttgcccatgctctagaatgctctccttagaattttacatagctagctcctcactttctactctgtttcaatttcactttttcagccagaacatcctgttgactctatccagaataagccctgtgaacctattgaataatttattttaaaatcagtgacttttaaatttaaattctttttggagacagagtctcaatcgcctaggctggggtgtagtggcacagtcacagttcactgcagcctcaatctcttgggctcaagtgatcctcttgcctcagcctcctgagtagctaggaccacagacatgcgttaccacactgggctaattaaattttttacagagacaaggtctcactgtgttgcccagtctggtctggaactcctgggctcaagtgatcctcctgccttgtggatcctgccaaagtgttgggacttacaggggtgagccactgtgccccagcccagtgattttttaaaataaaaatctggatacaaaatgatctggagagagaggttataactgggtatgttagggtttttctgcaacttctgattcttttaaaacaggcatgatttgctgtaacttttaaaaaagggccaggtgtggtggctcacatctatagtcccagcactttgggaggccgaggcagatggatcacttgaggtcaggagtgtgggaccagcctcgccaacatgatgaaaccctgtctgtactaaaaatacaaaaattatctgggtgtggtggtgggtgcctgtaatcccagctactggggaggctgatgcagaagaattgcttgaacccgggagatggaggttgcagtgagctgggatcgtgcctctgtactccagcctgggcagtagagtgagactacctctcaaaaaagaaaaaagaaaaaaaaaagaaacttctgaaaagtagacatacgagtttaaagaacctttaggaatttagttcttagtgattctgtgggtcttttatgttatcactgttattctcaaagtgagagctcatttagcatcattcagtagagggagattacacataaaaacgaagaggcattgtcttccttccttttctttttcttttcttttcttttcttttctttttttttgagatggagtttctcttgttgcccaggctagagtgcaatggtgccatctcggctcactgcaaccttcgcctcctgggttcaaacagttctcctgcctcagcctctcaagtagctgggattacaggcatgcgccaccacgcctggctaattttgtatttttagtggagttggggtttctgcatgttggtcaggctggtcttgaactcctgacctcaggtgatccgcccgccttggcctcctaaagtgctgggattgccactgtgaaccaccgcgcctggctccttccctcctttttgagatagactcatacatgcagagaatggactgaagagagaatatctttactgggaatggattatgtgattttgtgtctgcttttttgtggccttttgctttaaaaaaaaaaaaaaaaggatgagttcaagcctgggcaacgtagtgagacccctcttccccaaaaaccataaaaaaaattagttgggtgtgatggtgtgagcctgtagtcctagctactcaggaggctaaggcaggaggatcacttaagcccaggagtttgagactgcagtgagttatcatggccacggcactccagccttgacaacagggcaagaccctgtttcttaccaaaaaacaaaacaataggatgactgaatgcagaggtgagagacactactgagaattttctaacttgttcccatggaatcagcacttaaagcagtaacaaaatgatttttgtttaaatggagacttttgacacttcttgtctttggaagtgtatgaacatgggacccgtaagactcatgggcaggaaaataggtattgacattcattgttcttgttttagtgttctcattcattcataattttttttttttttgagacagagtctcactctgtcacccaggctggagtgcagtggcactatcccagctcattgcaacctctgcctcccaggttcaagcaattctcctgcctcagctgcctgagtagctgggattacaggtgtgcaccactacacccggctaatttttgtattttcagtagagacagggtttcaccatgttggccagggtggtgtaaaactcctgacctcaagtgattcatctgcctcaacctcccaaagtgctgggattacaggcgtgagccaccacacttggcccacacttgatattttattttttaattttatttatttttgagactgagtttcacgctctgttgcccaggctggggtgcagaggcacgatcttggcttactgcaacctctgccttctggattcaagcagttcttctgtctcagccttctgagtagctgggattataggcatgagccaccatgcccagctactttttgtatttttagtagagatggggtttcaccatgttagccaggctggtcttgaactcctgaccttgttatctgcctaccttggcctgccaaagtgttgggattacaggcatgagccaccatgcctggcccattttttaaaaaatttatttttgagacagagtcttgtgctgtcgcccaggctggagtgcagtggtgcgatctcagatcactgtaactcccaccttccaggttcaagcaattctcctgcctcagcctccctagtagtttgggattacaggcacgcgccagcacgcccggctaatttttgtagttttaatagagaaggggtttcaccatgttgtccaggctggtctcaaactcttgacctcaggtgatccccctgcctcggcctcccaaagtgctgggattacaagcgtgagccaccgcacctggcctaaaaaacacatattttaatatttttatagatcttttgattgattgattgagacgagatctcactctgttgcccaggccagagtgcagtggtgtaatcccggctgactgcaacctctgcctcctgggttcaagcgatcctcccatctcaacttccggaatagctgggactacaggatcatgccgccatgcctggctaatttttgtattttttgtagaaatgggtttcccatgttgcccaggctgatcttgaatatttgggctcagacattcctcgcacctcagcctcccaaagtgctgtgattacaggtgtgagccactgcacccaacctattttcttttgttgttgttgttttttttttttttgagatggggtcttgctttgccacccatgctggagtgcagtagcgcgatcttggctcactgcaacctctgcctcccgggttcaagcagttctcctgcctcatcctcctgagtagctgggactacaggtgctcacaaccacacctcgctaacttttgtatttttaatagagatggggttttaccatgttgtccaggctggtattgaactcctaacctcaggtgatccacctgccttggcctcccaaagtgctgggattacaggtgtgagacactgtgcccggccaacctatttgctttttcttttctttcttttttttttttttttttgatatggcatttcacacttgttgcccaggctggagcgcaatggtgcgatctcagctcactgcaacctccgcctcccagatacaaaggattctcctgcctcagcctcctgagtagctgggattacaggcatgtgccaccatggccagctaattttgtatttgtagtaaagatggggtttctccatgttggtcaggctggtctcgaactcccaacctcaggtgatccgccggcctcggcctcccaaagtgctgggattatgggtgtgagccaccacgcccggcagcggccaacattttttcatatttttaaaaataccattttttttttctgaactgtttgtttttgtgatttttttttcctttggttgggtttttttttttttcttttttttagagatgaggttcaggctggagtgcagttgtgcaatcatggcccacagcagccttgacctccagggctcaagtagatcccacttcctcagcctctgagcagctgtgactacaggcatgcgccaccatgcctggctaatttttaattttttttgtagaaacagggtctcgttatgttatgcaagctgaactcactatgttgcccagtctggtctggaactcctgggctcaagtggatcctcctgccttgtggatcctgccaaagttttttttttttttttttttttttttttgttgagacagagtctggctctgtcgccagtctggagtgcagtggagtgtcttggcttgctgcaacctccaccacctgggttcaagcgattctcttgcttcagcctcctgagtagctgggactacaggcgcgcgccatcacacccagctaatttttgtatttttagtggagatggggtttcaccatgttggccaggatggtcttgatctcgacctcaagtcatctgcctgccccagcctcccaaagtgctaggattacaggtgtgagccactgcgcctggccttttttttttttttttttttgtagagatggggtcacactgtgttgcccaggcttgtcttgaactcctggcctcaagacattttcttacctcagcctcccaaagtgttgggattgtaggtgtgagccaccacacctggccatggttaacgattcgaataatgttcacactgcccctagccagagtagatagagatatgcccctgcacctagtcattcagacactttctgaaatgaacaatctatgtttgttttctggcgggagtgggatgggaaggggtatggttgttgctttatgaaataataatttgttagttaattattacttaagctcctaagacatttttttttaaagacaaagactagctctggattaagacatctttttttaaatttgagatttctgaatgtgaatatctaaatgagataccattatgtgtccctgctgtagtgacactcatatttttatttagttaaaaatcacaaaagaacgctacgcatggtggctcatgcctgtaatttcagcactttgggaggccgaggtggtggattgcctgaggtcaggagttcaagaccagccctgaccaacatggtgaaaccccgtctctactaaaaatacaaaaattaactgggcatggtggcggacgcctgtaatccaagctactccggaggcagaggaaggaaaatcacttgtacctgggaggcggaggttgtagtgagccaatatcttgccattgaactccagcctgagctacagagtgagactgtgtcttcaaaagaaaaaacaaaacaaaaaaaaatcacaaaagaggacaccaaactgggtatagtaccaaactggttcagagggtagattagtagattgactattcactggattgctgaagtgtgtgccataggtcacacatccagttctgtgcttgagagagtacaggattcctgcttcttgaaatctttaccttacctttaactacatgctgcttacttatgttgtactgaactttgcttctcaggagaactgatgttagaacctacccaagttattttgctctgctctgcactcaatgaatacagctgttatctaaataagttattaggttgtggtcagaaatatctgcatagaccagtttaataatgtatgtaatgttatatatatttaaaaagctgttatttggaaatgggtatatataagttctgttttttactttgaaatcttgaccagtgatatttgattattgctttgaacatagcactgtgttttcttttctttttttttttgagacggagtcttgctctgtcaccctggctggagtgcagtggcgggatctcggctcactgcaacctccgcctcctggattcaagcgattctcctgcctcagcctcccgtgtagctgggactacaggcgcccgccaccacacccggctaattttttgtatttttagtagagatggggtttcactgcgttagccaggatggtctcaatctgacctcgtgatctgcccgcctcggcctcccaaagtggtgggattacaggcatgagccacccacccggccatactgtgttttattttcttaagaattacagcattcagtagtttggcataataggcacacccaaaaatgtgtgaggtgaaccatgggaatttatatattaatgtaatagagaagtaccaagttgagggtatagaattttattttatgttatttttttcgagacaaggtctggcccaggttggagtgcagtggtgcgatcttggctcactgcaactgttgcctcttgggctcaagccatccttccgtctcagcctcccaagtagatgggactacaggtgtacaccaccacgcccagctaatttttgatattttgtaaagacgggtttcaccatgttgcccaggctggtctcgaatttgtgagctcaagtgatctgcctgcctcggcctcccaaagtgctgggattacaagcgtgagccaccacgtccagctagggttttttttttttttttgtaaggttagtaaactttttcagtaaatccaccaccacccctcccagctttttattaggtaaactttcaaacatatagaaaaatggaaagtacatttgtcatttgtatacccactatatagattcagtagttgttgttttatttatctgtctgtatatgtggatgtgtgggtgtggatacacatatacacacatacacatatttaattgctgaaccattttaaattgcagacatactttgcccctcagtacttaacatatttaaattacagacattatgatactttgcctctcagtacttaacatatttatctcctaaaaaatgagaatattctgccatataaccaccatattatttacgtttgagaacatttccaaggccgagtgtagtagctaatgcctgtaatcccagcactttgggaggctgaggtgggcggaacacttgagctcatgagttgaagatcagcctgggtaacatagcaaaaccttgtctctacaaaaaatataaaaattagcgtggtgtggtggtgtgtgcctatagtcccagctacttggggggccgaggcaggaggatcgcaccagcctaggaagtcaaggctgaggtaagatgtgttcatgccactgtgctccagcctgggcaacacagtgagactctgtcaaaaagaaaagaaaagaaaaaaaagaacctttgtaatatcatctaatattaatttgaattaatttttaagagcacagtatgtgtcagttattatatagctaactagcttcttaatatgtttataatgaattaatgaaactcatctgggaggaagtgtttgcattttagttacttttctataagaaatttaaatttgaggccggacgcagtggctcacgcctgtaatcccagcactttggaaggccgaggtgggcagatcacgaggtcaagagttcgagaccagcctgaccaacatggtgaaaccccgtctctactaaaaatacaaaaattagctgggcatggtggtgtgtgcctgtaatcccagctactccggaggctgaagcaagagaatcacttgaacctgggaggtggaggttgtggtgagctgagatcgtgccacggcactccagcctaggcgacagagcaagactccatctcaaaaaagaaaaaagaaaaagaaaaagaaatttaaatgtgaaatatataaaacggaattaaaattggctaattttgttttaaaattagcacattggccaggcgtggtggctcatgcctgtaatcttagcacttggggagtctgaggcgggcggatcacctgaggtcaggagttcgagaccagcctgaccaacatggagaaaccctgtctctactaaaaatataaaagtagctgggcttggtggtgcacgtctgtaatcccagctactcaggaggctgaggcaggagaatcgcttgaacccaggaggctgaggcaggagaatcatgtgaacccgggaggtggaggttgcagtgagctgagatcatgccattgcactccagcctgggcaacaagagcgaaacttttgtctcaaaaaaaaataaaaataaataaataaaattatcacataaaaactattatggaccaggcacagtggctcatgcttataatcttagcagtttgggaggccaaggaaggaggatagcttgagccccagagttccagaacagcctgggcaacatagtgagaccgtatctttacaaaaaatagaaaaattagccgagtgtggtggtatgcacctgtggctccagctacttgagacgctgaggtgggaggatcccttgagcccaggaggttgaggttgcaatgacccctgattgtgccactgcactctggcacacagcaccacttgctctgggtgacagagcaagaccctgtctcaaaaagaaaacaaattatttttcccctttttgaaactttgagatatagaaatacagaaaatgaccctatatttaatatttttgctagtaactattttttttttttttttttgagacagtctttcgctttgtcacctaggctggagtgtagtggtgcaatttcatctcaccacaacctctgcctcctgggttcaagtgattcttgtgcctcagccttctgagtagctgggactacaggtgcctgccaccacacccagctaatttttgtatttttagtagagacggggttttgccatgttgaccatgctggtcttgaacttgcaacctcaggtgacctgcctgcctcagcctcccaaaatgctgggataaccagcaccagccaccgccccatggccatcttttttttttttttttcttaaatcatgtatttccaggatatcttgtttctgacttgtttacctactctgccagggttatagagcctgagaaattcttttacctgctgataagatttcctctggggtataggcctggaatttttatgattctggattctattactgcccccctccctttttttttttgagacagtgtctcatgctattgcccaggctggagagcagtgttgcaatcagagctcactgtagcctcaacctcctgggctcaagctatccccctaccttagcctcccaagtaactgagattatagttgtgagccacatgcaacatctattattgccttttttttttttttaaccttttttttgatggagtcttgctgtcgcccaggctggagtgcaatggcatgatctcggctcactgcaacctccacctcccgggttcaagcaattctcctgcctcagcctcccgagtagctgagagtataggcgcgtgccaccatgcccagctaatttttgtagttttagtagagatggggttttaccatattggccaggctggtctcaaactcctaaccttgtgatctgcccaccttggcctcccaaagtgctgggattacaggcgtgagccaccgtgtctgactattattgccctttaaagtgtgttttctcttgttcttcctgcagttttaattaaattaattaattttttttggtagggatgggggtcagactatgttgcccaggctggtctcaaactcctggcctcaaatgatctgccgccttggcctcccaaggtgctgggattgcaggtgtgagccactgcatccggccttcctgcagtttcttttaaagagctggacaggaactttatgattctctagttctaccttatcccattcccccaagtaggtggaaagataaacagaaacatagatgcttagaaagaacaaatatttattgagccaggctctgttctttttcttttttttttttttttgagatggagcactcgctcttgcccaggctagagtgcagtggcgggatcttggctcgctgcaacctccgcctcccgggttcaagcgattcttctgcctcagccttccaagtagctgggactacaggcgtgcaccgccatgcttggctaatttttgtatttttagtagagacggggtttcaccatattagccaggctggtcttgaactcctgaccttgtgatctgcacacttcagcctcccaaagtgctaggattacaggcgtgagccactgcacccggacttttttatttttatttttaaaaattaagacagagtcttgctctattgcccagactggagtgcagtggcttgatcttggatcactgcaacctccgcctcccaggttcaagtgattttcccaccctagcttcctgagcagctgggattacaggcacctgccaccacacctggctaatttttgtatttttggtagagacagggtttcaccatgttggccaggctggtcttgaattcctgaccttgagtgacccacctcccttggcctcccaaagtgctgggattacaggcatgagccaccgcgcctggcagaacaaggcactgttctaagccctggggatgtagccactaatgaaacagacaaggaaggtagcctatcttgtcttggagtttacattgcaataaacaataagcaaaccagttaattacagattgtgatagatgtgatgggataaagactagagtggcaggtactttattttacttaaaaatttttttaaattttattttatctatttattttgagacacggtcttgctctgtcacccaggctggtgtgcagtggagtgatcatagctcactgcagcctcgaattcctgggttcaagtgattcttttgcctcaacctcctgagtagctaggactacaggtgtatgccatcatgcccagctagtgtgtgtgtgtgtgtgtgtgtgtgtgtgtgtgtgtgtgtgtgtgtgtgtgtagagatgggggtcttgctgtgttgcccaggatgggcacttgaactcctggcctcaagtgatcctcctgcctctgcttcccaaagtgctggtattacagacatgaaccactgcgcctggccataattttattttttttaaccaagcaagcagcagtgaagaggtaggcactttagatggaacaaacaagttaataaaggttaagctttaagtgttttttctttttctctttttttttgagacagcctgctctgtcgcccaggctggagtgcagtggcgcaatctcggctcactgcaagctccatctcccgggttcacgccattctcctgcctcagcctcctgagtagctgggactacaggcgcccgccaccatgcccagctaatttttttgtatttttagtagagacgaggtttcactgtgttagccaggatggcctcgatctcctgacctcgtgatctgcccacctcgcctcccaaagtgctgggattacaggcttgagccactgcgcccggccaagctttaagtgttttttcaagctactggggaagaaaagggaagaagaaaaggttaagctgctctttcagcaaataattcatttcatctcataagataattatttagatctgaaactttagatacatattcagagtgtctcctactcattattcttgaacattcagaaaagttagctctcataaatgcctgtcttgttttctatcttattccttctcatacttgatgtctcagcagtgttttttggctacttcttcctttgagaaacattacatttagtttgtttgactttgaaattccttggctttcctcttacctacgtgaccattctgtggattcttcttactcagatgaatgttgtgctcctgggctttctttctaagaatttctattcccaggggttcaatttaccatttgttgattattacaaaatgtttaacctactcatctaacagattttatttatttatttatttatttatctatttatttttgagacagagtctcgctcagtcgcctaggctggagtgcagtggcgtgatctcggctcactgcaagctctgcctccccagttcacaccattctcctgcctcagcctcccgagtagctgggactacaggcgcctgccaccacacccagctaattttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggccttccaaagtgctgggattacaggcgtgagccaccgcacccggcctatttatttatttttgagatggcgttttgctcttgttacccaggctggagtgcaatggtgtgaactcgcctcgccatcacctccacctcccgggttcaagcgattctcctgtctcagcctctggagtagctgggattacaggcaagcgccaccacacctggctaattttgtagttttagtagagatggtgtttcttcatgttggtcagactggtcttgatctcgcgaccttgggtgatccgtccaccttggactcccaaagtgctagaattacaggtgtaagccaccacgcctggccttacagatactttcattgagtgccaactatgtgcatgatactgtgctcattgggcatacagtggtgagtaaaacagacaaggtccttctctcatggaactgatagcctactttaaggccagatctctctctggagtttcagattcatcttatgattgtttattgggtgtgaatatctcccagcgtgtccaaaactgaacttatttcccaaacctggttctcttttcttccctatcttcatgaaggataccaccatctacctggccagaaatcaggttaccatccctaactcttcctcattcccattgctgctttcttttgttttcaacttttaaatattgctggaatctcattactttctaaatccatttatactactgtggtacaggacaccaatatcgctcaccctgaatgcaaactccatagacctggaagtttgtcattcaccactatatcccagtagctagcacgttgaaagtgccagggaaatttttctgaatagatgaatggacaactgaaactagtccataactgatttttctgcttccagtatggccaacctataaaccgcccatctctccaaaatggaaatctgatcagatcattccacaagcccttagtggctttttctcaaattcctgggctcaagtggtcctctcacttcagcttctcaaaatgctgagaatacagatgtgaggcaccgtgcctggccagttgctctttctaaagctcttgaaaatgacttaagttcctaacatacaagaccttgtgatctggctgccccaatcttgtcagtctcatctgtttctttttgagccacagtgaacattttgaatttggtttgtaaaaagtatcctctctccaggccttcctaaaagctgtccctttgcttggcactcactttctcttcttttctgttgccttattttatttatctttcaggtttcaattctggaaagccttaacacccgactgtggtttgggcacattttatatccttccacagcttacagtcctcttgccctcttgtagcactttcagcgctgtgtcaaactaacctattgcttttattctcccaccaactaggatgcagtagataattaacagaaatttgttggttggatggatggatatgctaaaggtcaaattgctaagactaaccatttaaagttctctttgtgcattcaaattatcgttcctacttctggtgccaagttatgctaaaacttccaaaaagtttttcaataagtcctttcacttttgcatatacagaaaaaccatgacttctcctgggtataattatttcagacttatttcagacactttacctacattgccttatacttactattctgtaaatatttatgcatttaaaaaatctaaatgttaagatcattggaattactttcagaagtattgtaggaattcaagccgggtatagcaacacacgcctgaagtcccagctactcaagagattgagcccaggattcaaggccagctgggcaacatagcgagaccccatctctaaaaataacagtgataatattaataatgccaggtgcagtggctcatgcctgtaatctcagcactttgggaggccgagttgggcagattatttgaggtcaggggttcgagaccagcctggccaacatggtaaaaccccatctctactaaaaatacaaaaaattagccaggtgtggtggtgcacacctgtaatctcagctactggggaggctgaggcaggagaatcgcttgaacccaggaggtggaggttgcagtgaatgaagatcatgccactgcactgcagccttgggtgacagagcgagactccacctcaaaaaaaaaaaatttccatacaaatgaagattaagtgccaaaacttaattttaactcttcgtttcttctcttatgttagacatttctatttttttcttttcttttttttttttttgcagacagagtctcacactgtcacccaggctggagtgaagagtcatgatcttggctcactgtaacctctggcctttaggttcaagcgattctcgtgcctcagccttccaagtagctgggactacaggcgtgtgccaccatgcctggctaattttttgtattttagtattttatgttttttgtattttagagacggggtttcaccatgttgctcagcctggtatcaaattcctgagctcaggcagttcgcccaccttggcctcccaaaatgctaggattacaaatgtgagccactgtgcatggcccatgttagacctttctaatcaggattcagcagtaccttagagtaacagataaaatggtgagtaaaacaacatttatttctgaagaaaacatttgttctaaagaaaaataaacaattatttttgggggcgtggaaatccatgttggttaaaagcctgtgctagactattatggtataggccaggcgcggtggcttatgcctataatcccagcactttgggaggccaaggagggcagatcacctgaggtcaggagtttgagaacagtctggccaacatggtgaaaccccgtctctactaaaaatacaaaaaattagccaggcatggtggcgggtgcctataatcccagctactccggaggctgagacaggagaattgcttgaacctgggaggtggagattgcagtgagctgaggttgcaccattgcactccagcctgggcaacaatagtgaaactccatccctcccctgtccccctcaaaaaaaaaaggactattatggtataaatcaaatttctagttttaattatgtactcctcaattttgaattttctttcagttacctgttctagcctagccacattttgttactgctacctgtcagaaacaaataccttttttgtttgtttgttttctatttttattttttgccaggcatcagatgatggcaaaacaaatacctttttaaaggttaagcagttttttcaaagtgtagcatcaaaccagaaaggtaattttttttttttttttttttttttttgagacagaatctcacagtgtcactcaggctggagtgcagtagtgcgatctcggctcactgtaacctctgcctcctgggtttgagcaattctcctgcctcagcctcccaagtagctgggactacaggtgtgcgccaccaagcccagctaatttttgtatttttagtagagacggtgtttcaccaagttggccaggatggtcttgatctcttgacctcgtgatccacctgccttggcctccctgaatgctaggattacaggcatgagccaccatgcccagccccataagggtcacttttaaaaagacgattgcctatggtttctctgtgaaaatagtccatttgaacttgtttgatgtaatttggacacatttggcagaaattacacactcatttttggctttgtttagttttaacttttttttttttagacggagttttgctcttattgcccaggctggagtacaatggcgcaatcttggctcaccgcaacctctgccccgccaggttcaagcgattctcttgcctcagcctcccaagtagctgggattacaggcatgcaccaccatgcctggctaattttgtatttttagtagagagggggtttctccatgttagtcaggctggtctggaactcccaacctcagttgatcctcccgccttggcgtcccaaagtaccagattacagatgtgagccactgcacctggccatttttttttgaaggcagggtctctctgtcctagactggagtgcagtggcacgattatggctcactgcagccttgacttcagtctcatgtgatccttccacctcagcctcccaagtagcaggtactgtaggtactgtcacaagtattataggcatcaagccagacaccaccatgtccagttaatttttgtaatttttgtagagacaggatctcaccatgttgcccaggctggtctgaaacttctgggctcaagcagtctgcccaccttggcctcccaaagtgctgggattataggtgtgagccactgtgcctgaccctagttttaactctttaaaaaatacttttatcttgggataggaattcagtccataattggctcagttttaaccatccttaacctagccaagggccaggaattaaacagaattctcagcagccaaattaaatgtctcaagcattaaagtttgttatcttggcttactgaagaaacatttaagtgcaaagtgcttatttacccttattttatttttatttttttggagacagagtctcactctgttgctcaggctggagtgcagtggcacaatctcggtccattgcaactcccgcctcccaggttcaagtgattgtcttgcctcaggctcctgagtagctggagttacaggtgccttccacaatgcctggctaatttttttatttttggtagagacaaggttttgtctttttggccaggctggtctcgaagtcctgacttcaggtgatccacctgtctcggcctcccaaagtgctgggattacaggcgtgagccactgcgcctggctgggtcttttttaagataacaatttctagttttttttttttttttttttttttttttttagtaatagaagaatattttcataacagagtcaagtgttgaagcaaaaaccacagtgtcaggattgaagatctgtaaattaaagtcagaaatgtaagatgttggccatatacctacagaagcacataactgtgtaacaaagttagtaaggcatcacttggctgatgtagcaaacatcataacacaggtagagcattcctagtctgaaaatgtgaaatctgaaatgcttcaaaatctgaaactttttgcatgctgagatgacgtcacaagttactttgaacatactactatttcactgtattttttttccttttttttttttttttttgagacagagttttgctcttattgcccaggctggagtgcaatggcgctatctcggctcactgcaacctccgcctcctgggttcaagcgattctcctgcctcagcctcccaagtagctgggattataggaatgcgccaccacgcctggctgattttgtatttttattggagacggggtttctccacgttggtcaggctggtctcaaactgctgacctcaggtgatctgcccacctcggtctctcaaagtgttgggattacaggcgtgagccaccacgcctggccaattttcactgtagtaatggtacatcatattcttttttttttttttttttttgagacggagtctcgctctgtcacccagcctggagtgcagtggcactatctcagctcactgcagcctctgcctcctgggttcaagcagttcttctgcctcagcctccccagtagatgggaccacaggcaagcgccgccacactcggctaatttttgtatttttagtagagaccgggtttcagcatattggccaggatggtcttgatctcctgaccttgtgatccgcccgccttggcctcccaaattgctgggattactggcgtgagccactgtgcccggcccaaagtaaccaattctttaaacccatccggctgggcacagtggctcatgcctatagtcccagcactttgggaggccgaggggggcggatcacctgaggtcagaagttcagaccagcctgacaacacagagaaaccccgtctctactaaaaatacagaaaattagtctggcgtggtggcagatgcctgtaatctcagctactggggaggctgagttaggagaatcggttgaaccctggaggcagacgttgcagtgagccgagatcacaccactgcactccaacctgggcaacaagagcgaaactccgtctcaaataaataaataaataagtaaaaacccatttacccccacaggcttgtgagactggttggaagaagtgctgctaggcagggcctgtgtgtttggaaaaaaaaatcactcagggtgtttgtgattataactgtctcacccttccctctaattcagaaaccattgcttaagagtggaaaaaaaaaaccacgaactgtctgtcttctgctctcacaccaaaaacaatcagcccgctgtatttgtagttcatgagcatggtgattgggtgttcatgcaggtgtgtgagatatgccacccttgaaccttgttacaacactggcacattctcagacctgaaaaaaaaaacacacataacacagaagacttctgtgaccaaatatgtggggtagggcaggtgcagtggctcatgcctataatcccagtgctttgggaggctgaggcaggtggattgcttgagcccaggagtttgaaaccagcctgagcaacatgatgaaaccctgtctctacagaaaaatacaaaaattagctgagcatggtggcatgtgcctgtagtcccaactacttggaaggctgaggcaggaggattgcttgagccctgaaggtcgaggttgcagtgagccctgaaggtcaaggttgcagtgagctgggatcgtgtcacctgcactccaacccaggcaacagagtgagaccctatcttaaaaagcaaacaaataaaaaaatatgggagtgtttttccctaccagcaagcaatcagttctgcatcaggcaccagctaggtgtcatctaacttaatactgacactgtctacttgagatagtgtcacatcccacagtttgaggtctcagtccccaagactaccgacaacacttatgccaatctcaagcctcaggttattttacctgtgcttctgaccaacctgccatgtatatatatgtacatatatatgtatatgtgtgtgtgtgtatataatgtagataccataattttttttctttatgagatgaaggtcttgctgtgttgcccaggctgatcttgaattcctgggtgcaagctgtcttcctgcctcagcctccgaatcactgggattacagtcatgtgccaccttgcccagctactgtcttttatttttgatgaatcctctgtgtccagtacagtctcaactggctataaactggggttcccacaaccccctcctcaggttcagttgacttgctgaatggtttgcagaacctggggaaacagttatgtttactgttacaaaggatgtagatgaaaagatgcgtaaagcagggtatgggggtagtggtgcagagcttccatgccctccctgtacatgtcaccctgcaggaacctccatgtgttcagctatctggaagatctctcaaccttgttcttttgagtttttatggaggcgtcactacgtaggtatgaaaccattggtcattggtgatcaacttcaccttcagcccctttcccctcctgggaggttgtgtggggtgggctgaaagtcctaaccctctaattatgcttttggtctttccaatgaccagctcccatccttaagctatgtaggggctgccagccatgaatctacccattaacatacaaaaagacatctctctggagattctaaggattttaggaattatattttaggaattatatgttaggaaactgggtcagagaccaaatacgtatttcacgatatcacactgttacattcttatataatcttgcattttatttttttttacctgttgatctgtccatgttgatatacatatgcatctaattctttccttttaactgctgtgtattccatcgatgacatgaatataccactatccattcttcattaccacattatatattacaaatgttgttgtagtaacattcggtgcatatgtaagatcttctcaaagtatatattttagaaataggatgccaggttttaggatatgtatttgtaaaattaactagataaggtaacattgcttgtcaaaggagtgcagtgatttatattcctatcagtagtataaaagacttcttattttcttgtatctttgccaacacttcctgcactatcagactttttggtttctgttgcctgtctgatgtggttgaaaccacttctttctttctttcttttttttgtttttttttgagacagagtctcactctgtcacccaggctggagtgcagtggagcagtcttggctcactgcaacctccgcctcctgggttcaagcaattctgctgcctcagcctcccaagtagctgggactacaagtgcatgcctcctccatgtctggctgatttttgtgtttttagtagagtcagggttttaccatgttgacaaggccggtctcgaactcctaacctcaaatgatccacccacctcagcctcccaaagttctgggattacaggtgtgaaaccactttatatatatatatatatcactatatatatatatcactatatatatatatcactatatatatatatcactatatatatatcactatatatatatatatcactatatatatatatcactatatatataactatatcactatatatatcactatatatatatcactatatatatcactgtatatatcactatatatatcacatcactatatatatatcactatatatatcactatatatctctatatctctccctatatatatctcactatatatcactatacgtatatcactatatatatcactatatgtatatcactatatatatatcactatatgtatatatcactatatgtatatatcactatatatatcactatatatatatcactatatatatatatacacatttttttctttttttggagatggattctcactctgtcgcccaggctggagtgcagtggcatgatctcggctcactgcagcctccacctcccaggttcaagtgattcttctgcctcagcctcccgagtagctggaactacaggtgcgcaccaccatgcctggctcatttttgtattttcagtagagaaggggtttcatcatttctcagcctttggctaagatcaagtgagacggggtttcaccatgttggtcaggctggtcttgaactcctgacctcatgatctgccccttcagtctcccaaagtgctgggattacaggcgtgagccaccgtgcctggctgccacttttttttttttttttttttttttttaaagatggagtctcactctgtcccccaggctggagtgcagtggcgagttctcggctcattgcaagctccatctcctgggttcctgccattctcctgcctcagcctcccggtagctgggactacaggtgcccgccaccacgcccggctaattttttttgtatttttagtagagacggggtttcacagtgttagccaggatggtctcgatctcctgacctcgtgatccatgcacctcggcctcccgaagtgctgggattacaggcgtcagccaccgcgcccagcctggccaccacttcttattttaatttgcttttgtcagatcagtagtgtgcttgagcatgttttacatttactggtgattctacttctctgtgaattgcctattcagtttcattcactgataactggcacaaactatgtctggaagtacatagctatatatttttaatggttttatagtattccattataggatcatcacttaggtgaaaaggatcattacttggggaatccagagtttaaaagagacttaagagatatattatccaaatgtaatgtatgaaccttgtttggatcttgagtgtaaaaacatatatgagacaacctggaaaactggatattccttattatatcattaggggttgggaaatggtgctatttcaatccagttattccttcaacatttatcagctaaattttcttgtaaaggaaacttcccctcatcaactgtttggttaccctaaggtatagtttgtatataagaaagacaaaaagtgctggattcgtcaattcatactttaataatttccaagtgctctttcctgttttgtttccctcctcactacttttaaaaatagcatactattctggttccatgggagcaatgacttttctttggtctctgagtatattaattatagttttcatttgttccctgctttgtctgttttgtcagagtcccatttttatttcttatagttttggtttctctctttcaggctagaacttaaagtgccttataattcttaattatccttcatgttttaaaagtgagacactaaaaaaggagggttggaagctttgtgtgcctggatacagtttactgcctcttggcaacccagatttcaatatcccatggtcctttcgtagagacacttgagtttttccagagaaggatagtctctttgaggtgtggctggtggagtggtaggtaagcctagatatttacattattgcaacctggatgaaggcaggaaggaggccctattactgtttagtacgtagactttagaccttcatgtaattccacttgtcatttggcacctgcctggctgtgcctagagtgttcctagtctaaaatttctggttgagtttattgagaaaacaaacctcttatttcctgtgtgggtgagcaaggaaggccacctggccagtctggtgtgggactgtctacctactagggatattactaactagtgattttagacttccactcaaccctcctgttttcagtcccaccctcacacaccacaccagttttctattacatactttccatagtatggatctgttataattttctttttttttttttttttttttgagacggagtcttgctctgtcgcccaggctggagtgcagtggcgcaatctcggctcactgtgagctccatctcctgggttcacgccattctcctgcctcagcctcccgagtagcagggactagaggcacccgccaccacgcctggctgatttttttagtagagacggggtttcaccatgttagccaggacggtctcgatctcctgactttgtgatccacccgcctcagcctcccaaagtgcagggattacaggcgtgagccaccatgcctggccagatctattataattttcttatccactgtctgttgatagacatttaagttatcttccagttgtgaactgttacaaatagcccttcaatgaatgtctttgtacatgcccctttctgcatatttgctttttaatggcaggacaaacttttttcatattaaacaccactgatacttttattccaataatttattttcatttttttgttttttttaaaaagagggttttgctattttgcctaggcttgtctcgaactcctgagctcaagcaatctgtccacctcagcctcccaaagtgctgggattacaagcatgagccactatgcctggccaacttttttttttttttttttttacagaaatatctaaacattgatgattaccgagaatagtagaatatatttgaactcccatatacccatcattcaacttcagcagttaccaacaaaatgccaatattttttctttagaaaaaaaaattttttaagagacatttgcttgctctgtagcccaggcaggcgtgcagtggtgtgatcatagctcactgcagcttagaactcctgggctaaagcaatcctcccagtttagcttcctgagtagctagaactacaggtgtctgccaccacgtccagctaaatttttctttttctttttttcttttttttttttttttgtagagacaagggtctctctatgttccccaggctgttctcaaactctcggcctcaagtgatcttcccacctttgcctcccaaagcactgagattacaggcgtgagccactgtgcctggccaaaccaatttttcaccataatattaaggcagaccaaagactatatcattgtatctttaggagatagggctgtttaacaaatataaccacaacaccattaacacatctaaaacttataaacaattactctttaataatatttaatacttaataagtgttcatatttccctaattgtctcttaaatgtagttttgtagttggttgttttcaatcagtatctaaacaagagagtctatacatttatacttggttcaatatgtctcaagttcctctttatataatggttctttttttctttttttccccacttgacatttattgtagaagaaaccaaatcatttgtgttaaaaaattttccacattttggacttggaagggattatatcccttgagtgttatttaatatggtcttcaatcctgtcttatttcttaaaagaaattacatttaaaaacaattacatttaactaattaatataatatcttgatggacacttaataagccagccctttatttgatactattttttagacaagtactatagtcaaagtatttaaatggctattctttttcttttctttcttttttcttctgcatctttactccaacaagcaacaacctttagggaattttttttttttttttttttaactttgggagcttgtcttttcaaagtattcatttgtttttccccagaacagtggggcgaaacagtccctataagccatctggacttaaaagcattttgcttcatcacaaagcttactctttttagatcctgacataagtctgtattgtccactgatttttttttttttaacggtgtctagttgctcccaggagagttgtctgaagtcactttaatgttgttgctggcctattagttattgaaagggaagaggggtatttagtgaagatgtgttattatacctgctgaaaaagctcattcacaggcccttaatccccctagtccttaaaaaaaagtgggtatgtgtgtgagaaaaacagaaaaggggaggagtatgtgcgtttcataccaacatacctgagtgatctgacaaatgcttgtgctgaggggactctctggaatttccagggctaatgtggttttataatatgcaaacaacaacaacaacaacaaaaaaacagaaaaacaaacaaaaaaaactgctgcgcttctcctgccacgattttgctgttggcctaaccctatcgtggttattctaaggtttgccaagcgtagtagagggtgaccaacttataaagtcatgccactggcaagcaattaagtcacattaaatcattaatgactatcctagactttttatgagcattcatttccttttttttttttttttttgtatacagggtcttgatccgtcgctcaggctggagtgcagtggctcactctcagctcactgcaacctctgcctcctgggcttggtgatcccctcccacctcagcctttgagtagctgggactacagatgcacaccactacaccaggctaattttcatatttttcgtggagacagggtttcgtggagacagagtcatattgcccaggctggtgtcgaactcctgagcttgagtgatgagccctccttggcctcccaaagtgctgggattatacaagcatgagccaccgtgcctggcctgtgctttttcttgttcacatatgtaatttcagtgtggttacattatatgcagacttgaactatgtgatttttaaaagtttcatttcatattcagagtttgaaatgttaccttctcatttcagaaagtcttcagaaatcatgttatatgaaagcctgactgagctgtaaaccaatgttgtgctgttatcctatgttggtattacctaggcagtaacagaaatatcagccatctcttatcagccttaacctcaattaggtgactgttgaattatgcaagatcttttgtaaatcgatcttttttataaaatgtaattacccatgattaagacctttcatcttctgttaaatttcaatcaatagaacatagggctctcttgtaacttactacatttcccagtaccttggaatatttaaaacaataggggctcaagttgtgttttgaaaagatggatgaatgtaatctttttttttgagatggagtcttgctctgttgcccaggctggactcggctcactgcaacctctgcctcccaggttcaagcaattctcctgtctcagcctccccagtacctgggattacaggcatctgccaccacacctggctaatttttgtatttttagtagagatggggttttgccatgttggccaggctggtcttgaattcctgacctcatgatctgcttgcctcggcctcccaaaaatgctgggattacaggcttgagccaccgcacctggccaagtggaatcttacttgtcttttttactcgctttgtgaatcagagagattctcaacttattctttagtttatagtttacctttacatcgactcaaaatttaatggtgaattgtagttacctgggcatgccatgatctttagacgtttgcatgtgctgtgacctctgcctggaatgtctttatctcagtaaaggttttaggcaaaccattccttttagagtaagctaaaatgacttctctcttttttaaaaaaatagtatatatggccgggcacggtggctcacgcctgtaatccagcactttgggaggctaaggcaggtggatcacctgaggtcaggagttcgagaccagcctggccaacatggtgaaaccttgtctctactaaaaatacaaaaaattagctgggcatggtggtgggtgcctgtaatcccagccactcgtgaggctgaggcagggagaattgcttgaatctggtaggcagaggttgcagggagccaagatcatgccactgcactccagcctgggtcacagagcgagactccatatcaaaaaaaagaaagtgtgtgtgtgtatgtgtatatatatatatatatatatatatatatatatatatatatataaaataaagtgtatatatatacatataataagtagatatacacatatatattataattatatatatataattttatttcaatattttttggggaacaggtagtttttggttacatggataagttctttagtggtgatttccgagatttcggtgcacctgtcgacttcttttttgtttgtttgtttttttgtttttttgagacagagtttcactcttgttgcccaggctggagtgcaatggcacagtctcacctcagtgcaacctctacctcttgggttcaagtgattctcctgcctcagccttccaagtagctgggattacaggtgcccaccaccaggctcagctaatttttgtatttttagtagagacagggctttaccatgttggctaggctggtctcgaactcctgacctcaggtggtccacctgcctcggcctcccaaagtgctaggattacaggcatgagccaccgtgcctggcccaacttctgttttttttttgtgtgtgtgtgttttgttttgttttgtttttgagacagaatctccctctgttgctcaagctggagtgcagtggcgcaatctcgctcaccgcaacccctgcctaccaggttcaagtgattctcctgcctcagccttccgagtagctgggactacaggcgggtgccacctcgcctggctaattttagtatttttagtagatgcggggttgcaccatgttggccagagtggtctccatctcttgaccacatgacccacctgcctcggcctcccaaagtgctgggattacaggcgtgagcaactgtgcccacctcccatttttttttttgagacggagtctcactgtgttgcccaggctggagtgcagtggcacgatctcggctcactgcaagctctgccgaccaagttcatgccattctcctacctcagcctcctgagtagctgggactacaggcgcccgccaccaagtccgcctaattttttttgtatttttagtagagacgaggtttcaccgtgttagccaggttggtctcgatctcctgatctcgtgatctgcccaccttggcctcccaaagtactgagattacaggtgtgagccactgtgtccagccttgacttcccttttttaaagcagatttagtcacttcttcctctctgctttcattatagcacttagcgtgttacactgtaaatgtttatgatacgtctttgatggctctcatacagtgagtactcctattggatgggtgggcaaagagttttagttttatatttaacatgttattttatctaagaataagtcctatgaatgacattacctagtttgtagtaaatatcatcatgctgcctaactgcctagcatttggagaataggcattgtgaataggtgtgtggcttaactattacaacagctttttcctagtctcttaactatgacaagtttttctttgactacagagtgacggactgggatgtttcctatttttgttatctcagttagtgtgttaagtggaaattatagaagtagaaggcagacatgtttctttgaagtaaatcaagaagactttaaaaagagggtcagggccaggcatggtcgctcatgcctataatcccagcactttgggaggctgaggcaggaggatcgcttgagctcaggaattcgagaccaggctgggcaacatggtgagaccttgtctctactaaaaataagaaataaaaaaaatttagctgggtatagtggcacatgcctgtagtcccagctactcagaaggctgaggtgggaggatcgcttgagcccaggaagtcgaggctgcagtgagccatgattgtaccacttcacttccagcctggatgacagaacaacacctcatctctaaaaaataagtaaatgaaaattaaaaattaaattaaacaataaagaaggtcagccatgcttgtactatacaaacctagtaatgaggttcagcagaactcatgtgctaccagcccaactaagatctctgaatgtagaagggaagcagaaagccctgagaactttctttttagtgtaacccatgccactcattgcccaagtattttgttgatagtatgaaaaggttaggtatagagacaaagaaactattctcattacttcccttatgctatacctccagccttcatccaggaaaaaagaggactcttactaggaccacgaatccaaacctttttctgccaagagctgtattttggcatctgtttgaatttcatgacaccgtctctgtttctattcctgttttctcattcataaattcttatatcaatgtttcccactttcacatgattgctaattgctatatagagctatgccatttctgaagtatttttgtaattatgagtgttctgctttctgagctattctaccctacagcaacttctgtttatgaggttacctatattgtcagggatatttctcaaaacagtggcccaaaactagactatttgatggatatttttcttggatagcaatttagaaacttccagtcacttgttactttttcttgattcttgattattctttgaaagttagtattacatttatcctactcagctttcagtgccctgtgtaagctattagggatgtcttatcagaactgaggaacttttatttttgttgcatattagtgattagcattttattttttattttattattttatttattttttgagacggagtctcactctgtcacccaggctggagtgcagtggcaccatctcagctcactacaacttctgccgcctgggttcaagcaattttcctacctcagcctcccaagtagctgggattacacacacctgccaccacgcccagctaacttttgtgtttttagtagagactgagtttcaccatcttggctaggctggtcttgaactcctgaccacccaccttggcctcccaaagtgctgggattataggcatgagcctgtaatttttggagacagagtcttgctccattgcccaggcaggagtgaagtggtgggatgtcggctcattacagcctccacctcctgggttcaagcgattcttgtgcctcagcctcccgagtagctatgactacaggtgcatgccaccatgcctggctaattttttttttttttatcgtgttttcagtagagatggggtctcaccatgttgctcaggctggtctcagattcctaagctctggcagtctgcccacctcggcctcccaaagtgctaggattacaggaatgagccactgcacatggctgtgattagcattttaaatgaggatggcagctgtacgtttccaaaccaagacttaatacacatttaaaattgggattttcagccgggtgtggtggctcacacctgtaatcccagcgctttgggaggccgacgcaggcagatcacctgaggtcaggagtttgagaccagcccagccaacatactgaaaccctgtctctaccaaaaatacaaaaattagctgagtatggtgatgcatgcctgattcagctatggtgattcagctactccagaggctgaagcacgagaactgcttgaacccaagaggtggaggttgcagtgagctgagattgcaccactgcactccagcctgggcgacagagtgagactctctgtctcaaaaaaaaaaaaaaaaaaaaaaaaatgatttccaagaggataaaaaattatttttacaaaatcaacctcaatagtgtttataaatggggaaaaatcctccttgatttcttttagaacttgaagatgcactgataaatgtatatagctttgagtttcacctatttatctttctgggtataagatctgttttcacaatatactcaaaagagtttatgattccaagaagtttaagatctacttagaacaagaaaggagaaaatgtgcacacgtttgtgaaagacaacattccattttgtaatctctaagtttatctgttttaatttgtttgaaggaaatgactcaaagtatgtatttgctttgaaatatttttattattgctcgtactttcctgtgaaaggaaactaaagaaacgagatttctctttggagataatagccttgccaatccaagacctgtcacatcacttaaaaaaaaatctcttttctctctgccatatttatttaaagtgatatagataaaaagcctcagtagtcataataaaacgtgaaaaattctgaagcttgaatcattccacaaaggtaggtctttttggaattgtcgtattctgtggtatccatcttctgaagctgaacttggtcgctaagcaacaaagcagatgtgaaactgtgtgtcccttattaggtgtctcctattaggcagaaaggagttgtaaataagcaaaatagtggtaaaaatttttggtagcagtttagtagcacagcatcttcataatgctatatgttttttaaaatagtattttatccatagcacaaaaggtgcctaagataagaatttctgggctgggtgcggtggcttacgcctgtaatcccagctcggcctcccaaagtgctgggttcacctgaggtcaggagttggagaccagccttgccaacaaggtgaaaccacatctctattaaaaataccaaaattagccaggcatggtggctcatgcctgtaatcctagctactcgggaggctgagacacgagaattgcttgaacctgggaggtggaggctgcagtgagccaagatcatgccactgcactccagcctgggcaacagagccagactccatctcaaaaaaaataaataaataaaaagcaaaatagtggtaaaattttttgttagcagtttgatagcacagcatcttaagtgttacttggtaaacataatgctgtatgttctttaaaacagcattttatccgtaacacaagaggtgcctaatataagaatttctggactgggtgcagtgactcacacctgtaatcccagcactttgggaggccaagacaggcagatcgcttgaggtcaggagttcgagaccatcctggccaacatggtgaaaccccgtctctactaaaaatacaaaaaaattagctgggcgtggtagcccatgcctgtagtcccagctacgcagaggctgaggcaggagtattgcttggaggcaggagtattgcttgaagccaggagatggaggttgcagttagctgagatggcaccactgcactccagcctgggtgacagagcaagactccatctccaaaaaaaaaattttttttttggttactttcccagatatagtagttaagttagccaagggagcatcattttcaaagcaggccaaaaaataattacattttcctattaattcttagtctttgcttatatatcaaggcaaaatgttgaaataacttactcagacttcatagtttctgcttttctatttaacgtaaccttacatcatctgcttgcattcagttctagccaatgaacacttggaaggcagggctagttggatactcatagtcatgttccctgtgcctggtacatagtaagtagtcagtagatgtttcttgaatgaatgaatgatttattagtttgcctcttttcctatatttactgtaacctttacttttcctatatatggtcatcttgaatattctgaaaaataaacagtgacttgatttccccagaagtcccacaaatatgaaatgttttcatagaaaagtatagcgaagaggtgctaaacttggggtttgtggaaggaactacagtgtctctaagccctctgagaaaaataggtggcatttgacatgggcgggggcgttttttctggggaaatatggttcatagatggatcaaatttccaaattggtctttggaccccctaatgattaagaaccaatgttatagggtttgtagttttcaggcttcaaagatcaggaaagttaaacatggtggctcacacatgtagttccagctactctggaggctgaggcaggagggttgcttgagcccaggagtctgaggccagcagttcagcagttgtagaccagcctgacaacatagtgagacctacatcttaaataaataaataaataaataaataaataaataaataaaataaagaggctgtgtgtggtggctcacgcttgtaattccagcactttgggaggccgaggtgggtggatcacttgaggtcaggagttcgagactggcccggccaacatggtgaaaccccgtctctaccaaaaatatacaaaaattagccgggtgcggtggcaggcacctgtaatcccagctgtgcgggaagctgaggcaggagaatcacttgaactcgggagccagaggttacagtgagctgagatggtaccagcgcactccagcctgggggacacagcgaaactcagtctcaaaaaagaaaaaaaaaaaaaagaaaaaagaaaaaccaactcaagcttatgtaaaaaaggaatttattggattttgtaactgaaaagaacaaaacacactgggaaaattctggctccaggaatcctgggtacaaatagtatctttaattaaagtttttctcccctttgctctttttctctatattggctttagtctcaggcctgctcttctctatgctggaaaaagatgtcagtctgcagcctaggcctgctaggtttttagagtttaagaactggcagatgtcccagagaggacatctcagtttggttcaaatcatgtgcccacccctagggagttggggtcatcaccaatcaaattacatggactgaatatacttagcatgaaactggagagagaaagttccccaaaggaacgtaatgtgtgtagacaaaaaaacaaaaacaaaaacccatgtcctctgcagtgattgaaaagtttgaggacagttaatataggtaatagactgacaatttcatgttaaaactaggatatattgtagtgatacctaagttttttgtgaattataaatttttctataagggtttcagtttttttaacttggaaaattttcttcatttattcatttgtttaacaaatatttgagaacctgctatgtgctgctatcatcattctttgtactgggtatacagcagtgaacaaaacaaaaatccctgacttcatggaacccacattctagtgaggacagacaagtaataagtaacattaattactaaaatagcatgttggatgaggttaagtactctaaagaaaataaacagggaggagagatagggagtaggtatcacaggtttttttttttttttttttttttttttgagacagtcttgctctgttgcccaggccagaatgcactgcagtggcacaatctaggctgactgcaacctccatctcctgggttcaagcaattctcctgcctcagcctcccgagtagctgggattacaggcgtgcaccaccatgcctggctaatttttgtatttagtagagatggggtttcaccatgttggccaggctggtctcaaactcctgaccttaagtgatccacctgtcttggcctcccaaagtgctaggattacaggcgtgagccaccatgcctggcctggtatcacagttttaaataggttggccaaagaagccttcaccaagaaggtgagatttgaacaaagatgtgaaggaagtaagtagagagcaagctgtttggatatctggaagaagagaattctaggtagtaggaagcaagtgctgaggcttgaagtgtttgaggaactgcatggatgcttgaatcagagaatgggaaggagaagagggtaggaagagaagtaggggatgatgtcaaagaagtaagagaatggtggaagcatgttgtgtagatccttagaggctatggtaaagaatttaaaccactagagcgttttaagcagaggataaattgtttttactttttttttttttgagacagaggtttgctcttgttgctcaggctggagtgcaatggcgtgatctcagctcaccgcaacctctgcctcccgagttcaagcaattctcctgcctcagcctcccaaatagctgggattacaggcatgcgccccagacccagctaattttatatttttagtagagacggggtttctccatgttggtcaggctggtctcgaactcctgacctcaggtgatctgctcgcctcagcctcccaaagtgctgggattacaggcatgagtcactgctcctggcctgcttttttttgagagggggtcttgttctgtcgcccaggctggagtttagtggcgtgatctcagcttactgtaacctccgtctcctgggttcaagcgattctcctgcctcagcctcctcagtaactgggattacaggagcctgccaccacgcccagctaatttttgtgtttttagtagagaccgaatttcaccatgttggacaggctggctggctgactttttaaagaatcctcctagatcctctagaatatattgtagaggattagggtggaagtaagaagactaattaggagactttcactgttgcagtaatccaggcattagatgattgtggcacacaccaggatggtggtggaaatgatgaaaagcggtcagatctgaaggtagatttgctgatggattggatatgtgaggtactagagaaacagaagagtcaaagctgactccagagttttggtcctgagtaactgaccacagtaatttaatgagctagagaagaccaggagaggagcaagttttcacatgctaaatttaagaatttaagatgcttttttttttttttttttttttttttgagatagagtcttgctctgtagcccaggctggagtgcagtggtgcgatctcggctcactgcaacttccacctcccgggtcccggttcaagcaactctccttccttagcctcccaagtggctgggattacaggaacgtgccaccatgcccagctaatttttgtatttttagtggagacagggtttcagcatgttggccaggttggtcttgaactcctgaccttgtgatctgctctcctcagcctcgcaaagtgctaggattacaggcgtgagccaccacacccagccttaagatgctttttaaacatccaattgaagttttctagtaggcagttggacatacaaatctggaattcaggtctgggctagagatagaaattcagaagttgtcagcatatagttcgtacttaacgccatgaaactggacgcgatcactagggaataagtgtaaacaaggaagagaagatgtgtccaaggacggagcatgccaatgttaagaagttggggagaaaaggaggtactaccaaagaagaccaagaacgagcagcaaacaagaaaacatcctggtagccaaattaaaaaaaaaaaaaaaaagttttaaggagagcggatcacttgtcagatgttgctgatacaacaatcaagatgaagactgagatttaatgattgcacttagtgttactatccttgatgagaacaggtttggtaagttagatttgagtggtggagttattcctaggacatgtccttttcttaggaatttaaactccatggttcaggtgaatctatgactattaatcacacaaccatttaacaaatatttattgattattccatcattcttttgttctctattgtacatgttatagatttttaagttgtctggaagtcaagatgcatatgcaagtatacaaaagggtttatatatttgtagtaagatatgtatatcatatggaatgcctataacatgaagtggaaacaattattttgttatttttttcttctatatttgggagttttttaaacttaatttttatagaaaaactaaaaatcaacccaaggtcataattctgagatctaagtagttaatacctaattgtgattattgattccaagaaataacaggagttgaaaatgtaaagtttaatttctctgattaaatttatattgttcttctttattagaaattcattgaatttgaagactctcaagaacaggaaaaaaaggacttacagacccgagtggaatctttagaatctcaaacaagacaacttgagctgaaagcgaaaaactatgctgaccagagtaagtaaaacatttcttctcataagtacactaaagattgggcttggccagacgtggtggctcacgcctgtaatcccagcactttgggaggccgaggtaggaggatcacttgggttcaggagttcaagaccagcctggtcaacatggtgaaacctcgtctctactaaaaatacaaaaattagctgagcatggttgtgcatgactgtaatcccagctacttaggaggctgaggcacgagaaccatttgaatccgggaggcagaggctgcagtgagccaagatggtgccactgcactccagcttgagcaacagaatgaaactgtgtccccccaccccccagaaaaaaaaaaaaaggaattggctctaatggtgcaatgactcatcctgaaattcgactaaggttctaaatacaaacttggaattgtcatcccagactcaagagtgagacctaggacctagggttagttcttttttattcacattttcacatggtacccatgtgtgcagaactgactaaaccagatatatcgatcagactcacttcaatttagatctcagcctttgtttgtagttaacattatgctttaaccattatgcaagtgtgtgtgtatgtgtggatcatttcctctatttttgatcaagtacacaaagctccattttttctgttttgctttgaaatgtaaaaatgtaaggtaaacttacagctttgaagtatgtatttaaaaattacctaagcatgtaattagatactggagaaaaaaaagtactgaatcctcttttttgctcctttttttaatggaaaaatggggccatttggggggaatagaacttcatttttcagaatcattttatttttaatataatttcatattttcttggtttttaaaattattgtttcaaacctcaaggatgattttcccctttggctaataaaaacagacctaattaagtcaaaattagaaaaaaaaaaaggtgagaaactttatggcctattttcatgtctgatataggtaggcagacaattctctgcttttctcccagcattgtaaactttcagaatcctagggagcaaaggatggccaggcagctactctatccacattactcatgaaggctacatagtgacaccagctataaaggtacagccattcatgatggaatgccttcgccagcactcttggggcgtgtgtgagaactgactgttctctctagtactctggaaagacggaatagagctaaattaaaaccactggaaatctggagttcaagcattctagaattcaaggagaactcaagtggctattaagcagatgtcctagaagagggccaatggatgtttggtaacagaagccaacttgagcgagagaaaatgagccgtgtgtcatgctttgtgtttttagccttgtggatacccagagttgttggatacctttgttaccattgaatacattgagtgacttctatgatttctaccatagaaatttgaggtttgctgggtatgatggctcatggctgtaatcccaacactttgggaggtgaaggtgggaggattgcttgagccttggagtttgagaccagcctgagcaagatagcgagatcctgtctttatgataaaaaaattaagaaaacgaggccagacgcggtgattcacacttgtaatcccagcactttgggaggctgccgaggcgtgcagattgcttgaactcagggtttcgagaccagcctgggcaacatggtgaaaccccgtctctaccaaaaatacaaaaattagctgggtatgatggtgcgcacccgtagtcctagctatttgggaggctgaggtgggaggatcacttgagcttgggaggtggaggttgcagtgagctgagattgcaccactacactccaggctgggtaagagagtgagaccctgtctcaaaagaataaaaaaatttgaaatctcggaggactgcatgatggactccacagggcatccactaatagatatagtactgtagtcacattactatgaatactattcatctggagaaatggtcttgtggcaattgcaagcttttggtacatttcaagagttgaaccttttctgttcaagaaagaaaatttaactattggaggtaatgtttaaatcctaatttgattgtacttttttttaaatagagacaaggccaggcacggtgggtcacacctgtaatcccagcactttgggaggtcgaggcgggcgaatcacctgaggtcaggagtttgagaccagcctgaccaacatggagaaccccgtctctactgaaaatacaaaattagccggacatggtggcacttgcctgtaatctcagctcctcgggaggctgagacaggagaatcgcttgaccccgggaggtggaggttgcagtgagccgagatcacaccactacacttggcctgggcaacaagagtgaaactgtctcaaagaaatagatagatagctagctagatagctagatagctagctagatagatagctagctagatagctagatagctagctagatagctagctagatagctagatagctagatagatagctagatagctagctagctagctagatagctagatagctagataagatagatagatagagacaagatctcattatgttgcccaggctggtctcgcacttctgggcttcaaagtgctgggatttcagacatgagccactatgcctagcatgaagggattatataatcttttagaaccaaacactaaagacacagttgacagactcagcctacctttcattgttttacgtattaagttttcttgttgatatctgcagggtacacaaagttttctttctgtcttttttttttttaagacggagtcttgttctatcgcccaggctggagtgcagtggtgtgagctcggctcactgcaacctccgccccctggggtcaagtgattctcctgcctcagcctcccaagtagctgggactacaggcatgcaccaccatgcctagctaatttttgtatttttagtagagatggagtttcaccatgttggccaggcttgtctcgaactcccaacctcaggtgatccgcctgcctcggcctcccaaagtactgggattacaggtgtgagccactgcgcccagcctgggtaccaagttttcaataagaaattattatttattgaaaccggatctcactctgtctaacgtgtgcagtggcaggatcgctgttcactgcgacttgtgcttcctgggctcaatcgatcctctagcctcagcctcctgagtaactgagactacagtcacaagccaccatgcctggctaatttttgtattttttgtagagacagggtttcgccatgttgcccaggctggtcttgaactcctgagctcaaagcagtccgcccgcctcggcctcccaaagtgctggcattacaggcatgagccaccttgcccagcctgaaaaaaattttttttctttttcttttttcttttccttttttttgagatggagtcttgctttgtcacccaggctggagtgcagtggcgcgatcttggctcactgcaacctctgcctcctggattcaagtgattctcctgcctcagccttcctagtagctgggattacaggtgcctgccatcacccccagctaattttttgtatttttagtagagacagggcttcactgtgttagccaggatggtctcaatctcctgacctcgtgatccacatgcctcggcctcctgaagtgctggatctttttctttttttctcagagaccgagtctggctctgtgtcccaggctggagtacagtgacacgatcatagctcactgtatccttgaactcccaggctcaagtgatcctcccaccttagcctcccaaatagctggaactacaggcatgagccaccatacctggctaattttaaaactttttgtagagatggggtcttgttatgttgttcaagctggtctcgaactcctggtctcaagtgatccttgcaccttggccccccaaatgctgggattacaggtgtaagccactgcgctcgaccagaattccttttttgacttggaaaagaattccttgtctaacatccttttgtgcattaagtaattggcttctgtgattagaggaagaattaccttatacttgaaattgcatttttgatatcaaagtacctttaaaatgtctcacactcaaaaaagaagcagaagatactgcttctttttttcccaaaagtatctaagtggaatgaattactaattatttcacatacattagcccttttattactaaatttaaaaaatctgtttcctattcctttctaataaatgtaaacaaaatatagtggtttcttttcttcttcttcttcttttttttttttttttttttttttttgagatggagtctggctctgttgcccaggctggaatgcaatggcatgatattggttcactgcaacctccgcctcccaggttcaagcgattttcctgcctcagcctcccgagtagctgggattacaggcacccgtcattatgcctggctaatttttgtatatttgtagagatggggtttcactatgttggccaggctggtcttgaactcctgacctcagttgatccacctgcctcagcctcccaaagtgctgggattacaggcatgaaccactgtgcctggcctagtggtttcttaattaagggaagtgatcaatttaggggactgtttgagtatgtcaatttttttttcattgtcccagatttgttatccagtccagagagtcataccttttttggaattgtcatattctgtggtatccatcttctcattcctctctccaaaagcattaattatgttttccattttaattcaaagactttataaaaatgagatcatttaaaaataattgacaatactctagggaaaggaggaagaaattcttcatcaagtattagatatggtcttgagcttaatttgatctaaaaactttatttttgttatgaatatattatcctccaaagaatttctcccctgggagtctgctgttcctttctgaaataaagcttgctgtataaagaacaattaaggaacttacaaactgtggttaatcaaaattgaccgttcagatgcacgaagttgataacacgaaatcttttttctatgaactgagttattttttgagctggacccttgctctgtcacccagactggagtgcagtagcaccatctcggttcactctgcctcctgggttcaagcaattctcctgcctcagcctcccgagtagctgggattacaggcgtgcaccaccatgcttggctaatttttgtgttttttttgttttgttttgtttttatttttttgagacggagtctcgctctgtcgcccagtctggactgcagtggtgtgatctcggctcactgcaagctctgcctcccgggttcacgccattctcctgcctcagcctcccgagtagctgggactacaggcgcccgccaccacgcccggcttattttttgtatttttagtagagacggggtttcaccgtgttagccatgatggtctcgatctcctgaccttgttatccacctgcctcggcctcccaaagtgctgggattacaggcgtgagccaccacgcccggcctaatttttgtatttttagtagagatggggtttcaccatattggccaggctggtctcgaactcctgaccttgtggtccgcccacctcggcctcccaaagtgttgggattacaggcgtgagccaccgtgcccggcctgagtcatcttttattaatgctttggaacttactcccttctcctgaaattggagtctttttctcttttctagtgaattgttttcctttctcttccttttgtttttttctaagccttaactggtgtaatatgaattctaagtgtatcttaaattttcttcagagtttttattttaccacacttaaacattcccccactttttctggggggaaattatttgactgttttttcactttaccaccttaggtttttgttttttgtttttttttaaatctgcaatatgaatcaaagcttcttatttttaattttaaaaattacttatttcttaatttttttgagacattccagctctattgcccaggctggaatgcagtggtgtgatcatggctcactgtagcctcaacctcccaggctcaagcagtactctcacctctgctccgagtagctgggactacaagcacatgccaccacacgtggctaattgttttttttttgagacggagtcttgctctgttgcccaggctggagtgcagtggcgtgatctcggctcactgcaagctccgcctcctgggttcacgccattctcctgcctcagcctcccgagtagctgggactacaggcgcccaccaccacgcccggaaaatttttgcattttttcagtagagatggggtttcaccgtgttagccaggctggcctcaaactcccgacctctggtgatccgcccacctctgcctcccaaagcgctgggattacaggcatgagccaccgcgcccggctgaagttttgtattttttgtagagccagggttttgccatgttgcctaggctggtctcaaactcctaggctcaacaatctgcttgctttgatctctctcatgttagaattacaggcattagccactgtacacagcctaaaaacttcttattttttaaaaaggtgatgtaggaagtaatctttaagtatcattagttccctatactattggaaaaccaagattgggaatgagtgctttttaaaagatgaaaacaaattgaaataaatgttatgtcaggagttcattaattcttgttttgtataatagaaaacagatgatctgggctatctaatcttaatgtgactgattttattttattttttgagacagagtctcgctctgttgcccaggttggagtgcagtggcgcgatctcggctcactgcaacttccgcctcccaggttcaagagattctttctgcctcagcctcttgagtagctgggacttcaggtgcgtgccaccacacctggctaatttttgtatttttagtagagatggagtttcacccttttggccaggctggtcttgaactcctgacctcaggtgatacgctcaccttggcctcccaaagtgctgggattacaggcatgaaccaccatacctagcctgattttttgttttttaaataaaatatgagaccaggcgcggtggctcacgcctgtaatcccagcactttgggaggccgaggcaggcgtatcacctcaggtcaggagttcaagaccagcctggccaaaagggtgaaactccgtctctactaaaaatacaaaaattagccaggtgtggtggcgcatgcctgtaatcccacctacttggaaggctgaggcaggagaattgctttaacctgggaggcggaggttgcattgagccaagatcacgccactgtactccagcctgggcaataaagcaagactcagtctaaaacaaaaaaagaaaatatgaattttgtgacaaagtaaatgtaacccaacatttaatttaaaataaacatttatttaggggcactgagatgactgttcgcagtacctgtagtgggaggagaggtggatgcaatttttttgttgagtgccatttgtttgagtgctggatgccttttctagttttcatgtttatacagtgtattagtgtctttaattttaaaagactgagtttgtcaattctcatgaacatattttaggagcacacatcccttttaaaaaatagccacaataaaaattcaagttctgctctaaagactacttcctttgttaaaaggggaaattttggttaaagttatttgctatttgagaagcaagaaaaagtaaagaaataggaactgaattaaaagacacactttacagcttttgatagtatggaatctatcatgttgcatgatttaacaatgttgaaaagttgagtctataatatgttttttaacaatttttggtcatgtttgattttggagatttctgattacttttcaaaatctaaatgaatataagaaattttttttactttttccaacatgaataaaggattttttaaaatgctgtatattattccttatctggagcagcaataatacgtcctgttaatatcttatgaaccttaaggaagagtctgtaatcgatattgtgtggaataaggaagttgtgaattgagaaagccttggtgcttttcaagtgtgtaaggagtgtaatcaactttgccattcatagtgtggcagtaataggtctttgtcagaaagtactttttatatttattgtctctgttgtatgttgtgtatttctatcttgtaagccaaatatctaaaatttgagtcaagcaagtatagatattttaatacagttgaaaatattaaactggtccagtatgcctagcattctgcctaggtatggttgtggtacacaagagtatgatatggtccttgtggttaaagaaatcatagtttagtggggggaggaaggggaagattatgcgtatggcctactagtctttttcccatatatattatatttttatatcattgtggttaggatgtatatttaattttgtatcttttccttaacattatcataagtatttttccttgttgtataatcttcattattatttttatgtccacataaatccaccatccagaagctatgccatctattaacaatttttgttttccctgaggactatgctttattttttcctctaatgagaattatttaatggccactgtgttttttaccatggcagcccagaaacagaacaaacgttgaaatgcaaccataacaactagtttgaaccttacctggttggcatatttaaattgttttttttcttgatccacgttttatacatgtataattaatatattatgctctattgtaaactgtctcaaatcctttgtggaatgaagaggtgaatcagggtaaaataaatgtaagaaatttaaaataaaaaaaccaaaaacttctgttggttggttggtcattttttctggtatactgaatcatattgcagtaaatatttttttacatctacaagttttcccttctattggtagttttcttagaatatatttaaggaagtaggtcaaagaattttagtgctttttggcatataatagtttggccatttctaatgtcaatagaattggagaagtaagggttagtagtaaattccattttgcttgtcataacttatgaatttgaagcattatttacagcatattagcacacagagctgatatagaatcatttattatttgattctctcttaggaagcttctgttgccctcaggctccttggatttacaacttattcttccctgagtatagagccattgccttttgtggagaagatgaaaagatttagatgacagtgatattttttttttagtgagtacttcttaatttggtggctatgttttttggggagtacaggttttttttttgtttttttttttaagagatgagggtctaattcctgtgtttaagtgatcctcccacctcagccctcccgtgagggagcccacctcaggtgcatgccactgcacccgtggctgtgattttaagctgttatatttagactcttctttaattccgcccttccttcctttaaatgaaaattcgtctttttgaattaaatggaaaaatgttgttggcactgaagtcaaatgtgttagatccttatactttgacctttctaccttttttgtcccccatgtaacattcctttgctttttacatcttgtgtcaggatcttagtctagtaaaatacctgcaagccttcactttgaaacattattattagaaggaaaacacttcttatttcttggtcataagaataagcactccactagatagaaagttgggggagatattaacataaacaataacataatttttattttaaaggaatgtttaaattttatttaattaattaaatttatttaaaggaattaaataaggcttaaaacagaccttcaacacaaggtgattgataaattaagaattttcacagcacataaaccattttaaagttgccaagtatcatttcatatcaaagttaatatttgagagagcctaaatattttctgtcgctgtttttcaaatcacctaaaaaaatacattcaggcttgtacaaaactttatcagatcctttactgtgctttgtgattagcaatgaatgttagtattttgaaaaaattaaataatactgtaataggacactttttccactttagttctatgtcaataggcaattccttctacataattttaagaatgataaaagtagattacgaagatttatatatatatattttaatgatgatatgtgtttttgttgaaagtttttttaatgaggcagctttaggagtttgaattatatcttttggttttaaaagaatgacaagttaattatttagaaagctacttttagtctgtttaatcagaatctagttctttgcaatactaagaatatctatatatttaataaacaatatatatcagctgtttcttatttagagcctacatatgagtgggaaagtagaaaattaggcacaagatagtttttgcaaacactaacattacttctgcttcattaggtaatacttgtggtctttagctgttttatgttttattatctgtatttgggctctttcatttttgagtctagtgttgtctattgagaagcttaaagttgtaatttataattaatatctagaactaaaggtatcagaaaattaagtttatgagtaaaagttaaaggatttctggtgatttgcttagagaacagggaaaatacgaataatttgattattctttcaaacatataaagggatggataaggagtgtagcaagctgtttgtctgttattttggaagattaagtgagagaaaatgaattttttggctttggttggtcatgaggaagtatttcttggccatgagggtgatacacaggaatatgtgcagaggttaagcgtggactgtccctacgtagagactttaggtaggagaatcatcagctttgttgtggatggcttaagtaacatcttcaagacagggaactgtcagatcactagaagtttctaccgctgggattctttgaagttatcctactctgttttgagaatatgatcattgattcatgatagctttaaaatatgtataatttcacattgtgtcattgattaataacatataatatctgaaaattttttgaagttgagagacatggtaaaggacttagttggtgaggagaggttgttattactgttttgatgtggttgtctgagatttctttgctcttaagtcagccttgcttacctgttgggacttctgatgctaaattgttcaaggagaagtttctgaaagaccacatgtcaatcttctgaggcccagcaacagttggactatctgccttccaggaacagtaaaaactgatgattccttttgagaaggcaaataatgagttggatatggcattctagcaggtctgtttctctttcttccccccgtaggcctatcagcagtctgatggggcagaagacaacagagatggaaggtgttccaaacttggcaaaggccatcaatctcaggaggtaagctctgattttgagccggcagagcaggtggctcttcctgccttaatcttatcctcttgctttttggaaagacggatagaaagagcgctcaaaatgaggctgaagtatctccatcattattctaaaggggaaattttggatttgtcttttgattgttcttttttcttgccccctcaccttttttttctttttagataacatgatttgcctttttttttttactccccagaaaattagcaattttaaaaatggcagttacttatcagttgttttgggataggatgaacagaatcttgtttatttccagttaatctcggcttggagctagttttgatgagtaaaatgacaaggttttagaattttccctgagatcgttttgaagtttaggtttatgtgataactattaaacaagaaatgaccttttaatacacttcaaatggaatgcaacaatataggtataggttaacttcatggtacttgaggctttcgaggatgtctatagtccttgccaggtgggcttttctttcctgctttccccttcccttctacttccttttcttttccctttaactgattccttagtggcattcaggactttaaagagatggctcttccacactttaaaatgacttctcaaaagtgtttataccatcttatgggacttaggccttgagtaagctgagttcattggatatgttgttgtactgagttattgtaagtattttcagaaaagaaaggttctgaatttgtattatttgatcttggtgtatgtgtgtatattttctaatattttctatgtattatatgatcaattatatatgatctttatgttacatgatttatattgtaagtacctacaaagataataataaaatttaggatcacagtatatgtaaagaaaacatgaaatacacaaagtcataaaacagtttctgttcaggttcttgctgtgggtgttaggcaggagagaatataccaccagaaaaacattcagaaaatcatttataataacagacgtaaactatcctttttttttttgagatggactcttgctctgtcgccaggctagagcgcagtggtgtaatctcggctcactgcagcccccacctcccaggttcaagcgattcccctgcctcagcctccctagtagctgggactacaggagtgtgccaccatgcctggctaattttttgtattttagtagagacggggtttcaccatgttggccaggatggtcttgatctcggggtttcaccatgttgaccaggatggtctcgatctcctgacctcgtgatctgcccaccttggcctcccaaagtgctgggattacaggcgtgagccatggtcttttttttttttttcttttttttttttgagacagagtctcactctgtcgcccagcctggagtgcaatggcatgatcttggctcactgcagcctctgtctcctgggttcaagcaattctcctgtctcagcctcccaagtagccgaagtaaactatttttaaaacataatggggactggaggcaatggctcacacctgtaatctcagtattttggaaagctgaggcgggaggagtgcttgagaccaggagatcgagaccagcctgggcaacatagtgagaccttgtctctacaaaaaatcaaaaaattatcttggcctggtggcacacgcctgtagtgccaactgcttgggaggatcacttgagcctggaggattgcttgagcccaggaagtcaaggctgtagtgagctgtgattgtgccattgcactccagcctgggaaacagaacaagaccctgtctcaagaaaaaaaaaaagcgtaatggggtaacatacctttgataatttggaatgctaacttttaagaggattttagtacatgtttataagctgatatatgttaagctaactgtagttgctataacgaactagccacaaaaattatatattaatgactcaaatgttatttcttgcttacgtaaagtttaaaaagtggatgtttcagataagtgggtggcttttgcggagacatgggcatttccccctttatagcttctaagtttgtcttacctgcattaagttggaggaagggtaaagggcatggagcatcgtgtgtggagggtttttactggaccaggcctaggagtagcacacatcacttttactactacttcagtggctataagtcagtcagaggctacctgcaggggctggggtggatagcctagctatttgcccaagcaaaagaggaaactgttttggttaacatctggccagtctttgcctcagcttaacagccttagtgggggccattagtatgttattttgcccaagtgttgaggcaaaggaatgattctgcctaaggcttagcaaccatctgcctattctttctactgtgaattatctgaggaagagaagagaaggacattttaatgaaatgtccttctcttataacataaatgttgagattttctttttgatcccttaccatttgactttttctttaaaaaacaggttattaaattaagacataatttgctcatacttgtgttaagggataggtttcaaatgactctgtttaaaattgaaatccaggctgggcctggtggctcgtgcctataattccaggaatttgggaggctgaggcgggaggattgcttgagcccaggagttcataaccagcctgggcaaaatagcgagaccctgtctctatttaaaaataaaataaaattaaaaattgaaatctaattcacatatcataaaatccaccattttattttatgtatttatatatatattttttgagatggaattttgttctagttgcccaggctggagtgcaatggtgcgatctcaactcactgcaaccttcgcctcccagattcaagcaattttcctgcctcagcctcctgagtagctaggattacaggcacctgccaccatgcccagctaattttttgtatttttagtagagacggggtttcatcatgttggccaggctggtctcaaactcctgatctcagatgatctgtccgccttggcctcccaaagtgctgggattacaggcctgagccaccgcacccggccaaaattcaccattttgaagtgtacaattcagcggtttttagtacaattttcaaggttgtacaatcgccaccactaattccagaacatttttatcaccccaagaagaaccaccccctcatacctgttacacttacttctgcttttctgcttccccttgtccctgaaaaccactaatctaatttttgtctctatagatttgcctgttctggacatttcataataataggatcatacaatatatggtcttttgtgactggcttctttcacctagcataaaggttcattcatgttgtagcatgtgtcagtacttccttccttttcataaccggataatattgttttatgggataccctccacccccatttcaattgcctatatatcctgctagagctagaaacaaccaaaactctaactttgctatctgaaagtctgtagtaatacagttttgaagagctgagtataatgaacaaccactttgggaagatattccttgggtttcctcttggcatcttgacttgtttagttcctcataaatgggtaagtagataacttaatgtttgaaccatctttacaatgctgtggttgcctactaggagtaggtagtatattagtcatcttgttttatttgtataattagctatcagtgacacatctgaatataactaagcagaatgataaaccttctgtttaattttaatgggaaagataaatgaattagttaagggccttaagtaagtagactgaggtgaacaggctctcatttactcctctactggagtggagaggaagatggaagtggatatgatacttatgctagaggataatacttaacgtctaatttatgtagatattttaacccttttattttttgtctgcttttattttatttttttaaaattccattttattattattttttacttacttacttacttacttatttatttatttatttttgagatggagtctggctctgttgcccaggctggagtgcagtggcacgatcttggctcactgcaacctccacctcccaggttcaagcagttctcctgcctcagcctcccaagtagctgggattacaggcatgtgccaccacacctggctaatttttgtttttagtagagaagagatttcaccatgttggccaggctggtctccaactcctgacctcaggtgatccacccaccttggtctcccaaagtgctgggattacaggtgtgagccactacaactggccctggcctgcttttattttagatgttgcaaaattcagtatttttcctgttatttaacaggttacagacaaaatacatttatatgaaaagctgagacagaggttaatttaagtatactttatgatttattttgtatcaaaaacttagcgaaaagatagacgtggtcagcatacaatttttttttttttttttgagatgtagtctcgccctgtggcccaggctggagtgcggtggcacagtcttggctcactgcaacctccacctcccaggttcaaacgatcctcctgcctcagcctcccaagtagctgagattacaggcatgcaccaccacgcccagctaaatttttttgtattttttgtagagatggggtttcgccatgttggccaggctggtcttgaactcctgacctcaggtgatacgcctgcctcggcttcccaaagtactgggattacaggcgtgagccactgtgcccggccagcatacaagtttctaatatgtaacagtaagttgaaaatatcttaaaataccactttttgtgcattaaaaacatgaaattttgtgtgtgaaagagatagtaaaagtttgagacctgtaattttaagacctttagctcttatgaaaataacaggcataaactatggtaatctagacaatggaatattagtcagtgctaaaaagaaataaactgtttgtccaggaaaagacgtggagtaggttgtgtgtggtggctcacgcctgtaatcccagcactttgagaggcggaggcaggtggatctcctgaggtcaggagttcgagaccagcctggccaacatggcgaaaccctgtgtctactaaaatacaaaaattagccaggcatggtggtgggtgcctgtagtcccagctactcagaaggctgaggcacgagaattgctcgaacctggcaggcggaggttgcagtgagctgagatcatgccactacactccagcctgggtgaaagagcaagactctgtctcaaaaacaaacaaaaaaaagatatggagtaacctcaaatgcatattactaagtgaaagaagccaatctgaaaaggctaggtactatatgattcccactatgtgacattctggaaaaggcaaaactatggagacagtaaaaagatcattgattgccaaggtttgggagatggtagggagggatgaataggtggagcacaggatttttaaggcagtgaacttattttgtttgatactataatggtggtcacatgtcatatttttgtcaaaagctgtagagtatacaacaccacgagtgtaccctaatgtaattgatatattttgggtgataagcatgtgtcagtgtaggttcatcgattgtaaaaggtataccactctgattctggatgttgatggtaggggaggttgcgtgtgtagggggctgcaaatacatggaaattctctgtactttcattcaattttgctgtgaccctaaaacggctctaaaaataaagtctattaaaaattaaaagggacaagtcatctgtaactccaggtagtttgcatgtgctaaatgccctttttctgtgataaatggttgctattaaataaaaaaatatagatatgtatgtatattatttatatgagattagtaaatataaccatttcaccttttgaaagagatggttagagaatggattgatagtttatcaaatgttatttctgaggtgaaagtaagactgtgttgccaaatggaagtaaatttagcaaaaagtaaccctgatgggttagaaagctgtgaatggaggctgaaggaattaatgatagaaataattcaaaatgcttaaggagaacaaaatgattactagaactttaaggaatttttatggatgaacctaagcttatgtgaacaatggtcatattcatttagataaatattggaaatctcccaaaattaatggtatattctgttatatgtctccttcccacaagcctttttttttttttttttttttttttggagacagagctttcgctcttgttgcccagactagagtgcaatgttgtgatctcacctcactgcaacctccacctcccaggttaaagtgattctcctgcctcagccttctgagtagctaggattacaggcgtgcaccaccatgcccagctaatttttgtagtattagtagaggggtttcaccatgttggccaggctggtctcgaactgctgacctcaggtgatcagcccgccttggcctcccacagtgctgggattacaagtttgagccaccgctcctggcctaatctcactattaagtggtgtacatttgacacaaagcaatgcaaacaaattgattaggaaactggcataaaatcagtcaggacctgactttgttttgtggcattataatgttttgttctgtaaggtataaacccagctctctgaccaagtcagttgacaaacatcttatataaaagcttctctcggtggggcgcggtggcttacgcctgtaatcctagcactttgggaggccgaggtgggtggatcacgaggtcaggagatcgagaccatcctgaccaacatggtgaaaccccatctctactaaaaatacaaaaattagctggatgtggtggtgcacgcctatagtcccagctactcagggaggctgaggcaggagaatcgcttcaaccagggaggtggaggttgcagtgagctgagatcgcaccattgcactccagcctggggacagagtgagactctgtctcaaggaaaaaaaaaaaaaacaaaaaaaacccttttctctgaggtttgcttaatggtataagtcagctagggccgccataacaaaatattacagactgggtggcttcaatagcagaaatttatttctcacagtctggaggctggaaatctgagatccatggtacaagcagatttggtttctcctgaggcctttctccttggcttgcaggtggctgctttacctctgtgtcctaatatggccttttgcctatctcttgctgttataaggataccagccctgttggatcagggccccaccttaatgacctcattcaaccttaattacctaccttcttctgccttttttttttttttttttttttaaaaagacaaagtcccgctctgtcaccgaggctggagtgcagtggtacagtctcagctcacggcaacctccatctcccagattcaagcgatcctcctgcctcagcctcccgagtagctgggattactgctatttgccatgacgcctggctaatttttgtatttttagtagaaacagggtttcaccatgttggccaggctggtctcgaactcttgcccaggtaatccacctgcctcggcctcccaaagtgctgggattacaggtgtgagccacctcgcccggcccttaattatcttcttaaaggccctatcccccaaatgcagtcatattgggaggtagagcttcaacctatgaatttggggggtgagggagcacaattcagtccataataggtcaggagataagagttctctgtggggatgggaagcaaagagtgttgtgacttgacaatcagatccagaaaagtcttacagaccattgtaagaatttttttttccttttaaaaatgagatcggaagctttgaagttttgagcggttagtcactgtttgattccatctctattttgagaatgtagggaacaaagactaagtagagaaactagtcaggagactaggattattattgtaataacctaagcaagagatgatgtcttgggtcaaagtgagagtgatgaaggtggtaaaagtggtgagattctggtttttggtttgtttgtttgtttgtttgtttgttttttgagatggagtcacactctgtcgccaggctggagttgcagtggcgcaatcttgtctcactgcaacctctgcctcactgcaacctctgcctcctgggttcaagcgattctcctgcctcagcctcccaagtagctggaattataggcatgcaccaccacgcccagctagtttttgtatttttagtagagatggggtttcaccatgttggccaggctgttctcgaacttctgaccttgtgatccgcccacctcggctctcaaagtgctgggattacaggcgtgacccaccaaattttctttatccagtctattcggtaacatttttgttctctccctgagaatgctacagtcagagcaataaagcttgtttgttatggttctgaatagtttgtttaaatcccattctacatgttgaactcatagccattgtaggataacataaggaagaatgagtattcaagcagaggaaagtgcctgtgtgaatggatgcacatcgtgtttgaactgaggtgggctggggctatacaggcataaatacatcagatcactgactcctccccagaggtaactactatcctgacttgtaacatttcagattagttttgtgttatgtctttgaattttgtattcttttgtttctgcttctttccttcaatatcatatttgtgctattggtccatgatgttgtgtgtggcaataatttgtttattcacgttgtacagtattccagtacatgaatatttatccattctactcttgatggacagttggattgttttcagattgtgcttctttgaacattgttttaaatacctttgggtggacatatatataggctttctagcaatgacattgttttgtgatagggttggcaaacattcgaaacttaactaaatcttgccaaacagttcttaaattgggcataccaagttacggtgtatgaaaccatacaccacagtttatgaaagttccagtagttccacatccatactggcacttggtgtgttgtgtttttcactgtagccattcagaagcatggtggtgttgcattttggttttaatgtgcatctccctgacttgggtacacattttgcttggcagtttgatgccctttgtatcaaagtatctgtgaatgggttgtttctgtaagaacagaggagttttttgtttgaagcatactcccctctgcccaaagtgatatcttaaagtaaactccaatatacaaaacagattaaaatgagtatttgctgagaagcagtatagcatggtaattaagaacacagattctggagccagattctgataggaatccttgctttgccattttctatctgtgtgactttgggcaagttacttagctcctatttgcttcagtttcctcatctctaccatggatgtaataataatactttcatcgtaaggttaatgttaggctcaaataagttagtttatatgcagttcttaggactgtatggtacatagtaagcacttgatgttgttggctgctattagtagtggtggtgttggtgatacaaatttatttatgaatttatatcagctgacaagaataataaggctctactattgagcacaaatttgaaattgaggattatgaatgatagttggattttatttcagcctcagcatccaatttttgtttttgttgcacattatcaagaaaataatgattcaaaaagatgaacaattgaaaatagatatggtttgtccagtagtctcagaattcctttaagcttttaatcagtttaaatgacaagtagtagaaaatgtttattttgaaattattaaatatccataatttgcttggatttcctgtttttaaataaaaatcatagaattaaattttattaaaaattaatttgtggttttagcatctattattttatcacaacacatctgcataataaatttgcttattatcgctttcagccacaggataagatgagcagcagatgtattcaacacttgtgtggcatgataaaatgtgctccgtgggtactgtagtgtgtgtttgctctctggtgcaaatgtaatgagccagcgacacataagcttgaattagaaacaaatcaaaacaaagacagctacagttttcctaatcacatattttcaagatatttaaacaaattatggcaagtaaaggtacacaaacccaaaatgaattttctgggcagcacaaggtatgttttgtttggtgtctggtgtgttaatactaggaggcatataaaacattcatttatctgctgtcagaatattagttcatactagttccttctacagctgtcctccacagtcaccagttgtagattacacacagccttgcctgtttgcggccagctgacccttaaacccagggaacattttcaactatgctaaggctttccaacagactaaatgagtaccctgataaactcctctagcaccagctttatttctccccagactgtctcccactgctccttagccaagtatgggctcctccagtctggccagtctcccctctgcctcaccaccaccctctgcctcaccacaggcatggttttgtgttcccttctctgtggtaacagtgtcaggaatgctctcattaccatctgtcttgagtactgtaatttcttcctttgtggttctgtgtggacaccacctcctccctgaatcattcctctttgctatcagttattctttcctgtggaatcctgtcctgacattctgtatctcaggatctattaataaaactttttttttttaaatatcctgaagttgtactctgtgagcactacctcaagtcagtgccactcacaaaacccatcagcagagggagctaaataaaagaagatgagtccctgaaattgaggagacctgaagcagaaaaagtacttataaacaatcaactttcacaaactgccagtgctaaagagcttgagtagtgttggaaatacattatttgggccctaatcccagtttaaaactttgatgaggtgatttgtgtttttgaaagagttaattctgtatcatgttaaaaaaaaaactgtttagggggatgacctgataaatataggaatattagagaaccaatctaaggtattccgctcgtctgaaagttttcattattaaggataatgaaatgaggtcactgctttgtgaagacttgcatatggaacactgagtctgaaagttgctaaggattatggatagcccattctgagtctaacatgtactttttcaagtaaatttcttattttgttttgatcaagtgtatgtatcttaatttcagttagcagacttgaagaaagagaagcagaactgaagaaggaatataatgcattacatcaaagacacactgaggtgggtttctaggtttttcattaccatgctattattgagacaaagaaatgaaccttagaaaatatgtcttaatttttctttgaaaatcagaattttttaaaaaagaataattcttggggattctttcaagaaaacattaaatttcatgtggcatttacctagttaccaaatgtcaacttttcttggaattagcttttcatggggtgaattagtatgctacagaataatttagttatttaaggcagctatagtacttctctccttggctggctaagcaaaaacctatgtgcacataatgaagtttctgtgatgcttagatgagagaactgatttgtttttttatgagtttggaaattatggattggtaagttattggtaaagggtctctacatctattatccattgtaaaggacttatttgcattaagctcataacaaataatataagcacaaattataatgtgttaaaataactcaaaagtaggttttttgcatgagttttcagtattttaaattaacagtttcagcacagtctcctcaaaggaaattagaaaatgtacttgagggttttttaacctttttatgattccctgtcagcctttcatgttgcttttgtttctgttatcttaatgtgaaaattatttttgtatgtcatggtcagtctgggtttcacatacccagataaatataatttttatagttttatacaatatttgttacatgaaaaaaataattcctctctctttccccttgctagtcctatatttcccatgatacatatggttccagtcttagcccgtttttttgtttgtttttttttctccctagtttgtgtgatctcttatcctgcgtctggtagaaactatgttgttgtttttctttagaagagtataaaaacctttataatctataatcataaaacaatttaaaatcatgttttggagaatatccacacagattgtattctgtatacagtaagcatattaatgctacaaagattgtatttacattattatattgtagctatattctgttgttgcttgtgtgtgtgtgtgtgtgagagagagagtcttgctctgttgcccaagctgtagtgcagtggcgcaatctcggctcactgcaacctccatctcctgggttcaagcgattctcctccctcagcctcccaagtaactgggattacaggtgtgtgccaccatacccggctaacttttgtatttttaatatagtagagacaaggtttctccacgttggccaggctggtcttgagctcctcacctcaggcaatccacccacctcggcctcccaaagtgctggcattacacgtgtgagccagtgtgcctggacgttgctgtttatttatttatttaaaaaaatgttttaatactagccattgcttttaaggaacagaaaaccccaccacacattgcatttgaataatgtggttagcactttcttggggtagggtgtagaatttttccctgttagccttgacacgtgagatttgattattacaatcttagcttaataaccatacccaaagcatgaagtatcacagaattgatatccagtagcagatggaaaggatggtccatgaagggcttgaaccatagagctcagggaagacaggagcaggttatacagcagctttttcagtggtaaaaaatacccacatttggccaggtgcggtggctcacacctgtaatcccagcactttgggaggccgaggtgggtggatcatgaggtgaggagattgaggccatcctggctaacacggtgaaaccccgtctctactaaaaatacgaaaaattagccaggcatcatggagggagcctatagtcccagctactcgggaggctgaggcaggagaatggtgtgaacccaggaggcggagcttgcagtgagccgagatcacgccactgcactccagcctgggcaagagagcgagactccgtctcaaaaaaaaaaaagccaaaaaaacccacattttggctgggagcagtggctcatgcctgtaatcctagcactttgggaggccaaggtgagcggatcacttaagcccaggagtttgagaccagcctgggcaacatggtgaaaccccgactctaccaaaaaaaatatatacaaaaatagccaggcatggtggcctgcacctttagtcccagctattcaggaggctgaagtgggaggatcacttgagcccaggaggtaggggatacagtgagccaatattgtgccactacactccagcctgggcaacagaccctgtctccaaaaaaaaaaaaaaaaaaaaaaagccctcacattttaatgacatttgttagccattaaggtttaattttagtggatattaagatttaatggcatttggtggatattaagatattaaggttgctaaaaggcctgttactgattttcacatcattcatctcagtgcctaaacaatgtactctatgtactgtttgcttaagtagtacttattaaagctgataattataaatacatatatgttttatatatatatatatatatatatatatatatatatatatatatacttttttttttttttttttaattagggtctcactctgtttcccaggctggagtgcagtggcgcagtcatagcgcactgcagcctcaacctcccgggctcaagcagtcctcccacatcagcttcccaagtagctgggaccacacacgtgcatgccaatttttttttttgtgtgtgatggagtctcgttctgtcacccaggctggagtgcagtggcttgatctcagctcactgcaacctccgcctcctgggttcaagcgattctcctgcctcagcctcctgagtagctgggattactggagtgtgccaccacgcctggctaatttttgtatttttagtagaggtggggttttcccgtgttggtcaggctggtctcaaacttctgacctcgtgatccatctgccttggcctaccaaagtgctgggattacaggcgtgagccaccgctcctggccagtgcacgccaatttttaaaatgtttatttcatttttattttttgtagagataaggtctcactatgttgcccaggctggtctggaactcctgggctcaagtgatctcctaccttggcctcccaaagtgctgggattataggtgtgagccactgtatccattataattgataaatttataatttataattttataaatatattataaatatatttgggggaagtaattgatagtgataaataataaacaacgtttttgtttttaaaatgaagctctaatcttttttaataattgaaaattattaaattatgctatattaaagtataaaatataaaatacatacttttttttgttttttgagatggggtcttgctctgtcgccaggctggagtgatcttggctcactgcagcctctgcctcccaggttcaagtaattctcccacctcagcctcccaagtagctgggattacaggagtgcaccaccacgctcggctaatttttgcatttttcatagagatgggatttcaccatgttggccagcctgatctcgaactcctgacctcaagtcatccacccaccttggcctcccaaagagctgggattacaggcgtgagctaccatgcctggcctaaaatatatacattctttaaaaataacggtaaagtgaaatttcatattttttccatatatttaataaaggtgaagatacgcttctataaagaagcctgacatactaattttaaatgaaaacatatacttttttttttttgtctatttctattccttgaggaaaagatagtctaggaagaaaaaaagatctcaggaaaaattttaattaccaagtcagagagctaggtctgtccagtaaccaaggcagatttcccacgccgcccaaaagctcttttcatagatctcctccctcagttatgagcagcttctatcctctgacctgataggctccctatattttgttttgcctcaaggaaggaaggtttatgtaacatatatagggctgctttgaaatgtgggtctgttctgctctagcccacaattttttctgtttatacatctgttctagagatgtcattcaattagcaattataaatagctatctaaagccaaagaactaggcgcccttaaaacataaactctgaaaacattcagggaaaggaagcctgaaggggtttaaccttaaccttttcactattatttccaaagaagataatgtcttttaatagttgtttagcacttttatgaaacacattcattgttgcttaagggaaacctaccgtggctttttaaaatttgatttaagaataactattcttaaatttaaatagtcaactattcttaaatcaaatttttgtatacattactgaatttgcttaaaagacatgccttaaagagggcagtggaagaaatataaaggacaattttgaagcactcgggcccacatgtgtatgctaatcaccaaaaactttagccctttggaatcttgggagagtctcacatcagggagtgtttgaatgcattctcattttatcctttgaccaaattctcatccattcccattttacagattgaggtttagaaagagtctataaaatgatttgccccaaattctaggctagttagtgactagatttgaagccaggtttgtcagattctattgcctgatttttttttaagagggagtctcgttgtgttgcccaggctggagtgcagtggcgtgatctcggcccactgcaacctccgcctccagggttcatgtgattctcccacctcagcctcctgaatagctgggactataggcacatgccaccacgctcggctactttttgtatttttagtagagactgggtttcaccatgttgtccaggctggtcttaaactcctggcctcaagtgatctgcccgtcccggccttccgaagtgctgggattacatgtgtgagccacagcacccagtctccctgaacttttaataacactaacaccttggccgagtgcagtggctcacgcctgttatcccagcactttgggagccgaggtggggggattatctgaggtcaggagtttaagaccagcctggccaacatggtgaaactccatttctactaaaaatacaaaaattagccaggcatggtggcaggcacctgtaatcccagctacctgggaggctgagtcaggagaatcgcttgaaccaggaggtggaggttgcagtgagctgagattgtgccactgcactccagcctgggtgacagagcaagcctccgtcacaaaacaaaaaaacacactacacctttagttccactagacatttttcttttccctccctccctcccttctttctttttctttttgttttttttttatttttaaattctctttcttcctttcttttctttctttccttccttccctttcctccctcccttcgttctttcctttcttccttcctctctttttctctctctcttcagttgtttattgctgaattgactcctgaatgtgtgaattaatatgcatacctgagaaaattgagaattgcagttctgagaccagaagcaatggacctggtggacccaagaatagattatctgaagcgtgtcctattttactttctcacttctcttttctgtctaacaacactggtgctccctcccactcactttttttttttttaacctgagtgatactgtgaggccttattaatatttaaattgttatgtataatttttgttcttttttgtgtgtttatagactatagtgcatatcattttattccagacatcaggaaatgctttagggtatgggattttcttgtgggtatgaggaagaaaggacaatgggctcattgcctgctcagagaattaagtacaaaggcggcctgagtcctgtaattcttaataactcagatgactgagtcaggcaggccagagttctggccccaaagctagtgacaacttgaaaagttagtcattgaccagacaatcaacttggagtttacctatgaaatcatgatatggtgaggattaaatggagaaaaaatggctgtaactgcactgactgacttataattggtgctcaataaataatagctgccattttgttgttattgttctctcttttcttttccccctcagtcatttttggttgtcagttctttcctttaaagtgctagtttggttgagttagaattgatttcattatatagataattttggaatgtcagaatactatatctgtaattacattggactagtcattaaaagaaagtttagaataagataatagagaatcagtctgtagaatggctattgggggagaactatttttgcattttgcttgtcattctttttctatattgagttcatagattactatacagcaatctggggtgagtttgttttcttcatctgaatgcttaaggaaacttaggtcctccatttgaacaaatcaatcccatacatacaattactttactatccagtgtatataagaattcacggctgggcgccgtggctcacacctgtaatcccaacactttgggaggccaaggcgggtggatcacttgaggtcaggagtttgagaccagcctggccaacatggtgaaaccccgtctctactaaaaatacagaaattagctgggtgtggtggcgggcacctgtagtacccagctacttgggaggcagaatcgcttgaatgtgggaggcagagattgcaataagccgagatcgcgccactgtactccagcctgggcgacagagtgagactcatggttcactgcagttttgatctccctggctcaaacgatcttcccacctcagcctcccaagtagctggtactacaggcgcatcccaaaatacccagctaatttttaaaaatttttttgtagagacagggtctccctgtgttgctcaggttggtctcaaactcctgggctcaagcagtcctcccacctcagcctcccaaagtgctgggattacaggcattagctactgcacctgacctcttttatttttaaagtggtttttttttttgaggggtctcattctgttgcccaggctggagtgcagtggcatgatcatagctcacagcagccttgaacttctgggtccaagcagttctcccacttctgcctcctgagcagtagggactataggcgagtgcctgctagttgttgtatttttttttctagagctggtgtcttgctgtgttgcccaggctgatctcaaattcctggcctcaagcaaacctcctacctcccaaagtgctgggattacaggcgtgagccactgcaaagccttaatttaggccttctaaaaccttttgaaaatttaaattgagattgattaagcctgacagtcactttgttatattagtttcagtttgatttttgttcctgaaaattcttcctgacacaaggaagctcattatttctgacttgctgatagatgaaaggtgtatttctccaaaactgttgtgtaaatggtggtaaaatctataaatttaaaataaaaagtatgtcaattaaaaaattttaagatactatattcatgtgattctgttttcattctttgtggataacatttgttgtttggactagtcttcattgaggaacagtctggttaatttgttttatttcatgcatcagagttcagctttttgtttatttgatgataaataacatcttaaaattaacttacatttcctaatatttgtacatgccaaataaaatttctacaacaaaagcaagctttgtaaagtgaatttaaactttttaaaaattttattttgttacttaatatgctacagtgcatattttaagttataaagagattgaaatgcatcttaatacagctaaagtttagtgacttccaaagctattctatgtacagcgttaagaattcaagtaatattccttaggaatggtgagaagggacattaaaaaaaaaaagaattcaagtaatattcccaagaaagacatcaacctttgcttgcctcttaatatttacaccctttaaatactaacacactatttcttgttttttaaaattcatttttttcttattcatatcatgttagtatctctagcaaaggccttttgattttatgtcttaattccaaatttaggctttttaaaagtgaaactatatattatcaagaatcaaataggacattagaagttcttggcagtttatgtactttatattcttgaagtttttactttcttattcagcttgtctgtcatatgattccttatctaagactcaaaaagtattctaattttttacatttgtattaatttgctgctgttataatagatgattataccaagtaatgataccagtaacagtcaaaggagaaagtattttaacattctttcaactaaatataccgaaagaagaaacttttcttggtattaaattaattaaattgaaagtgatctttattctgttaattccttttaaaatggaagagatcagcacataaggatatggtttcttcagaagtttcacattaatttctttgttgtgtctcattttagtgaatggctttctcaaatgccatctattatttttaaccaatggtcttttatgacttctttcccagtgtctgtttactaatttgtgttctttatatcaatattattttaatagcatcacatattgtaaaaaaagtgggttttttttttttttttgccatcctaagcaagatattagctacttttgtggacaccagcatccttaaatgtaagcatttgcatattactttcccttaaaatttttttcattccttaatattctcttacttggaatcgagtagtctgatagataagaaaattgtaccaaaatgttttccttgttataacactatgattttattccaggtattagccttaaatattgtgtattttttctttctttaaaatagatgatccataattatatggaacatttagaaagaacaaaacttcatcagctctcagggagtgatcaactagaatccacagctcatagtagaattaggtaagctttgttatatattttgccttgagaaaaagtaaaataaataatatgtttgtttctgtttttctctgttctttaatcctggaacaatagttaggctgattcaaaaagctctccactgtggttggaatgctgcaggagagaatagcacagaaaagtagaaacggtttttaccattaaaaagataaattatgagccatccatataagcagcacattgagtatttagattgttttctgatacttgatggagattatactaggtttaaaattttgtaatttatgggaatgctgaaatattttatttctcccgtgtaattggtttgaagtcctttttgttacagagaggcatgtttgaaagggttagctagccatctgtttggtgtaggagtgtgaataaattatgtagatcttcaggcattgtagccaatgagctaagccaggactcttagtggaggggaaaatagttaataggctggctgtcgcttggggttgctgcataaatgctaggagcagcagctctatggttatgaggtggggagaacggaatgacgtcatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgccatgagtcctggatgcatgctgctgtttgtgtttggctttgttggcggggcggtggtcattaattctgctatcttagtatctctctctgttttgctgcttgtgcacttttctatttctaccggtgtgccagctctgacgcagaacctaccaaggatactcaggtactcccatctctcttagaagcccctgcttagctggtttttattaaatttttagctcaacgggtctgctttgtaacaatttctgttgcagattgaaacaatggaaaatggcctgaagctaggatttttgattctaatttatagtaatttatagaccatcagttaggattatagctttatgtttggaaaccactaactaaagaaaaggattttcatattgtacttacacacaagtacaaggtcagtgtggtcttgttttaagcagaatgttcaaagtaaaagaagagcaagagtagagcaccggctccaagtttatacaacctctgcatttagcttctgagcatttagggacaaatatcttttatgcttggacttgcagtcagttagatacaggccgtaagcttattttgttttaattatcctttgaatgatagagtttcaggtatcatttttgtaatttttgataatagctcatgggaactgacaatttaaatattttcctcctaaaacaaaatatgttttaaagtgaaaaaatttaagacttttaggttaaggaatgcctttttccccattatttacacatcaaagttgtgaaagctttacaaagcctattcactattgttttgtcagatgttgccctttcttttctttgtagtcttgggtgacaaatatccatgcctgcttgtgggggtagtcattaatctctgtagctttactgttgctcactctacttacaccctgtaagagccatcttctgtattttagaggcttaaggttgtggtttcttttgttttctaaaccgtcagactagcagtctctgatttgttcagatttctgctttgtgcatggttttaaatgaaagttcatagtatatagtttttatttattatttaaatgtttataaaatatttaaaccctaattgtagatttagataaattaagaagaattaaagtagtaacttcccttaatgtgtttctttttattcataggtcagttcaagtttaatattagttgaaagcccagaaattaaatttcatcaatgacttaaaactagatacttggtcttttattttctttcctgatttataaaaattgggaataatcttactacttgtatatatattagtacataaaatatttgtgtacgtgtatctgtatatttaggctttgaagaaattaaaagcaactgaacttaagaatatgtagaatattaatataagactaatgttaaggggatgtcttgggtttaggcttcatttgagagggcagtgccgtgagctgctgtgcggcgcctgcaagtgggtacaacaaggctttggaattgaactgcctgggtgcaaatgctctattgcacgtggccgtaggagctttggcaagttgcttaatctctctgcctgagttttctctcctgatgggacttaccccgttgggtggttttaaaaatcaagtgattttattattttgtatttaattatagttgtaagatatatggtaaattacttgagtaaataattttcagttacttatatgtgtccatttttagcagaaattgttttagctacagctaaaataccttataattaaaattttaaagttctttaccacaaaaattgctactgatctgattaaataaagatatcaaagtctttgatattaagattaaattgtcaaaaagttggtagttccaagtaggaagttccaaggaaagcaaagggcttggaattgaacagtactggctttgaatcgaaactctgccaattactagtgcctaaaatctctgagcatcacttttcctactctgaaaaattggaaaaataatccctgtttcttgataaggattaaatgcgataatgtaaataagtcatctagctcagtacccaccacgtggtgagtgttcaacaaatgtactttttcttttatctgcctttatatataaagcagattttactaattagttgtatcaaatgtgaatatagccaaaaagctgttccaaaaatgtagttgtaaaattatttatatacataagctaacatttaataaccaactcaaaaatggatatatggaagtagggcaattaagaaaaaagaattctgatagttgttgatagcttcgttttctagacaagtaatagcagatgttttggtctgcaggtataaatctgccacttgatagttttccacgtgtatctcatttttttccttcttctgtgagtttgaagcatttaatgcatgccaacatagtactggactaatgtttacctttcagggtttcttttcaaaagtaggattctcatgaacttgcctaattatgcgtccttctctcccttaccccaactgtatgtaatttgtaagtaaagtaaggggaggagtatgtagtaattattttttcagagttggaacattgtaacctagagcatcattgacccacttgacagatagctgtcagtctctgaagagatctcccctccctgtagagtagtttctgaatgattgatacaagcaaattaaaaaggtgggaattctatttgcaatttgggttgtagattttgttgactgttgattgtagattttgtcaactgattttgtttactttttggaaagtaaaatttggattcatagaagactccctcccccaatagttttaaactttttcaatatttgttatgtgtgaaaatgaatggcttatattttgatttctattagtgtgagggagtcttatgaagtctgtatatcatcttcctggttgtctttgcattttgagttagagagctttccattatattcagtcattaaattcccagtcaccttttgcttaactcattaaggtatgttagaaaataaataaaagtcagctagtagctcttagtccccttggattttcggttcacaaaatatggggggaaaacatcagattgacaactttttattttgtccagaatgaatatgaaaaggaaatctagctacttatcactgtcaccatcatttaatgaaagaaagggcattttaaaatcaaagaagaagaaaagatgtaatttaaaataagggtcagtcattttcaagaaagaacagggttctatagtatatgggaatgtgtatgtgtacaataggtactatattatctatgcactaaggaaataataaataacgcctcttttttcatggacttattataaaaactttgttgctgaacagcatttgggaataactggtgtaaacatggtagctgactagtcactttaatttttgtcatttggttgtcccggcagctcatagtcgcaaacttagatttggtgttaaaatttaccctcttggccaggtgtggtggctcacacctgtaatcctagcactttgggaggccgaagcaggcagatcatgtgaggtcaggagttcaagaccagcctggccaacatggtgaaaccttgtctctactacaaatacaaaaattagccagacgtggtggtaatgcctgtaatcccagctacttgggaggctgaggcaggagaattgcttgaacctgggaggcagagcttgcagtgagccgagatcgtcccactgtacttcagtctgggcaacacagcaagacacaaacaaacaaaaactaccctcttattgtactgccttcctgcttttgaattttccccctaaatcaaagttctgtttttaaattttatttccttgtgcatacaactttgactaaatgtagtctctcaacccctttgcttcacctcatttttaagaaggcattgggatagttttactagtccttttagattgttaggaatggaagaacacaccctttgtattaagtgaagacacatttcaaaagtggctgaagtttcttggaataaaaatgaactacagaattaaagacttacttagcaaaactgaaattttcccactttaattaatgagctcattgtttttattctaacttacattcttaccagtagaggtaggaattccaggaggcaccaaacctttagtgtatcatttctttctagtttctacacttttgagttaatgacccaggatgacccgttagtaggcttgtttccaccctctaaaagctcttcgatttggaatcttgtgtgcatcaacaaaggatgtgtttctcgttgaaattctgttagtattaaaattgtaactcttgttcattgaaacttctcacaaagcattggaaattcagtaatcttttatagaattatttgaccttcttatttggaaaaaaccgacaatggttttctcatatgtactgtgcttgaaaggaactcatatagtggttctgtagaaaaacagagctttcttacttgggtggtggggagaaagatattttgagttcttttcatcatttaataggtagccctgatttagataatatattgattttcctctaggcaggaaagtcataccctgaagaagcttcagtaaacatccagggattagcgagaggatttgggaagaaatgggttggattcacttccaaagaaggaggttgcaagttccctagggctaagctacgtatggttaaaaacccagcagcagctcttctccagaccacactagaccactgactgcttcttgggcaaggaactcgtcagtaacttttaagatttccttaacccttcttaccacttttcttagttgatttcttgaggctaatttcctgaggctaactaaactgagactgtccttcctctttggtaagtctgttttattcagatgggcagacagtgtcatttttgagtgatggttgtaaaacagtggcagtccaggcttattacttatagtcatggcaaataaaaagtcaaaataaatgaatgccgaattttttctcccctcttcaaatagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtaagctttatgctgctgaaattgtgtcagtttatatttcataaactttcttatcctaattgaagtgctagacgaccacagtatagtaaaatgtaattgtttgtatacatttagtttgtaaaattggttttttaaattggaaatgagctcttaccaaagagtgtgttttttactattttatttcaaattatataggaaaaaaagtgaagcattatatcatcttgattagtatactaatgacaaaaattaatttctatttgatttaggctatatgagtttagagtagggtaactagtgaacctaattatattagaattgaaaatcgctattaccagaaagtcttggttcatgttagaggctttccaatttagtagggtttcacttacagaaaaacaaaacaaaacaaacacactgttccttctttaaaaccgcttcatagagcagtctacaaaaatgcattatgtttagctaaaaaggcgtggtgtaaattaattatagatatgttcttgaccaagaacttgtcatcaaataagtgataaatataaacaataatatatgctgagtggatataagctaataattaacttttaagaatatttgaagttctgtatcttttaaaatgaaatattcatcatattgattataaaagatcttttgttaccttataaaatcaactcatcatgaaacaggccacctgcaatgagtagaaatgagttacatgtatcttatttccttttcctgctttatttttctccataatacttatcatggtctaagcatgtaaagatagctcttaacaatgcttctaaaatactgtcatttactgtatttagttgcctctagactcttccctaagaacataaattctatgaggtttatttactgctgtatcccccagcacttggaaaagtgcctagcacattataggtactcagaacatgtttgttgagtgaatgatttgttttagatgttagaaggaatctttggggacaatataagtggtctttctctcaactctagaatgtagaggcattcagaatcattctattgacctttgaaatgtgctcaaaacagtaagcagttgataaatatttgatagcttttctcccactgaaaatcatttttaacaataggggttaccttaccttttctcccttcttgccccaatttgttagaagctaatagtgctcagtattagcccacagtgatgttactgggcaactcgctcgctctcacttttttttttttttttttgagacagagtcttgctgtgtcgctcaggctggagtgcagtggtgagatctcagctcatttcaaccttggctcactgcatcctcctcctgggttcaagcaattctcctgtctcagcttcccaagtagctgggattacagcacccaccaccacacctggctaatttttgtatttttaatagagacagagtttcaccatgttggtcaggctgacctcgaactcctgacctcaggtgatccacccgcctcagcctcccaaagtgctggaattacaggcgtgagccactgcgcctggctgcaactctctctttctttacttctgtaccacaatgggtcttttagccttcctgcaggtttaatagattttccaaaacactcatctctcaattgcctacttgctgtgtgtgctttcccaaaacaaaagtaggagggatacttttagtacaaaaaaaagtatcccatatggtaactatattttaatactacccaaaagtgcgccttaagagattattataattctctttattttttactccactgataggctatgccagaactttattgacaacttataaaccgattaacaaattattagtatagacttaagcagaggagtttctcgtgtcctccctagaggaggacttgccttagtataaggcaggtactcaccagagagtttctaaaacaaaaccctgtctctctctacttggtctggaactggagccaccgaatgagataaagactcaatgaataaggatttccaggaatggggtggtgcttacaaaatggcaaaagtctagtttgtaaatcatgttactagttgggatgtacagtattttatttttcacctaagcccttgtcgttcactagataactttctactttaccagggctggaagtcaggggtttaggattcacttgtgggctatgccacaggtatgtcacatgccctgtcattttggtttctgtgtataacaggaattggactagactctaatttaaaatatcatttcccctgagattgaggatgacctagccatcttagggcatgttttgacttcattatgaaaaaatggaaggtgtaaatttataattaatgttagtgttactaccacaatttttctgtgaagtaaggttaaggtgaaaatttcctgtgagagaacgacagaaaactttgtggcagaatagcagcagataaggggatttgccagtgattgtaaagttatgggccttctttgttggtgtattacaaatttctcactgtgagagacctgtggtgagtgaggttgtaaataatctaatagattttctaggaatgatgcacctagaaaaatgtacaagttcttaaaaagaaatatttgtacatattcttgatttatcacaatctcatggagatcgacaaacaagtaaacaaataaatgaaataatagaacttcaagtattgttaaagcaaggtaagctaaagagtaattagtaaggatgggtactcattttagggtatgagagaaagcctctggaagatgactttcatcctgacatggggatgtgcaggtgcatggaaaggtctggaggagtacgtgttgaggaagatgagatggcaattgtgaaggccctgaagtggggaagcacttcagcatgtttaagtggtggttttctcttcatcacactcagactttcagtcctacctactgcaccaacatgccttctgtcaagggtgccaaaagaatccatcgttccaaatataatggaaaattctcagtcctcatcttaccttttagtagcatttatatatttcaatatattcagcttcttgaaatacttccttcagttttcttccaggattccccatggcaaacacacactgattttcttcaccattccttctccattgctggtttctcttctgcttttggacctctaaatgttggggtactcgtcagcccttctttttacttaatctgggtagatcaaattccatgtctgtaaatgccatctatgcatcagtgctcacaaatttgaatctacaactcatatctcttccctggactctagacctctgcatctaattgcttttctttatagtttcctcacatacatatgctttaccttgcctagattaccactagtaaaaataccctaattcaaggccagtgcaaataccacagtttacatgtagtctcactaacgccctagagactaacaccctgttgattgtcctcaaatcgagtttggagatcagttcaagaagaaagcagaggagttttgtattgcttcattaacaggaatttcgtaccgggggacttctagtgaaattgataaaaagaaactccttatattaaattatcaaagctgttgcgttaaagagcatattataaaagtgctataggctggacaggtggctcgtgcttgtagtctgagtactttgggaggccaaggcaggaggatcacttgagtccaggagttcaaaaccagcctgggcaacgtagtgggactccgtctctttttcctttttttaaaaaaatgtttatacacacacacacacacacacacacacacacacacactatatatatatatatatataaaacacatatatttacttattttatttatatatataattttttttttttatttgagatggagtctagctttgtcccccaggctggagtgcaatggtgcaatctcggctcactgcaacctccacctcccaggttcaagtgattctcctgcctcagccttccaagtagctgggattacagacgtccaccaccgtgcctggctaatttttgtgtttttagtagagacgaggttttgccatgttggccaggctcttgacctcaagtgatccacctgcctcagcctcccaaagtcctgggactacaggcttgagccaccgcgcccggcctattttttatgtatttttaaaatttattcctctagtgtcaagcgactctgtctctacaaaatatttaaaaatcagctgggcatggtggtgtgcgcctctagtcactgctactcaggaggcacaggcaggaggatcaacttgagcctgggaggctgaggctatagtgagccatgatcatgccactgcactgcagcctgggtgacaaagtccttgtctcaagaaaaataatgaataataatagtaatagtcatgggctaagactgagaatggacaaaatgttaaggtgagacagttaatcttactgaattatattcacaaagaagctacaaatgaaggaattggaaaacaaaaggccaagtataaccaagacagtcctgaagaacagtaagtataagaacttgctctaccaggtattaagatttactataaagcgtaattattaaggtggtatagtattgcttcatcttccctttctctttcctttctgcacaatttagttctaaagccaccaggcagggcagaggaaggtaaggctttccatggtgcttaggagcaggggtggggttgttatcataacctaagcaaagttacaagggtaatccatatggggtagcctggtgtagagagtcagggccccagcaacattaaggacatccctgcaggatggcagccaggcttgggggtacaagaccctaaacaggatgatgagagcctccccaaggagaggtcccaggtatagagtgtcagagcctgagcagatgaggaaggcagcatctgtgtgtggtagggggagagggggctggagtggagaagaaagaagatgcatgggaaaagaagggcattagtggagggctgtagtggcagagaagagagaccgtaagagacttgagcgctgaaagtcgaggcacaaagggagttttagaatggaagaagatgtcagcagggtcagctggtgtggggaagtcaagtagaatgaggactgaatttgtaaatttataggtgtagatttgagcagtttaagttgtagggccagtaacaggagtaactgtaaatcataaaaagaggaaataacatgtgtagactactcaaaatggtgattgtggtgggaggagagaaaaaggataacttgaggtggagattggcagagcagagggaaaagtatagaatgggagagactgggttgttgctatgcttacaagaagggttcaatagagagaaaaattgaagacaagggagtgaagaaagataattgatgtatcagaatcttagaagaagggcagaggggaagggatcacatatcccagctgcaattcagatctccttcgttgctgagacagcttcatttttcctagtcttttgctgttacaaataatactgtggtaaataaccatccaaggcctagaaagcatcatgaaaattatatggctggcatagaacatgcacacacatgtatgcatgtgtatacatatgtactccaaaaaagtatttttttctttgaagagcatccttggttgttgattattagtagaatgtgacctttagatctgagaaaagcaattttaactaactaaaccaattggatagacacctacttgtgaaaattttagagagttctcataaaatcacatgacttgtgatactttagtaaactgctgtgagaagctcttgttagcagagtttggtatgtaaagccagtcaatgtgtgctgcattcttcaggggatgtgcttagcatgcagaacaggaaatgtctaaacagagccagcattcttgttgagagaattttccatcctcctccatttgtggttaagttctgaaattgttcctatttctttagtttctacaagctttaatctctatagtagttgaatcatatctattgttatttgcaattcctattataaaatgcatatgtaatttaaaaagttaaagttcgcagttttaaataacttttttgaagtaattttagacttacagaaaagttgcaaaaatagtgcagagttccatatacccttcacgcagcatcccctgatgttaactaaccataatacaatcatcaaagctatgaaattaactttggtacaatactgttaggtaaacctgtattcgagttttaccagtttttccactaatatcctttttcccttccagaatccagcccaggatcccatattgcttttttaaaaaaaatttttattacagacagggcctcactatgttgcccaggttggtctcaaactcctggcctcaggtaatcctcctgtctcagtctgccaaagtgcagggattataggcatgaaccagcacacctggcttccacattgcctttgtacattatgtctcgccagtgttcccagtgtgtaacagttcctcagtcttgtcttgtctttcatgaccttgagacttttgaagagtactggttagttgttttgtagaatgtctctccctttgggcttctctgatttctcattattagattgaggttatgtatttttggcgagaatataacagaatctagtatcttggtgtggatatactttgagactgtgcagataccctgtttctgctcaaactttcattcactgattttagcatccacagtggattttgcctacaacaattattagtaaaatattgctaatagttattttctattttcttcattctacatttattaattggaattcttctatcagggagagttgtcttcttccctccttccctccagtccagtttgaattcaagggatatatacatatattattctgtgggctatgcgaacctatcatttctttggtttctcaaatttttctagctttggacattgagagctctttcaggttggctcctgtgctcttttgacataccccatccttttttgaatgctttcttccttattggcaccataagatgctctaagctgttgtattttccctgccccactcttaaaaattggactacttctcaaaggagctctggcacattttttgggagaagtgtatttaggaaccaagatctaggcattattcattcatttacttctggtttgggtttttccattagtttatacctcctttatagaattttgtattagtgtgcctactagggtaaaataaaagtagagttttaagaaaaaaatggattatgtgttgtaatatttcatattgttttgtttatgacagtggataaggaatttgttctataaactcaatttttgcttataagcttttttcctcacatatatcttcatgtgataactttaggaaccacctataggtgactgttagggtttggaaggaaaaaaagggtaaagattctattgtgttgtatgttgaccaagatgcctattatgtatgttgagaatagaaactgataaagatgtaaataagcagcactttcaaaatggcggtgtttaaagcttgtattttaaatgtgacttcatctgaggtaattggcacataggtatttattaatacttacatttactgtttaaacagacttttagaataggagaagttgtttaacattttctactgaaaaaattacctttttcactcaaaaaaatttattgatgctcactgtgttaggcacaatgccatgtactagaaatgttgttaaggtgctcagaggtccaaatattttctaaaagaggcctttataatttcttttaaaaagttattttactactcaggaggctgaggtgagaagactgcttgaagccacgaattccaggttgcagttcactgtaatggtacctgtgaatagccacggcacttcagcctgggcaatatcgcaagatcctgtgtctaaaaaattatattaattcagtttcacaatttttagtaatactgaagaatgtggagtaggaatgggaagtttcttcaaccctaaatttcattttttcccccagtcattgtaaatagttgatgtatccttggcctttttctttacaggtgcacatagatataatatctttttaagataagtgggtttataagtgttttcctgctgcttgcttttttttttttttttcatttaatgacatagcttgacaatctttctacttttatatagagagagctacccaagtttttacctagtttttgatgaagagaatgattaaagatgatgagaatctagaatcaaagatcttataaataaacattaagtgctcttaccaccaaaaaaagtatgacgtgctagatatgtttattggcttgactgtggtgattgtttcacaatgtgtattaaaaaaatcaccttaactatatgctgtatttgtcagttatatctcaataaagctaggggaaaaaaaaaaaccacatctgttaaagaagaggcagtctgattcctacaaagtgaatcatgccttgttaatctgtgtattttgtattttttatttttttttgagatggagtttcgctcttgttgcccaggatgtagtgcaatggcgtgatctcggctcactgcaacctcctcctcctgggttcaagcgattctcctgcctcagcctccagagcagctgggattacaggagcccgccacaacgcccagctagttttgtatttttagtagagacaagtttctccatgttggtcaggctggccttggactcccgacctcaggtgatccacctgccttagcctcccaaagtgctgggattacaggtgtgtgccactgcggccggcctaatctgtgtatttttaagggcataactgagagctagcagcctttcaaaaagactttgatgaatttccagaccaagagtatttgaaactgttgctttgtatttaagagaaacacatccgtctcatagagggaaaatgtatagatagaaataaagaatatgaataaatagatttttatgaaaaaggatttgggactgggcacatggctcatgcctgtaatcccagcactttgggaggccaaggaagatggatcacttgagcccaggagttcaagaccagcctgggcaacaaggcgataccaaatctctactaaaaatacaaaaatttatccaggcatggtggggtacacttgtagtcccagctacttgggaggctgaggtgggagaatcacctgaatcctgcgaagttgaggctgcagcaagccgtgatcgtgtcactgcactccagcctggacgacaggagtgagaccgtgtctcaaaaaaaataagaaaaaggatttggattttggtgatcctttgatcattagtgttatctaactaattcagaaatgatagaaggaggtgtgataaacatttctgagtatgctgcactggattattagcatgttaaatagtcaaagggactggaataaacatcaggaagatttcataaagtggtgtaagtagaaaaaaaaggttaaacaatgagctgcatgttgataagtataagacactgatccaagtggtggcttctgaaccatgatattacttaaactagagtgttaaggtcagcttaagtcaaaataaaacaaagcttccaaaccctcattttaaacacagtagataatagatgaatcttgtatcttgggagatagtacaagccaaagttacagctgtgttaaaacctagtaaacacataatttttttctcttttataatcttccctcttcctaggtcagcaatagtcctgaacctcagaaggctgtagaacaggaggtgagaatggtgcttcttaacattttgcaaaaagtatactaaagtgattaactattgattacttcctcaactgctattctcaagacatcagatgctcagcttggaagactattgttgtaattcactgaaatataaaagaaaattatttccactgtagtggttgtcagggctttactgcaatctgtaatttattccttccccaaagtaagcatttttaaataaaggaaagaaaatataagtaaattctgtgaaattcagcctgtttgcatttatccagctctatgtaatggtatactttccagaaataccttcttcagggcataatgtatgtaacttgtatttgtcctgaatgtggcctagtgtgtcatcttacagtggactgcttccttagtttaatagagttcttcatctccagtcagggcaccatccagctttattcatcaaacatctgttaagagcctactacaggccaggtgtggtggctcatgcctgaaatcccagcactctgcccaggcaggcggatcacttggtcaggagtaggagttcaagaccagcatggccagtatggtgaaatcttgtctctactaaaaatacaaaaatcagccaggcatggtggcagacacctgtaatcccaggtacttaggagtctgaggcaggagaattgcttgaacccgggaggtggaggttgcagtgagctaagatggtgccactgccttccagcctgggcaacacagcgagactccatctcaaaaaaaaaaaaaaaaaaagcctgctacatgtcaggcttgatatgctgggcactggggataacaggatatctgtgactttctcctacgtgctaggtcaggggttgacctgggtccatggaagccctctagcatcaacagtgaaacagtatcctcttcctttgaaatatactcagagttaggacattcatacctttcctttaataatttgaattctcttgaagctaccattctgtttacacttagatggattttacctaaatgtgagtatctagagttaaggtttttagtgtttcctttgggtcacagactcttaggagtcaaattatttgaaactctccagaagaatgtatgtacacaccattttgtaactcttttatgccacatagctgtaaatcaaaagagttttaagaaccaatgctttagagacttacttttacttggggagaaagaaatgtaggtataaaagtatatttgtgttaatagtgagggatcctatgtggggctagttacttgtttgtagttttgtctttattttcatttggcttaaaaccctcaaatctaagagacaaacttaggtagcagagttgcttgcctttatatgacttatttcagaagttaggctactcaggaaaacactacattggcatgtagtgtctgtaagttgaactgaatgggataattcattttctctagttgtaaacatagtttatagtctgttagaaaatagttatgctgcaatgccagataatccatgacatatatattctgtatagcactaagcacatggtgcatttggtaaatggaacaactgaaaatattttgaagagcttatagacttttagcctgatatttaaaacccataagaaaatggcacaaagaccagattgcttttactgcagtatctcaagtgaaactgaaagtaatgacgtttattttgtgtgtgtggtaaaaacacataaaaattaccatcttatgacctctgatgtggtctccacagggaggaaaaaaatgaccattttaaccatttttaagtatatagttcaatagtgtaagtatacagttcaatagtgttatgtatattcatattattgtaaaacagcaccagagctttttcatcttgcaaatctaaaactctgcactcattaaataataacttcctttccaactactgtagccccggaaactaccattttactttatgtttctatgaatttgatgtcacatattaaataccgcacataaatagaattatgtagtgtttgtctttttgagactggcttatttcatttagcataatgtcctcaaggttcattcatgttatagcatgtgacagaattcccttcctttttaaggctgagtaatatttatttgattgtatgtgtacaccatattttgtttatttatttgttaatggacatttgggttggtttcaccttatggctgttacgaataatgcttttgtgaatacatacccagaagtgagattgctggatgatatggtagttctatttttaatgtttttaggaactttcatactgttttccagagtggttgcatcattttacaatcctaccaacaatgcacaagtgtctaatgtattcacatcctctttttcttgatagtggtcatcctgatgggggccaggtgatgatatctcattgtggttttgatttgcatttctccagtgattagtggtgttgatcatcattttatatgctttttggccatttgtgttacatctattttttttcaaagcacaatttaaatatgcacagacatgccattcttttatatgcacttccaaatcttgtactagctttttgtgaacattctctagtgacatgtacacctatgatgtggcagttccctaaaggctctaaaggggaaaatggggctataaaataaatatgttagaaagagacttgatgactgcgtaagtctccatgtttgccaccactcatgccattgaaaaagatatcttaatgatgtcagacaataggatttgataggctagtggtcatttgcagtcaagagtattagccaaaacagcacaacctggcaagtgacctgtaaagtctaatataaaataggaatttgcagtgtcaagaagccacagattgaatgtgaaatgacagcatgcaactcccctggaactttatgttgaatgattcataataaatgcttttcaattaggacctcttaagaattttcccttgtttgcatacatagtcatgtgtcgcttaacaacagagatacattctgagaaatgtgtacttaggtgattttgttgtaggaacatcatagagtgaatttacccaaacctagacagtatagcttactacacacctgaactatatggtatggcctgttgctcttaggctgcaacctgtgcagcatgtactgaatattgtaggcagttgtaacacagtggtaactattttgtgtacctaaacatagaaaagatacagtaaaaatacaatatgaaaaatttaaaatggtatacctctatagggcacttaccatggatggagtttgcaggactgcaaatgctcttggtgagtcagtgagtgagcagtgagtgaatatgaaggcctagagcattactggacattactgtagactttataaaatgctgtccacttaaactatactacatttatttaatttttttcttcaataataaattaaccttagcttactgtaacttatttactttataaactttaaatttttttacctttttgatttttttgtaataatgtttagcttaaaacacaaacacattgtatagctctatgaaaatattttctttatatccttattctataagcttttatctatttaaaaaaaattttttttttttttgctttttaaacttttttgttaaaaaccaagacacacacatattattagccttggcctacacagggtcaggatcatcaatgtcagtatcttccacctccacatcttgtcccactggaaagttttcaggagcaatgacacacatggagctatcacctcctatgatgacagtgccttcttctagagtacttcctgaaggacctacctgaggctgttttatagttaactttattattatttttaagtagaaggaggagtatactttaaaataacaatgaaaattttagtaaatacataaaccagtgacataattgtttatcattatcaagtattatgtactgtatagaattgcatgtactatacttttatacacctggcagtgcaatagttttgttaacacactagggcattgcactgggatattatgacagttgcaacatcactgggcaacaagaatttttcagcttcattttaatcttatgggaccaccactatatatgctgtatgctgtctattattgaccaaaatgtcattatgcagatgtggcacatgatcgtattatcttatgagtgtactgttgaccaaaagtagtatattttaatttttaacaggtcaatgattttttttttttttttgagacaaggtcttgctctgttgtccaggctggagcgcagtggtatgatcttggctcactgcaacctcttcccccttctggattcaagtgattctcgtgcctcagccgcccaggtagctgggactacaggcatatgccactacacccagctaatttttgtatttttagtagagatgagttttcaccatgttggccaggctggtctcaaacttctgacctcaagtgatccacctgtcttggcctcccaaagggctgtgattacacacatgagccactgtgcttagcctcattctgtctttagttggaggcagttagtgaggtataatgcaagaatattgtgcccctggccaaatactttgtccgatttcccatctaagtgcttttctgctaatcttagaagctttatgtcaccactgcctgggataccaagaagaaagacctctttcaaaaatggtttcccggccgggcgcagtggctcacatctctaaacccagcactttgggaggctgaggcaggcggatcacctgaggtcaggagttcgagaccagcctgaccaacatggagaaacctcgtctctactaaaaatacaaaattagctgggcatggtggcgcatgcctgtaatcccagctactcgggaggctgaggcaggagaatcacttgaacctgggaggcagaggttgcggtgagccaagattgcgccattgcactacagcctggggcaacaagagcgaaacttcgtctcaaaaaaaaaaaaaaaaaagaaaagaaaaagaaaagggctcaacccctaaaatcagagcttttcccttctcagctctcatgctgtatctctgggatctagttgtcagaaatatagcccacacattgggctattttaaagagtgtaaaatatttttatgtggtaagtataaaagggaagtaagttacatataagtaaatttcattttatttggatagcctaggataaatttaaaacataattttcttctaagtagatctaaattaaccacttccttgtagcctgaaaccttgggattgctgaggtatcatggtccctttcctgttttaggttcagctctctcctggttatttttttttttttttttttttttttctcttttcaccccatgatatctagactgtctcctggttattttatttcatgctcccagatccacaaatgaatttggaaagtaggcctttgccacacttcatatgttgtgaacttttaaattactaaatacaattttttctgaggtgaaaataacctgccttttgtggggagtgggggactggaataataaggaggaagaagaaataatttctctatatttaagaggtaaatgagaattccaagattgacctcaaattatttatttttgacatagtttcaaaggcatatcactttctcatatagatgaactcaatattctctagggctttctgaatccgccgtcttaatgggttttaagtgctttcatcaacactgtttatcagaaatacagactgtttattttatattttttaatgtgtgttacgtttgaaacttttaaagaatgagaattcatgtacatgataacatgggtgcaatctgagctcactgcagcctctgcctcctgggttcaagcgattctcatgctttagcattcctcgtagctggaactacaggcgtgcaccaccatgctgggctaatttttggcatttttagtagagacagtgtttcaccaggtttcccaggctgatctcaaactcctgggctcaagtgatatgcccacctcaacctctcaaagtgctgggattacaggcatgagccgaccgtgtccagccaaataccacttattttttaatcgagtatacatcaaagcaaagacaatgcaaatggtgctcagagggacttgtagttgttttcactatcaatctctttggctccagaggtgttaaatactgtcagttttttttttttttaattaatactgtcagtctttttgactcaactccaaacaaatgaatttgctggaattagtaggtttctatcagatacttttatattttatattgggtgccagttaccaattcaagaaaatagcattttttttttttttttttttttttttttttgagacagagtctcaccctgtcaccagactggagtgtggtggcacaattttggctcactgcagcctccgtctcctgggttcaatgattcctctgcctcagcctcctgagtacctgggattacaggcatgtgccaccatgcctggctaatttttgtatttttagtagagacggggtttccccatgttggccaagctggtctggaactcctgacctcaactaatccacctatctcggccttccaaagtgctgggattacaggcgtgagccactgcacctggccaattttttttttttttttgagatgaagtcttgctctgttgcccaagctggagtgcagtggcgcaatcttgcctcactgaaacctctgcctcctgggttcaagcgattctcctgcctcagccttttttattttattgtggtaagaacatttaatatgagatctaccctctaaaaattttaagtgtacaatacattattattgttttatgtgatgggatcttgctgtgttgcccaggccattcaagcgattcttgtgcctcagcctccgaagtagctgggattacaggcatacatgaagtattgtacaattttttttttttttttgagacagagtcttgctctttttgcccagactggagtgcaatggtgcaatctcagcttactgcaacctttgcctcctgggttcaagtgattctcctgcctcagcctcgctaatagctgggattacagacgtgtgccgccacgcccggctgatttagagacggagtttctccatgttggccaggcttgtctcgaactcttgacctcaggtgatctgcctgcctcgtcctcccaaagtgctgggattacaggcatgagccaccacgcttggccaaagtattgtactcttaacatggatatgctattttatttttatatgttgtgtaaaatatattgtacaatatattataattaatatgtacaatatactgtaattaatagtgatacagtattgcaactgccattaaaatgatgttgacatcagtgtgtaattttatcactaatgcttttccttttttggagagagtctcgctctatcccccaggctggagtgcggtggtgcgatctcagctcactgcaacctctgcctcccgggtagctggaattacaggcacctgccaccatgcctaatttttgtgtttttagtagattacgggtttcgccatgttggccaggctggtctcaaactcctgacctcaggtgatccgcctgcctgggcctcccaaaatgtcgggatttcaggcgtgagccaccgagcctggctgctaatgcctttcgtattgtattttcaaattttctatttagaaaaatcggctgggcgcaatggctcacgcctgtaatcccagcactttgggaggctgaggccagcagatcgcttgaggccaggcatctgagaccagcctgggcagcgtggcaaaactccgtctgtaccaaaaatacaaaaaattagtggggcatggtgacgcacgccggtaatcataggtgctcaggggactgaggcacgagaatcgcttgagcctggaaggtggaggttgcattgagctgagattatgccactgcactccagcctgggtgacaagaacgagactctgtcttagaaaaaaaagaagaatttcatgtacgcctggaaaaatacgatttacttaaatatttcccaattatttgcagaggagctagagagattatttattgataatcggtgactctttattgccttttaaaaaaattgtgactttctctgggcaaatttatttcttaaccaatttttaaagtactttagaataaattactcaattaaaatttcttttaaattacttctatttgtaggttgaactttctgatgttagccaaggtggatctaaagctaccacttcagcatcaatagctaaatcgatgtggcaataattcctgctgatactcccttaagggaattatatatagtatatataatttataattaaaatattataaattaataaattataaaaatatataattatgtattataattatactaatagttactattataatagttataaattataaaaatatataattatgtatttagaattatacaaatagttactattataataatagttaatattttaaattcttagtatgtgtgaaacacattgctaagccataatgtagaataacttaataagaatcttaagaagtagatactgttatctatattttacagatgataaaacaaaggtttagaaagaatacattacttacccaaggtcatacatttagtgaatgataaattcacttaatttaccctaaccctgatttattattattattattattattattattattttgagatggagtttcactcttgttgcccagactggatgcgatctcagctcactgcaacctctgcctcccgggttcaagtgtttctcctgcctcagcctcccgagtagctggaattgcaggcatgcgccaccatgcccggctaattttttgtatttttagtagagacagggtttctccatgtttgtcaggctggtcttgaactcccgacctcaggtgatccgcctgcctcggcctccaaaagtgttgggattacaggcgtgagccactgcacccggcctattgttattattattattattattattattattagtggtggtggctgtaaactttttgtcagtttctcttttcttaaaacctgggtgctccaaaagaactgcttcatttttgatagccactggacaattgtttataattattttggagctgcaaacccctttgaatatctgataaaagctatgattcttttcccagagaaatacattgtacacaaatttttgcatacaatttcaatttgcatatacctcttgaaacctatctgtagatcctataatagtgatcaaatttcaatgagtatgtaactcacctggattgcttgttaaaatatagatgacctattctcactgcccaaagtttggtgcattaagtctggagttggacttagactctgtctactcctccctactccctactcttttctcttttttcaaagagacagggtcttgttgggctcaagggatcctcccgcctcagctgggattacaggcatgtgcgtggctggaatctgccccctctccccgcttttttttttttttttttttgagatggagtctagctccgttgctgaggtgggagtgcagtggcgtgatctcagctcactgcaacctccgcctcccaggttcaagcaattctcctgcctcagcctcccaagtagctgggatcataggtgcctgccaccatgcctggctactttttgtatttttagtagagacggggtttcaccatgttggccaggctggtctcgaactcctgacctcgtgatccgcctgcctcggcctcccaaagtgttgggattacaggtgtgagccacggcgttttaacaagcacttcaagcacttcaaatgatttagatgcaggatattttaataccacactttacaaagatacccgaggttaagaatttggttattctacttctgttttagatcagctattacagagtatgtgttctaaatgttctaaagtaggtctttattaccaagtgactgtacaatattgcaattgccattaagaatgatattgacattaatgtatagttttattgctaataattcttttattttcaaattttctgtttagaaaaatatcatttgaaaaaatacagtttacttaaatatttcccgattatttgcagagggtctaaagagagtacttaccggtaatcagtggctctttattgcctttattttggaaaaaaaaatagaactttctttggtagatttatttctcaacccatttaatgtggtttagagtaaattcgtcatttaaaattttattttaaattatttttatttgtaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggtgagtgaccctagttctttacttactaggaaagtattcagtaaacctggataatgtgggtatgagaaaatatgtctttgtgggtgttgcctgctttgtatttataaaataggcagatatagttggccctctatatctgtggttctgcatctgtagattgaaaatatttgaaaaaaaaatgatagctgtgcctgcactaaacatgtacatacttttttcttattatcccctaaacagtacagtatgacaattatttacatagcatttacattgtattaggtattataagtaatctagagatgatttaaagtatatgggaggatattgataagttgtatgcaaatacaatgccattttatataagggacctgagcatccatggattttggtattgtggtgggttctggaaccaatcccccatggatactgagataagactgcacttaattgtattcaattgtaaataagcttaaaagaggtaatgtttaaatagtcttggagagaaactattggggccaggagttgggggccaggaggtcacagaacccaaaagacgggaggacagttcttttctgtcccctatcttagtttagtctttgtctttagttcctttaaattccatcttttaaataagaatgaaagcagggccttggatacattgtactgtgtgttccacgaaacacaagggaaaactttctttggttgcttattagtttttgatacaatctgttaactgaatatgtgatatattgtataatgctgtatttcctaaaatccagtcttgcacattttaaaaaaatgttcaaatgatacctttacacccataaaaacaacaggatttttatattggggtactgtgtaatatatgtattgtttatttcatcatgtccttttttaaggctctgctgaaaatgaagaaaagtcagaagttcaagcaatcatcgaatctactcctgagctggatatggacaaagatctcagtggatataaaggttcaaggtaacataaatgttagatgaagacatattctgcgccccccacccccaactcccataaacactgttctccagtctctggacaaaatggattcagatgttttgttgaagaaatgttagtattatattctaattcctattcttgaaactggacactgtacatggtttaaattttttgttaaatgttatctttgcaggatcacaaattaggtgtatgagcaggaaggatggtgtcttagtctattttgtactgctatagcaaaataccagagtgggtaatttatatatttatttatttgtttatttttttgagacagagtttcgctcttgttgcccaggctggagtgcaatggtgcgatctcggctcaccgcaacctccgcctcccaggttcaagcaattctcctccctcagcctccctagttgctgggattacagacatgtgccaccacgcctggcttattttgtatttttagtagagacggggtttctccatgttggtcaggctggtctcgaactcccaacctcaggtgatccacccgcctcggcctcccaaagtcctgggattacagtcgtgagccactgcgcccagccttgtttatttttttgagatggagtctcgctctgtagcccaggctggagtgcagtggtgcaatctcagctcactgcaacctctgcctcccagggtcaggtgattctcctgcctcagcttcccgagtagctgggattacaggcacccaccaccatgcctagctaatttttttttgtatttttagtagagacggggttttgccatgttggccaggctggtgtcaaactcctgaggtgatcagcctgcctcggcctcccaaagtgctgagattacaggcatgagccactgcacctggccaatttataaagaacagaaattaattttctcacagttctggaggctaggaaggccaagatcaaggtgctggcagggtcaggtgtctggtgagggctgctctttgctttcaagttggtgccttgttgctgcatcctctggaggggaggaactctgtgtcttcacatagaagaaggacaagtgagccctgaacactggataaagcctcattattctataaggaccccaatcctgtttataagggagaagcccttatggcctaatcacctcttgaaggccccatcttaatactatcacattggcaacagctgaattttataggggacacattcaaactatagcagataggggaaaaaagacagccaagacatatcccatactttctgtaacttgaaaaaaccaagaagcgggagtgaaggaagtaacagagtggacatggcagggctggcagcggtgctactttgagggcatgaaacacaccgttggctatggagcatgcttattttagggccagcagccgggtactccagcctgccggacacttcagtccagccccctcctgactggggcttgttactcacaagattgcattgtcccggacactaacttgggtccagggcccctccccctagcacttacctggagtttgtgcatgtttcctgctgctgggtgggttcagaaggtgatttcttttttatgtgtacatatgctaaataaatgtgatttaaaaaacaaaacaaaaaagtttgaacaaacttttgtaccttccaccagatcaggaagagagaatgtacttccatcttgagaagtgtaatctcattattggaagaaattagtctcattttggtatcattttacatgggaaggctgtttagtggtaggaagaaaatagttagatctcatctttttttttttgagatgcagtcttgctctgtcgcctaggctggatgcagtggtgctatctcagctcactgcaaccttcaccccactcccacccccaccccctcccccgggttcaagcgattctctcacctcagcctcccaagtagctgggactgcaggcacacactgggctactttttgtatttttagtagagatggggttttaccatgttggccagactggtcttgaactttgaactcctgagcaccagtgatccgcctgcctcagcctcccaaagtgctgggagattagatatcatcttaatcaggattatccaaaatacattgatgctcaagaatgtcagacaggagctactgcctttcttttcatttcttccataaagttgatcctttaattaattaatgactataaaaatacaagccatttattgatctctgttaagcattgtgcagtcagtactctgtagcggttaaaagcatagaccctagagtaagactgcatgggttcaaatcctgtcttggatttgaatcttaggtatgttttctcatttataaaacagctttgtgttaatacctcagatggttgtgaggattaaatgaatcaatatatgataaatcattgcaaaatgccccattcaataaatgttaagtaatattgttttcatcatgattttatataatttgatcctaattacaaccttatgaggtagatctttttatccttattttataaataaagagacttagaacttgttcaaagtagcttgtcccagattaccaagctagcaagaggtggacttgggattcaaatccagaaccctctgtctctctctctctctctctctctctctctctcagacaggttctcattctgtcgccactcttcttcctggatcctacatcaccctgcttcttgatttatgcctttgttttgacagagcatatccttactagctttctgggtaaagggtgcacaactctatcacttcttagctctctcttatgctgtttgtcttcaggtatctaaaataacatgttcgtcctgcccctccttcatccctccctttttcagctgagattctgtgagaaaatgtagtcctaatgccctaaggcatctcttgtatataatgaattagctatgctcctgtgcgtctagaataggattctaggtatgtacttaccttgggagaatggaaaaaatactcacttaaatccttttctgtattttgtagatcaaatacggaaccctggttgaaaaaggctgtgatgctagctgttggctttctgtagtagatgaggatataatgcctaaaccaccatcctttcatcctcctaatattatatatttcaaattctgttagttaaattcattatttatatcagtatgactatataaaattaatctgtaattctacttagccacagaatacagtataattacatttcatttatttttttatttttttccctcctccgagacggagtctcgctttgtcgcccaggctggagtgcagtggtgtgatctcggctcactgcaacctctgcctctcaggttcaagcaattctcctgcctcagcatcctaattgggattacaggcgtgagccaccatgcctggctaatttttgtatttttagtagagacggggtttcaccatgttggtcaggctggtctcaaactcccgacctcatgatccacccgccttggcctcccagtgctgggattacaggcgtgagccactgctacggcccatttcatttcttttacaactttttgttcttctgaaattaataaagccttgggttattttgtttcttttccttatgtttctgtggacctgttactaaatcactggcagacactatgcaattcataaatgtaaaagtccccaatatgaccaaacacaaaacctgcctgtttcctagggcttactctcctgcagcctcctattcccattctccaattgagactgctgtcatatttgttctggttctggaatatgccctcactatcatccctggaattcttttcacctttctcctctgttgtatcttttgtttcctggatgccacatcatcctgcttcttgatttatgcctttgttttgacggaacatatccttactaggtttcctggcaaagggtgcatgacaagtaaattttttttttttgagcactatgaacttgaatgttacaaatttcctaagaagacatacttgatagtttggctagataaagaactatatgggttgggagattttttttccatcagaattgcaaagacattacttcattttcatgctgagttcagggtgttgttatttgagttcttgctcatttttatatactttctgaaatcttttaagattgtcactttcttgattttttaaaaattaatgatactgtgcttggtgtaggtgtcttttttgtatcttcttatatgaagtaagtcttttcatctgaacattcctatcttccagtcctgggaaattttatctctttcttcttattgttgtttcttctgctctcgttctggaacacctcttaggtatgcattgaacatcctggagtgactgtcataatttattttctcccctctttcctatctcttttattttatactaattgctggcagatttttttttaaaccctcattctttttttttttccaaattctttttattggttggtactttttataccatcttgctattttacgaatgcaacatttattctgaagaaaattaagtgctttgtttttttgttgttgctgctgcctgcattgtctttttttgctcttagtgtctctgtcacatcctctttgttttgggccctttcttttataatagaggccttctttagacatctggtactctgtggctgttttattcatacttaagtaaataatgctgattctccactttcctgcctataacatttaaacttggcttccattattagggagctgtgccaagagaagggaggtctcactgttctggaggattgtgtctaggtcctgtaccgccttttgtacagtttttttaatcctgtccttctgtttcatgttcctccctgcatgccctccctgtggttgctggtaccttcaagtcctaggcctttcaggggttctggcagcatattgacctcctccctaaaccccagtggcttaggtttcagctttctctggtctattgaatcactttctactgtttgcccatctgttttccatcttacagaattttgttcacatttcatctgctatagtttctttttctattctctttgtccttttgggtgtatacctttttaatttcttaactttcattttagttgagcttctgagttattaggtgataaatgactatgttctctccaccatatttagctggaaatggtctacagagttttttctattaataatagtattcaggcacaaacatatacacttccccattcccctatacacccctgcaaaatagggcatatagtatatacactgttttgcaacttgattaaaaaaaaaaacctttgtatcatgggtttctttagtttataaagctctatttatgtttttaaccttaaaggtaaaaattttaattttgtatgtgtataacttacctcatctgtcccctgttaacagtcatttaggtcatttcagtttttgccactgtgagaaatgctactctaaccagcttttacatacataattgccttcttgtgacataggtaatctatgggaagcactgagaccagcacctggtatagagcagaggagctgccattattgcttgtgtttgctgggatcacacaacaaaaacattctataatttcttcaccagctatttccatggagcttagtgagaatttcttaggaagcctttgagaaatctttttaagttatattttctagtaaacgtaaattataggtaagaaagtcctatgtagcttagcctattgtattcattttacagcgtcaaaaaagtctttgtcatttgttgatttggttttgttgttcttgttgcatagcactcccaccaaaggcatagagaacaaagcttttgatcgcaatacagaatctctctttgaagaactgtcttcagctggctcaggcctaataggagatgtggatgaaggagcagatttactaggtatgatagctcatctgaagaaatatcatactgtttttaaaattgattttttaaatgatttaattgaaaagtcctttaaaatgtccccaactgctcagtgatacagggttattgcccttttaggtaattattgggaacatattctttgtgatcatgaaagttttaaatgaaagcacctttgcatatgggtatgcttaaaactgaattgcatttaaattcatgttttgaattcatacaacacaatttattgaactcctgctatatttcaaaacagataactacacataagaacatggtgatgtgtgtgtgtgtatgtgtgtgtgtgtgtgtatgtgtatgtgtgtgtgtatggattgatgcctagttatcccctggcttacataaatttcattatattctgttgactttaattaaataagaaattataacacttgatttttctaagttttctcagagtatattatgttttagccctatggtaaatataatcattttaaagtttgtgttctagaagaatacatggtctgaaaagaatattgcatttggctcttagactatttgcctgctgacctttgccaagtgtcttaacctttttggaccttaatttctttgtgtgtaaaatgaaggagctggaccctagttcaggaatctggcaaactgccgcttatgggccaaatccagctgaccccttgtgtgcgtgtgtaaataaagttttattggaacacagacaccaccatttacttattgtctgtggttgcctttgcctaccaacagcagagttgagtaggcaactgaaatctgaagcctaaaatatttactgtctggccctttatagaaagagtttgccaacccctgccctagatgatctctgaagttcctttcagtgcaaggttctggctcctatgaattagttttggtataccttccttataacttaggaccctatagaaattaaaaactatatggaattaaaaatatatacctttggagatactaagctaaaaaaatttgtatctattggtataattatagtacagattacactgttctcaaaaggtttcgtttgttaattgttatgactttggagtggagtgacattgcttgcattattttatgttaaatttattgattgccagttatgtccttgacattgtaaagtgtttttgaaggaaaacacaagttctatctaaatgtctatctaggccggttgcagtggctcacgcctgtaatcccaacactttgggaggccaaggcaagtggatcgcttgagctcaggagttcgagaccagcctgggcaacatggcgaaaaatatcaaaattagccaggcatggtggagtatgccagtagttcagctgcttgggaggctgaggtgtgaggatggcttgaacccgggaggcagaggttgcagtgagcctgggttgcaccactgcactccagcctgggtgacagagccagatcccgtctcataaaaataaataaataaataaataaataaataaataaataaagtatctagtaagagagattgaaagtattttaagtacatatagttagacagaaagggattgtcaccattaaagtttaagtaaaactttggaagaaattgaatgaattgcgtttctcatggagggctaagaaagttgtaattcttttttttttttgagacatagtctcactcttttgcccaggctggagtgccgtggtgcgatcttggctcaccacaacctctgcctccctggttcaagtgattctcctgcctcagcctcccgagtagctgggactaaaggcgcataccaccatgcctgactaatttttgtatttttagtagagatggggttttactatactggccaggctggtctcaaactcctgacctcatgattcgcctgtcttggcctcccagagtgctgggattacaggcatgagccaccatgtctggcctgaaagtttaattcttaaggaatactccatttttatatttaattttatgttttaattttagtttacatcaaattatacctgaaaagtttcttttaaggcataattagtttgagaaactaactccctggcaaatttgaggagcagatgaaaaaatgttagaagaattttaaaatgtatattcagtgcagtaaaattcaccagaatcaatatacatcaccccacaaaattcctttatgctgtttgtattaacaagaatgaagtaattctgaatataatttgtacactgtgttacctcataatgcagtaatgagtgataaaatgtttaaggttggtggccccaaactttcttttcttatgaagtatttagaagccccatagtacttagaaatatctgttgtcttttaaatcaattaaaagtaatatcctgatgctttggtttcttttccactttgaagataagaaacagactacaaactatcttttccattttgtagatgttgatacatttatctctagaatagttcagattagaatattttaatatattactgtaagtttagttacttatgaatatttttggtcaaagatggtaaataaaaatgttcctggccgggcacggtggctcatgcctgtaatcccagctctttgggagaccgaggtgggcagatcacctgaggtcaggagttcgagaccagcctggccaacatggtgaaaccccatctctactaaaactacaaaaattagctgggcattgtggcgtgcacctgtaatcccagctacttgggaggctgaggcaggagaattgcttgaacctgggaggtggaggttgcggagagccaagattgcaccactgcactctagcctgagtgacaaagcaaaactccgtctcaaaaaaaaaaaaaaagtccttggcttctcttctgtgtaattcagtgataacaaatttgaatcattatatatggactcagtacttcaattactgttttttttttttgaggtgagatctcactacgttgtgtaggctgtcctggaactcctaggctcaaggaatcctcttgcctatagcctcccaagtagctgggactacaggcatgcaccatcacgccagcgcaacctttttctgattttactaatttaaaagaatctcaacaatttgtcctttatcttgattggtgtctcatccctcaactttcttatttaaaactctctttgctgggtttctgtgatatcaacttgcctgtgtcctttcctgtctcgactcttaccttttcagtcatcttaacaggatccgcttcctttgctcgtctttcaggtatcagcgctcctgtcctaggcctgatactttgtttaagaaatcatgtttgctctcattgtttcttggttttcatggctaattactcccaagtttttacctccatctcagatctttttctagagcccaagactattatttcctaattgcatgctagacacccctaaaatgacttggagggctttacgtttgacatgtataaagctcagtttgttatctttattgttctgtcccccaaggctgctcttggaccaacaggcactgttttagtgaatgaatagctctccatcctgcacctctcactttccctcacagctaatcaccaaggcttgtttgttccctctcctaaatgtgtgtgtgtatacatacatatatgtatatatatatatatatatttttttttttttttcttttcttgccttgcttaagtgatacatcctccaggaattctgccttgatcccctaattaaagcttagttttccctgaaatgtattcccatggcactgcattttattataccactcttcatactttactgttattttttagttatctgtctccctggacagactataagctcaatgtggctgagacaactgtgtctttgttcactgttgcatatttagcacatagcaactgagtgaatgggattgctaaatagttctgacagttttgtttcacctcaaaatcggtgattcttctccttttgggattaaaaattcttcacaggtgaatttgtaagagagcaatgtacctttggaaaaacacacatgtagaactagataaaattgtgcatcttctcaagggattaccatataactctgaagctcatctatggacctagcttgagaatcagtgttaaaatccaaatgaaacttctgtgattttaaaaactgccaggcagttttttttttattttgcttgtttttaataagtaaagttttcaaatgtattagacctaagtttgtgcttcatttaagtcttgaatagaaatgaggccactttatgtttttcttataaagagttattgatcatttcaaaatgaaattttagataatcctattggttatatattcaatttatacaccatatattaagataactcttcattgggaatgtgtacatttaatgtaaactttatttatttatttttgccatctcggaaaggctttatttctacttcatccgggtctcatgcagactcaaaggcaccatcatgtgtttccatttggtatcctcatgactttttgtagtgttttcccttaagagtaagctctgtacattgccagttaatcttttaatgataattttaaaatgttgttgctgttgtatcattgatgcaaaaagaccaacaatagaagtacaatacaaggaaattcacaacatattatagtgggacagactgagtcacatttaggtgatggtgaggacgcagtagcagtatattcatgcacccaaagacgtgcaagccaagtaggataatatatggatcatacggtgaattttctaagcccactgaggactttgtaccttttcaaaaatgtcctgtataccctccagtttacagaattatctgtcttgtctactggcttcatggctaatgtaaactttagaaactatattataggatttgtttttcctgtagcacacatttcaatttttttcctttttataaatatttacacttcattgtgtttagttaatggtttctctacatcttgtcaatttctttgtttcctctctctcattttaaagtaaatgagtttagttcttgctttctgaaaacaatctaattgagattctcattcatttttctcttgggctgcttacgtaggggaatattctggtgtgtatgattttgaatattttaatattactgctttttaagctaggtgttcttggctgctgttctcatctaatgctttctcatcatttttttctgctcaactatttttttgcctttcatatattttcagcttccacgcttatctaactgcttgagagtttatagcaaacatagttactatataaactgttttcaaccagtctacattcttatttcttctgtctctataactttgttaaaaagttaacattcccagccattgtatctacaaaggaataaaaatttagcattagtgtttaaagcaaatatcttgccgaagatcattttggagttagaatttggaaacttttttgggacttttattttgttttgtttggtttcagtttgtagataatacataggtagatgattaatctatttctgatatttaattctttctggtgtaagtaccctgatctttgagaaaattagaatatagacaaaatatgagtccaggtacacagaatatgtagcattcctaggttggctgtttttgttttaagtaatttttaaatcatttggaaaattaccttttttaaaataaagggacatgttaactcctttgtcgtatgtagttttctttagaaagatttctttcctgtttacttgggttatgattattacttcttccattgtatgtgattttccaacattattagctcacaattccttgaagatgagtgactggtgggttttttttgttttgttttgttttgctttgattttttgttttttgagtgatattccctagtgtgttatttcatttcttcagtttcttaggaaaagcaaattaatagctttcttctccctaaagaccactccattggatcttgcattggatgctctacgtgcttatctcacagtagtcattaaaatgccaaacacgatcaaagacattcactcaagtgataactgaacattattattttataggtggcactttgaaggaaagtttgtattgttaattgaagattttcaatctaattatagttaatcttattgtgagaaagaattggtaaagcattttttaggtatatcagcatccttatgaatgaaggaaatcatctttatttctgtcttttgcacatcattatgcattaaatcataacattgtgattccagatgtttttcatatcatgtataaaactttatagattaataatctgttttcatgctgtttcttacgtaaaacatttcttgttctttgtttttgctttacatggaatgcatgggctttaagaccataatttctttggtaaggtttcatctgccttggggttctatctttctttagccttgtttttgcctgttctctattaataaggtctaatttttaggcaaaagcctacgaggtcagatgtgatttagaaacaatttcgatccatattaaagctgttcttttttaccctatgtagtgttggaatattagaatatttggcagaaaagtcttgatccttttgaaatattatctatgagaaatatagactaacagatattaaaaattggcctcattccctagcaagccgattcagatttaaaaaagaaataggccaacaaaatctttagccttgttcgtaatgaataattatttataattttataatctattaaagtaggtccatcaaatgaaattatagacaaaataaaattaataaaggacagataaaatttctaaaataaaacttgtgactatagcttatattttaaatgtatataattattgatgcatttattttcaaagtctttatcttttttcgtttgataggaatgggtcgggaagttgagaatcttatattagaaaatacacaactgttggaaaccaagtaagtatatgtgaaattttaacagaagataaagaattttcttcttgtccaagtcaatgacacttcatcgttttaacataatactaatggaatctccctgtcccatctcgttccccaactctgagtgtgcacacacacacacacacacacacacacaccctaatgttgggacctacactgccctgttagatatgttcccttgccctgtttttttgtagaaacacagattgtcatctccttttcactctataagtatccatgcctttttcttaatcttctaaatttgtcctggttttacactttttttgctccctcccttaacatttgtctgttttcttatctcttctcctggggtttcttttatttccacacaaatattttcatgtatactcagccttcctcttcagagctgtcttccatagctgtgcattcttgggtgcaatttgtggagtcttaagccctcagacacatttaatgggacagatccccagtcatgtggaaaagctgactgggttcctttgtcagtttgctgtgtcagagcaactttggaacatctgtgtatatccaagacagaatgcagttataataaggtcctatgcccactatacccaaaggaactggatatcagggttttttcttcagcgtagactgtcttaactttccagtttaaactgttttctcattatttattaaaggtaacatcaagaaataattttactttattgattgggtaatatattctgaggaattattaacaatagtaaccttttgaatgctatttttaaaatttaatcttctcactttttagtaattgatgatctgtcttgttttattcatttgataaatgagtaaaatcttagactgttgctttgtgttctttttgcatttatctacaaacaacattgggtagaatgtcttgaagtattaaattattattgtctatggttgtacagtttagtctacaaaggaatagctgaaagatggaaagaatatttatttgtaatgatgcacttgaaatatgtgtttcttagaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaagtaagttttaactgtgttgttctaaaccaaactctttgccagttatgccacaaagggttacagatgtaaccctgagactgagaccttctgtccactcaagcctggaaggccaagagctgcctgggagagggcaaagtgccccagcccattgcctctgctgtgagcaggcccctccagttgttagcctgtcatctaaatattattgtcttttgttttttgttttctgtttttttgagacggagtctcactcctgttgcccaggctggagtgaagtggcaaagccttggctcactgcaacctctgcctcccgagttcaagcgattctcttgcctcagccttctgagtagctgggattgtaggtgcctgccaccacacacagctaatttttgtactgttagtagagacagggtttcgccatgttggccaagctggtcttgaactcctgacctcaggtgatccacctgcctcggcctcccaaagtgccgggattacaggcgtgagccactgcacccggcctaaatattgttattttttatgtctataatgatgcaaaaagagttagagactgttcaaacatctttgttttgataataaggaaatttaaaacattatttttttatcccactttctttaatacctgtttatttctgaacaatgctatgatatgatgatactccaccaaatgagggtggctaaataccctgtttgggaaaagaaaaataatcctttagtggtagttaaaattgttgacctactcttatttttttgaaaagatgagctcaattcaaataacatgttttgttttgttttttccccactagagctcgggcagaagctgaagatgcaaggcaaaaagcaaaagatgacgatgatgtaggtttacaattttggactttttttcttaccttaccatgttttggtgtttcgggaagatcttcctacgtaagctttggatataatactataaagatttttaaaagtcaggagacatgtttatggtcatgaataggatagctcatgcttctgcatggtatccagatgctgagctttctagctccatgcagtgtgctcattttccctctgtgcctctgtgctcttacctgtagttgcatgttcaagtttgaggaccaactgggacattttggggtttttggttgttgttattgttgtttcgtttcaaattttgatttagaaatatgaaagcttaataataaaaattatttaacagtattaaaaagatgaagtctagaactttagtactagtcaattagttcatattgttgtgaacataagtacagaagaataaatatgagcttcttgctaatatccttagcatacccctagtctttttttttgagacagagtctcagtctgtcaccgaggctggagtgcagttctgcgatctcagctcactacaacttccacctcccaggttcaagccattcttgtgcctcagcctcccgaggagctgggactacaagtctaatttggctaattttttgtattcttagtaaaggtgggattttgccttgttggccaggctggtctctaattcttggctttaggtaatccaccctggtcagcctcccaaagtgctgggattacagatgtgagccacccagcccagcctcataatcattcttataacaaatgtttgcaggtcaaaggtcagaccaaagatatgtggttgttttggacagaatgatcacttggtgccccttcagtctctgttttttagtatcttatgtaatgatacacacaaaaacaagtaagacatgcaggttatgaatcataataaattaacattgtgaacctaccacccaatctgataattagaacattactagacattgaactattctgtgttcctcccctgcagagaaagctgctatcctatatttatcatttgcttaacttaaaaaaaaaattttatcatatcacatatgtatatatggtttaatttttccttttttgtgtttcacactacatttagtcttggagaccagcttcttttcctcagtggcatgtttttgagattcatccgtgtagtacagtgctgtagttatcattcatattcactactttatgatatcccattgaatgaatagtcacaatttatgtatttattttcctgttaaggaatatttagtttgtctcagctttttacaatgctgttgttacaaacattacagtagaagtctccaggtgggcaggagcagtagcctttccagagtacatacctactagtgggcttgctgtgttataaacttaagatctttatcatttgttgtttaactttattgaaaggagaggcccagtttctataacagaacaacaaaggaggaggactgctaagggctaagcttagtgtctttcttatgtcccaaacctttcagctttgatccaaaatgtggataatgaaagcctataggacgttgacttgagccatgttcccttgaggtcttacccctgtgctcactctatattcacatactctgtctaagagtaattctggctaatacagttgtctccatctgtttgcatttatgttggtattttagcgactcttatagttgagtaccttggtaactaggtaataagtttacccttaatgctggtcttgggtgagtatgtggtttggtaatttgagataaatggaactaacttataactattttctgagtgacgattgttacagagcatgaattaaaataatggtagagcaacatttttaggtgaaacttacaatagtgtattaaatctatgtagataacaattttggttttagtttaaaatctgcactatcctttatttttattttagtattattactattttttagagacagagtcttgctctgtcactcctccaggctggaggagtacagtggcaatcatatcccaccacagccttgaactcctgggctcaagtgatcctcctgcctccgcctcccaagtagctggaactacaggtgcatgccaccccacctggctattaatttaattttattttttgtagagccagggtctcactatgttgcctaggctggtcttgaactcttggcctcaagcaattctatgctttttttttttttttaacttcagcctcctgagtagctgggaccaaagttgtgcgccaccccatacgtggctaattttttattttctgtagagatgggatctcacaccacattgccaaggctggtctcaaattcctgggctcaaagtgatactcccaaagtgctaggattataggcgtggaccatcgtgcctggccctactgtttgtttttgttgttgtttttgttgttgttgttgttttgttttttaaagacaggattgcactctcttgcccaggttggactgcagtggtatggtcatggctcactgcagccttgacctcccagctgaagcaatcctcctacctcagcttcccaagtagctgggactacaggtgtgtgccaccactcctggctacagggttttactatgttgcccaggctggtctcaaactaagctcaagcattgtacccgcctcagactcccaaagtgccgcgactacaggcgtgagtcactgcgtccagccccctactattctttttattttttagctttattttttatatatttttaagaaccatgagaacagacccacactactctttatgatttctttataatatgttcaaatatctgtgtatatatattcagaaattaaattgctgccttttatctttgtagtcatgagtgattatttaaatctctttgttggctgggcacagtggcttacacctgtagtcccaacactttgagaagctgaggcaggagcaccactagagtccagtatttcaagatgagcctgggcaacataacgagaccctgtctctacaaaaaaatttaaaaattagtcaggcgtgttgacatgtacctgtagtccaagctactcaggaggctggggtgggcagattgctttaacccagaagttccaggctgcagtgagctatgatttcaccactgcacttcagggtgggcaacagatcaaggccctgtctcaaaaaatatatttttttaaaaaaaagtctttgttgattttgtttttataaagccatttttctttaaatgatctactagattaaaaattaaggaatgcttaaaaactgaaagattttgcataactctgagatgaacaccaagacatttataagcttccagaatgatatgtcattttcttgtcattatagagtgatattcccacagcccagaggaaacggtttactagagtagaaatggcccgtgttctcatggagcgaaaccagtataaagagagattgatggagcttcaggaagctgttcgatggacagagatgattcggtttgtatgacaagcgctccattattttcctactattattttgtaggtttgaatattccttcatgtggaacttaagtcctgccctgtaagatccaagcccctttctctgtttactaggagagactttttaaagtaacactcagaattagcaacagaatgtgatcaaaggaggtgctttttgggccagtaagggatcttggaggatgttactacgacctctaaaaggcaattattattacttaggaatgatggtcatttttcaaatatagaaatcaatactacttacccagtaatgtcaggaaaagatcacaatttcatatgcaacacaggaaaataaattattttgactcagtgtctttctgtaaaatactcttgcttgatttctttctctcttttctaactgttcatgccaagtacacccttccattggtatctttcagtcagatggctcttaaatctcacccaatgctgccatctaatggttgtagtctcagtaatagtgtttctttaatttagaaagaactgaaaagtttgtaaatgagctgccccctaatttacccatatttttgagtttggattgtcatatcagatttaccaataatagtatgcattgacatgttgtttttaagtttatgaacacattctctaattgccaacttttacttctttaggattacatcatttatttcacagtttatgtaccctttaccaatgttatattagaatcaagtgttttaacatatcattttacaatttgctgtgatagtaattgcttataactgcccataaggaagatcagtattctaatctatatttattagacaaggaaactaacccactagaaagtgtatgttcttaactgcagtatttagtggatatcgaataaataataagtaaatattcaaaaaactgaaagtggaccttatttatttatttatttatttatttatttatttattcattcatttattgagatggagtcttgtgatggagtcttgctctgtgcccaggctggagtgcagaagtgtgatctcggctcactgcaacctccaccccctgggttcaagcagttctgcctcatcctccctggtagctgggtttccaggtgtgcgctaccatgcccagctaatttttgtattttttagtagagacagggtttcaccatgttggtcaggctggtctcgaacttttgacctcaagtgatccgcccgcctcggcctcccaaagtgctgggattacaggtgtgagccactgtgcccaactggacttcactttccattgctgtttttaactctagcagccaagtggtagtcaacaaattaaaggaaatagtagcttacttttaactacttcactgaagtaaagaatgtttttaatttagttcataacaaaaaagtagtgaaaagagagctctgattatgatggcagaatccctaccacctcataaatcaatttggaatatcttattttctgaaattttgttgaatcacctgtcaatccagtttatcctcttccctgctgtggtcatctttccagtgatggaaaagttttagtcttgtgaaaaatgacccctcaggatgccaaagtttcaagctattttgtgagagctccgagtatagatgatagagacttttatgtaaagatgggaatttacaaggcaatattttaataaaagggaaagttagagggtatcttttcaataaaaaattttaaatatcattcaggcatgttggctgtctagcacatattacagtcctctgtcggtagactaagctctttgagggagggatgatattttatttttcttagtagaattaaagtcaatctttagcagattgactgacacatggtaggtcaaagtaactacagtatttattgaacttaattgttgactcccctctgtgtatcccatgaacttcttgggtctcttgttcttcagaaagaaaggtagaatacctcactgataaatgtttcttttcttttctttttgaatgtagggcatcacgagaaaatccagccatgcaggaaaaaaaaaggtcaagcatttggcagttgtaagtattgaaaaacaaagatgttagacagcacatgagacaagaaaattacagtcaaaatttatttccaagaatgattttatgtccattttctttccttcattttttttttttaaactaggggtaatggttaagtagctaaactgaactttttttttttttttaatatatagtgtgccaactcggtaaggctcttctcaaggacaaaaaatatgatatcgtaagctgcatcatgttgactgtgcatttgttgcaatcctctgccaaatttaaataatggggaattatttagagacttgaaaatgacctggatccccattaaataagtttctgattggctggttttgtgattgtaagaaactttacaaagtgaagatgagaaatttagtgcttgtagggtttgagtaatattgtgtatgtattgagcttgagttatgtttgtgctagaagtactatgtgtttactgtgattaaaacttacccttttttggtgaatctgctatttaatggaagtgtcaattaaaaaagaaatagacccgaaagtagttgtttaaattgagcttaatcagaaaatgtataaaatgtgtgttaacatggtaatatgtgttccagtacttgattataataagctgtttttagaactggcatactaagcttccattcacatcacacagccataaccttgcggtttaacaatcgctcttaccttgcaccaagtaggagctagcaaaaaaaccaaaatatatttattcagtaggagaagtttcctctatttaagagcttcttgctttcattatacaaattgctagttaaagaacaggcacccgccattctaagcaatagtttctcttcactgaatgtctgagtttggctacgagttactgctaaggctacagcgtatgactacaaaaactgtttttgccaatttctaactcattgccttgtaaaagtactctgaaattttcttcaacattaaagtttgtggaaaatcaaggattgtttctcatagtacatgtgacacacagacatactgtcttcttttagtttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagagtaagtcttttccaaattaatcattatattctaaattaagttagtggttcagaatattcttggcctcttatcagctctaaggattcaggtaaatctataaaaaaatcatttctgggccaggcacggtggctcacacctgtaatcccagcactttgggagaccgaggtgggcggatcacaaggtcaggagttcgagaccagtctggccaatatggtgaaaccccatctctactaaaaatacaaaaattagctgggcgtggtggtgtgtggctgtaatcacagctacttgggaggctgaggcagaagaatcgcttgaacccaggaggcggggttgcagtgagccgagatcatgccattgctctagcctgggtgacagagtgagattccatctttaaaaaaaaaaaaaaaaaaaaaaaaaaaaatcatttctgtaacttggctgtctttaagtaaattacttgtagtcaaaagtttttatgaaaattgcttttcagtttttataaaagagaaggatttttttttaaatgcctcatttttgctggtatgacaacattgataaatacctattaatagaaatgtgaatggcctttagaggtaaatgagcctttatcctaaatgtttgaacatttctgttggtgtcagaggacttggttttccatcctgactttactactcattaggtacaaacacttgggcaaattaacctttcagagcccccagtttctctgtctgtaaaattaatctgataacctatctcaaaggtgattggacccaattatacagttatctgtaaagtatctgacatataggtagatatgttaactgtggtatatatacatagcaactcatcttatgaaaatttaaatggccaaaataatggcaaattattttcaaaatcattttaataatattttaccttataactccaaagtttaccaaatcagtttgcatttttattttctgaaacaagttaatgggatctaaaatctaacctatatcaatcttcctaagcagatattgatttactcaagttttaaatcacttctagcacgttttctggcattaggatattctcagtaaatatttgttgaatgaacaacaacaacaaaaaagccaaacatacttaagaattttcccctttcatatggccagcatctgaaacctgatataaatttggtggctgatgattcaatttaatgtaacaaagctgcttggtaacctgttaaagcttaggcactgaattcactgcacaaacttaaaaagaccagctttagtataacactttgtttgtttgtttgtttgttttttgagatggagttttgctcttgtcccccaggctggagtgcagtggcaccatcttggctcactgcaacctccaccgggttcaaatgattctcctgcctcagcctcccaagtagctgggattataggtccgcactaccgtgcctggctaatttttgtatttttagcagagacggggttttaccatgttggccaggctgctctcgaactcctgacctcaggctatctgccctcctcggcctcccaaagtgttgggattacaggcatgagccaccgtgcccggcctattataacactttttaaggagctgttatagttgaaataaactaatttgaaatcatgtaaatttttgttgtttttgctgttttagtgacagaggagagataaaactggggataaacgtaattaaacgtattcatgtaattaggaaaatcttttttccttttagaactgaagctagtttagcctcacgcagagaacaaaagagagagcagtatcgtcaggtaaaagcacatgttcagaaggaagacggtagagtgcaggcttttggctggagtctgcctcagaagtacaaacaggtaatatgcacatgtggtaagagcatccagcaggaaagaagagggcaagttgagtgtgcgtgggcatgaaggattcactgtacgcatcccagccctgctcatctcagccgcatggactgggcacacatttaagcatggagggtggtggttttcaggctgttttctagagctgtagaactcaaatgaaatgctctgagtctgtgagggggggaggagtcaataaagggtggctaagtgcatggagtttgaggtacccgctctgctgtaaccagagcaattctggtttaatatttgaagatttcattttttaaaaaaccagcatcattgttgaaaaaattattggcatggaacttttcaaactgttcatttaaaattaagttcaggtcttcaggaattttatctgtctactccataattcctaccccaaaagactcacatgttcatgtacaaacacatatgcatgtgcacgtgtgcacatatgtgtgaattagagcctctttttgagctcccattatatcctgtttattgaattgctcaacttgatttttctgtttttcaaataagaatggcaaaattggctgatgcctgtcattggctcatggtgcctgttattgactcatgcctataatcctaacactttgggaggccaaggtggaggatggcttgagctcagggagtttgagaccagcctaggcaacatagcatgacctcatctctacaaaaaatttaaaaaattagctgggtgtggtggcctgtgcctgtagtcccagctaccttggaggctgaggtgggaggggaccgcttaagcctgacagattgaggctgcagtgagccatgatcaagccactgcactctagcctgggcagtagagcgaccctgtctcaaaaaaacaaaaaaacaaaaaacctgaacttgatttcaaggagtaaataacagcagtgcttgctcatgtctcagtggatctgtaataagttcacttttgatgaggcttactaatgtgcctttttcactcctccttccaccattattaggtaaccaatggtcaaggtgaaaataagatgaaaaatttacctgtgcctgtctatctcagacctctggatgaaaaagatacatcaatgaaggtaagttcattgtgaattaaaaggagatgttttctaaactctgggtagttttttttctaaaaccaaaaaagtataagtattacttctatggtgaggttattgttcattttataatattaggttataagacctgtatttacaaccattagttattttaagaaaacatgaaaatgctaaacatttctagacttaatattgttttctttttcacctgagaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggtaagtgtgtgtactaacatttgacctggtttatgagactatgagtttaactctttcatccaaaatttgcctctgggtccagcttctaattgggattactatgccctggcttactgtccctcagcacccttttaaaatcaattttaaaatattgaggtataatttacatgcaataaagtgtgcactcgaaatgggtataggtcagagttttgacacatgtgtacacgtatgtaatcactacagtgatcaagctaatggaacattttatcattgttctgctttacctgttagttttgtgttgctgtttagagacagagtctcactctatcacataggctggagtgcagtggcatgatcatggctcactgcagtgttaacctcctggactcaagtgatctgtccacttcagccacccaagtagctgggactacacacccacaccaccacacctggctaattttattttttgtagagacgagggtttcactgtgttgaccaggctagtctcacacttctggcctcaagcagtcctcccacctcagcctcccaaagtgctgggattacagacgtgagccactgtgccagcctaactgctagtttttcatctactaattaatattgataggtggttgtattagtctatattcacactgctgataaacacatacccgagactgggaaggaaaaaagaggtttaattgggcttacataggtaacctctggggaggcctcagaatcatgacaggagatgaaaggcacttcttacatggtggcagcaagagaaaatgaggaagaagcaaaagtgtaaacccctaataaacccatcagatctcgtgagacttattcactatcacgagaatagcatgggaaagactggcccccatgattaaattacctccccctgggtccctctcacaacatgtgggaattcggggagatacaattcaagttgagttttgggtagggacgcagccaaaccacatcagtggttgtatttttacccttccaaataatctggaaataaatttgaaatagtattgccttttactgtaacagcaccaccttatgaatatttgtacatacatattgttttaaacatttttcctcctttgcctatacaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtaagagtgagtcatgcgtttctctgccctcccctccatccacctacctgctgggcactgatgtagcagctgaagatgcagttctgcaccttgctgtcatgaagcttatgttctagttagggaagattaaaaaacaaactggaaaccattgaataaagaagatattttcaggtagtgaaaaatactgtgaagaaaataaaacaatgggaatatgagaaaataactgggagccagaggactgtttggattaattaataaggaaaggtcttctaaagttttggattaaacattatgtgatgttaaaacattagtttaaaaattaaagaagtgtatgtgatatatccatatgttggaatattattcagccataaaaaggaatgaagttcttttttatattttattgtggaatacttaatatgagttctactttttttttttttttttttttgagacagagtcttactctgtcacccaggctggagtgcaatggcatgatctcggctcactgcaacctccaccttccaggttcaagtgattctcctgcctcagcctcccgagtagctggaattacaggcacctgccaccacgcccggctaattgtttgcatttttactagagacggggttttaccatgttggtcaggctagtctttttttttttttttttttgagatggagtcttactctgtcactcacactggagtgcagtggcaccgtctcggcttactgcaacctctacctcctgggttcaagtgattcttttgccttagcctcccaagtagctgggactacaggcacgagccactacacccggctaatttttgtatttttggtagaaatggggtgtcaccatattggccaggttggtctcgaactcctagacctcgtgatctgcccgcctcggtctcccaaagtgctgagattacaggtgtgacccaccaccccgggcagtcagattagtcttgaactcctgacctcaggtgatccacccgcttcgtcctcccgaagtactgggattacaggcatgagccactgaacccagcctgagatctaccctcttaacacatttttgtttttgtttttttgagacagggcctcactctgttgcccaggctggattgcagtggtgcagtcacaactcattgtactcattgcagccatgaccttccgggctcaagtgatcctcccagctcagcctcccaagtagctgggaccacaggcgcacactaccacacctggctaagttgtttgtactttttgtaggcagggtttcaccatgttgcccaggctggtctggaactcctgggctcaagtgatctgcctgccttggcctcccgaagtattgggatgcccagccctcttaacaaatttttaagagtacaatacattatcctctaggtagaagttctgacacatgttataacacagatgaaccttggaaacactatgccaaaggaaataagtcggacacaaaaggacaaatattatatgattccgcttatatgagatatctagaataggcacattcataaaaacatagagtttctgtgtgaggtgatggaaaagctttagaaataggccggccatggaggttcacactcataatcccagcactttcagaggccaaggtgggacgatcacttgagcccagaagtttgagaccagtctgggcaatatagtgagacctcattccacaaaaaatcaaaaaatgaggcgggaggataacttgagtcggggaggtcaagactgcagtgagctacgattgcaccactacacacccacctgggcaatgggagtaagaccctgtgttttaaaaaaaaaaaaaaaaaaaaaaaaaaaaagacctggcatggtggcttacacctgtaatccagacactttgggaggctgaggtgggcggatcacctgaggtcaggagttcgagaccagcctggccaacatggtaaaaccccgtttctactaaaaatacaaaaattagccaggtgcagtggcaggcgcttgtaatcgcagctacttgggaggctgaggcaggagaattgcttgaacctgggaggcagaggttgcagtgagccgagactgtaccattgcacaccagcctgggcaacaagagtgaaactctgtcgccaaaaaaaaaaaataatggtgatggctacacaatgttataaatattaatgccaatattgtaaatattagtgccactgaattgtacacttttaaatggttaaagtggcaaattttgtttatatatatattatttttactgcaataaaagtttttagtgtgatataaataaaacaattttctaaattaaaaaatgagatttatttttatattgtaaatatttttatattataaatgcttagtttttaatgttttactaatatcttaatcaacctatatacttggggcatttaatttttaacagtaatggatagaagcttatacttcaagtagtagcagtagtcttgatgatttaaaagaatttttttttggctgatgttgtcagatataatagattgtttttaacctgtggctgctgaggagctcactaagaacagaagctggctaggcgtggtggctcgcacctgtaatcctaggacttgtctgaggttggtggatcccttgaggccaggagttcaagaccagcctgaccaacataccgaaaccctgtctctaccaaaaatacaaaaattagccaggcgtggtggctcacaccggtagtcccagctactcaggaggctgaggcaggagaatcacttaagccaaggaggcggaggttgcagtgagctgaatcatgccactgtactccagcctgggcgacagagtaagactctgtctcaaaaaaaaaaaaaaaaaagtttattttctgacatttttatgtttatttgcacttgtgttaatagaagtattttcttaattttttaagttaccttcccatattgtgaagatttgtttatgtaaatttaatgctacctgtattcaactacctgtacatctcacctgcataactctcatttcaaacctgtaattgttttagtaaaaaaaatgttatttatagaagtttactttgctgttacaagaagatttatttttcaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccaggtatatccattctctttacctgccatctgtatagagtctaaggctacactcagatgcctcattatggacttaatttagatcttaagtaacaaggttgaaagaacttgaaagaagatactgtaggccgggcgtggtggctcacgcctgtaatcccagcactctgggaggccaaggcgggtggatcacgaggtcaggagatcaagaccatcctggctaacacagtgaaaccctgtctgtactaaaaagtacaaaaaattaaccgggcgtggtggcgggtgcctgtagtcccagctactcgggaggctgaggcaggagaatggcgtgaacctgggaggtggagcttgcagtgagccaagatcacgccgccgcactccagcctgggcaacagagcaagactctgtctcaaaaaaaaaaaaaatgctgtaatgactgttaaatggaatgaagaattcttaatttcatggtacagtgtgaaggagtgggtagatggaatggaattctataacaggggtttgtgtggggaaataattggaggagaaaagcccagacttggaatagtgttttatttactttgtagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgaggtataataatgggtcatcaacttaggcaactgggtgaagtgcacaaataaaaggaaccaaaataatctcaaacagtcaaaagatttccactaattagtgtcactgtggtggattaaaagatacctattcttgtgataatttcatgtattcccgctccatcattctcgctggatattcccccccatttcttctgtacaccttccaatttaaaaaaaaaatcttatctataaaagtataatcatgcatcagtcaacaatggggatatgttctgagaaatgtgtcattaggtgatttcatcattgtgtgaacatcatagagtgcatttacacaaatctagatggtatggcttatcacacacctaggccatatggtatagcccattgctcctaggctagaaacctgtacagcatgttactgtactgaatactgtagataattggaacataacggtaagtatttgtgtatgtaaacatgcacaaggtactgtagaaatatagtagtataatcttgtggaaccaccaccatatattctgtccatcattttccaaaatggttttaccaggtgtgtgactatatattagtcaaaatctttctgttcattttctcctctgatctgtttttttttctttttttttgtacttactgtcttccattctataagtaattctttgtcattttaatcccacccctactctaattttcactccagttatcagcaaaattggccattgtttaaatctgccattgtacaagtttcccacatgggtgtggatgacctttttgaatttagttttcatgcaaatattttattaaaaaacaactcagatagttccagtggctcatgcctataatcccagcactttgggagtctgagcaggaggattgcttgagtccaggagttcaagaccaacctgagcaacatagtgagaccctcatctctacaaaaaacttaatgattcgctgggcgtggtagcgtgcacctatggtcccagctactcaggaggctgaggtgggaggattgcttgagccctgggagctggaggctacagtgggccatgatatcaccactgcactgccgcctgggaaacagaacaagactctgtctcagaaaacaaacaaaccaaagaaaactgtttgttttaggctcctccgttaaagggttggttaatctaggcccatttagtgaattattttattttctttcctgccttttctagatcccctctagatgagagtctctttaaactagatcctttttaaagtttaatattcttagtgtataaagtaagaaagattaattaataacccatttatgcctagtggtccattattggaatgctaagcttgtgggagttattcatatcctactgctcaaggtcatcgctaaggtctgattttttacaaaaaaaatttgcaacctccggcataaatgggttaatatttaattcttttttttttttggagatggaatctcaccctgtcacccaggctggagtgcagcagtgcaatctcagctcactgcaacctccgccttccaggttcaagcgattctcctgcctcagcctcccaggtagctgggattgaaggcatgtgctgccacacccagctaatttttgtatttttagtagagatggggttttatcatgttggctaggctggtcttgaactcctggcctcaagaaatccacccacctcaccctcccaaagtgctgggattataggcgtgagccaccgcacctggcctgaattattaatttaagaataagtcatgtttgaatttgatagcctggttatatatcttttactaaatatgccctgacaattcaaaggaaaggttttgtgatagaatattaaacatatttcagtttattaatttattttaggtcattctttatatttctccctactatttgtatgtgtgtatccctcccttctctctcacttgagaagaaactatgacaaaacccaaaataagagacagccatagtaattgtctgaatattaactgctgtatttcattaccatgtcttattatcttttctgctccttgggcttcctagtttgttaatgttatttctggtacaattgttgaaatatgtgatgtaagcttttgactttggcttttctggaattttggtggtttctttttttttttttgactaaaagttgaagccaggtgtgatagtgtgtgtgcctctagtccctgttattcaggaggctgaagtggaaagatcacttgagcctgagaggtcaaggctgcagtgagccctgattgtgccactgtactccagcctgggtgacagagtgataccctatctctaaaaaataaataaataataaacaaatgaacaaacttaaatatagaaggattcagtccctgaaaactataacgatagttaagtatactcagatttctttccttttgccctccctttccagcaatgactcagatgcatataaagatcaaatatcagtactgccaaatgaacaagacttggtgagagaagaagcccagaaaatgagtagtcttttaccaactatgtggcttggagctcaaaatggctggtaggtgtcaatgcttttaacattagaatatgttgttttacttttgcttttgaaatcagaagataagtaaaatatggtaaacaaatacaaaaagtgtggattaatgcaaagaattttatatatacacacaatttgatgttatgttgcaactaccacataaactggacttgcactggttctgaatagtaagccatatgtttctttgtcacagaatgttccctttctataatattcttggaagaagaggtatgtaaaattttaaaatcgaggtgctccagaaatagaagatcctgaacagcacaaagacagagaatatttaatttatgtaggctagaatgtgggcaggaaaacagggattaaaccaacattttggctgcaggaaggcccaatcccaacttttagtgaattttttactaagataggtaaaacaaatcacaatctgcaaagtcagatgatgatgactaatattatatggtttgttcactttccggttgtgtggagagttttacaaaattgtgcatttacaaaggttaagcaagattactgttgagcatctctaatccaaaatttaaaactctttgaccactgttatgatgctggcaggtaatgctcattggagcattttggatttttgaattaggaatactcaactgttatgtatgatgtaaacattctaaaatctgaaaaagtcagaaatcccaagcatttcaaataagggttactcaacctgtagtatgtctttttcatatgagtccaatactataaagtgaagagttggcaaacttagtgtaactctcttccagtagagcattatgggcattgtagtttgaatttcatataaatctcccctgtcgtaaaatacccttgatttcccccccacacacacttttaaaaatgtaaaaagtattcttagcttgcaggctggattaaaacaggtggcagactggatctggcctgtaggccatagtttgccactccctatgtgggccactctgtcatccaaaagttatagatcagtgtagtagagaggtaaggcaattcaaaaaaagagttttgcccaaggactaagtgtgtgaacctgactgtgcattgcactagttcttgcttttcagtcttcatatgtttttctttgctcagcagcctatttctttaccttaggcctaccctcactctcatttttcttttctgaccattgcacaaaagcagcagcaccttttcctaaaatttgtatgttactcttctttccttctgaatgaacttcgcgatcattgttagatatatgcaatgtcttgatgttctctatgccttaccagtgttgactttgttcttacagtttgtatgtccattcatctgtagcccagtggaggaaatgtctccattccattaaacttaaagattcgattctcagtattgtgtaagttttattttggaaattcttcttgttaaaactatgcattttggtataaactagattttaagactttgaaagctaatacatgtttcacgactaaattagtatccaatttgtttgtttttttaaccctttttatggaactagagaagttaagtgagaatgaaactgtataatagaaaacgaagtagaaaggataacttgcttgattgagtcctcaccatactgcgatttatttagcactgcaggaaataaccaatacctattaagttatgtttattttagaatattctttatggcttgtaaatatgttgattggggcattgattactagttcttttctatgtgttcactgtaaaaaaatcagacagtttatctctgagcctacagggctgactctgttggttccactcaaggtgcatgtctctggtctttagagtttgtgttgattgtctgtgatgagaggagaaccttgggccagaaagtgaaataactgagataccattcatactgtttatttagttcagctgacattttttcatagcaggacatccacagtgaagaaagtggtgtgttcatttatattcaggtgtcagctccttaactcatcacagattggccctttgtgaggccttgaactagttcagtagcatgtggtcccttctgtattcctgaatggagagttctgaactcccctttcctgtttgcagacacgtgaagggaatcgtgttagtagccctggctgacggcacccttgcaatctttcacagaggagtgggtgagtggtgatgtgtgtataacatggacactaatttgttgctttgcaaagcatttttaagtagattggtttatgttttaaagaaatgatactcagtttaaagaataaatactaacaatacacaacatcagtaaatatattagtgcgtgcatggaggtatacattaacagataccttagggaaaatgtgtttaccacaatgggcattttatggtgcttttattttattttattttttgagacagagtctcgctctgtcgcccaggctggagtgcagtggcgcaatctcagctcactgcaagctccgcctcccgggttcacaccactctcctgcctcagcctcccgagtagctggactacaggcgcctgccaccacgaccagctaatttttttgtattttcagtagagacagggtttcactgtgttagccaggatggtctcgatctcctgactttgtgatctgcccgctttggcttcccaaagtgctgggattacaggcgtgagccaccgtgcccggctggtacttttaaataatgtgatagggaggcatttgtttttcattcatatacttatgcaattcggagaaacttggtgtttttttaatgtcctatgtgttaaaaataatttgtgtccacttaacatttggactttttcttaaagaattttaattgggtaagatttaatcattttcatgtcaccttatttatattctccccctttaaaaccattgtttcatctatagaggggtggtggtatcagaaaccctaccttaaatgaattaagttgagggaatttagtatgtattcctccgtaactccttggtacttgtgtcaaccaaaaatgatacatcattttctacccacttgattggtatatctaggaagtattatgaaacatagataccctgaatttggattttagaaaagcttttcccaaaatctcctatctttctgggctggggaaatgtggagtagatgacagttaggtgcttttgtaattgattggtacctgaaaattgctggttaatgactccatatcatcaaagagtgagagggctccattttacctttttcagccctttatctatgtttaatctttacagtaaattattaagaaagttccatggtcatcctcattttatagatgaggaaactgaaacacagagcattttggtaactttttcatggccactcagctaataagtggaaaagcctagaaaaaaaatgaaacaatgcatgttttggtaaattgaattcaaaataatattgacagaataagacaagtaaaatgcatttagtaagtgtcaatgtaaagtcctgcatttgagttcagaagagcacgatggggagacatgtctgaagagtgagaattacctaaaggttgactataaactcaatatgagtttaatgccttaagcctcaaagacaaggctggtgataatcctgctctactaggctagataaagacagcatattcaatggacatcaacaaaacagagttaggatgaagggtctgtaaactgtggtaggtacagagcacatgccaaagataacttggttttgaaaagaggagacatagggctgtaacgaagaagtttgtactggatttattcttttgtttccactctgcaagactgcagacgagtgggtgattacatacaaaaagacagactttagctaggtgtgggtaatatttttcaattaaaggtgtctgaaaatagaatggctgctttgtgaggcagtatgctcacaaaagctaacaaagcaaagcgaggttctgatgactggttctccttcatatttctagtatcactgaaaatatagtatgcataattcctaaagtgttagcaatgagttgccctcaacttctacccaagaaaatacatcaaaatgcacgtgactgagagacgttattcccaaaataaccttaagtccattctaattcgaaaaatattatgataaacagataacttgtaactgatttatcatcacatcactgcttttgtgagcatgttttaaagggggtctaggtactgggtggcactttgaagcagatgacctttgagggtctcttccaactttgcagcttatggaataaaagaacccaggctgcaaataaaagatatacttagtacatggtactttgagtgcttcctcaataaatttaattatacaacaaataaaatgtttcttgtgttgaaattgagtaacaggtggtatgtatttactataaccttttattttttttaaagatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagaggcaagttattagcctatgttttctgtatttattgaatttgtattatccgaagactattagactataattattttcagcttctttagaaattgtttctggatctgtgtgttttagggcacttgagtaatgtatttgaatatcttagctttctgtgttacttaactctcttgccagttttgactgtgagggtagaaagtggctttttaaaaaaggaaagaggattcatacgtgaatgtttaaatgtgtgtctgtgtatgtatccagaaatatgtatgtgtttttgtttgaatacatggttctttttatgtttagttatatgaggattgtttgagaagaggattcctccctgtcctccccacgtgtaatccaggcacatccacatgtgtgtcccagacagaaataacattgcactgggaatttgttgtaaaaatgaaaacctcctaacctcctagcattattttctttttttcttttttcttttttttttttctgagacagagtcttgctctgtcacccaggctggagtgcagtggcatgttcttggctcactgcaactttcgtctcccaggttcaagcaattcttctgcctcagcctccaaagtagctgggattacaggctcccgccaccacagccagctaattttttttgtatttttagtagagacggggtttcaccatgttggccaggctggtctcgaactcccaacctcgtgatccgcccaccttggcctcccaaagtcctggggttaaggcatgagccaccgcgtccggcctagcattgttttcttacggtttttttttttttttgtcacaatacataaatgcattctaattgtttagggggacaaaaagcatacaggaaattttaaggtgaaagccctccttcaccctcccccaaatcacatttctttccctagaagtctcaaagtcaaccatttggtgtttgttttttatatcaattctatctatctatctattctttctttctttctttctatctatctatctatctatctatctatctatctatctatctatctttatctgtgtatctgtttatatctatctaattagctagctatctggctgtctatccatccatccatccatccatccatccatccatccatccacacacaggttgaatatcccttattgaaaatgcttgagaccagaagtgtttcagattttggattttttgcagattttggaatatttgcatatacataaataatgaaatatcttgggcatggaacccaaagtctaaacataaaatttatttatgtttcctgtatactttataacagtgaaaaatatgatataccattagtgcagtaaaaaaaatactgtgttcagcgtgacttatggtatcatatcggcacttaaacactttcagattttaaagcatttcagatttcagatttttggattgggaatgctcagcctgtgcctcacacacatatacagcagcgtgggttccttttagtttaattatattttggtatttttgtttgtttgttttgagacaaggtctcactctgtcacccaggatagagtgcaggggcgcaatcatagctcactgcagcctcagactcctgggctctagcaagcctcctgcttcagcctcccaggtagctgagatcacaggcacacaccattatacctgactaatttttctttagtttatttgtagagacgggatcttgctatgttgtccagactggcctcaaactcctgggctcaaatagtcctcccacctcagcctcccaagtagctaggaatacaggcatgcaccactattcccagctaatttttgtatttagagttgggatgtcaccatgtttcccaggctgatctcaaactcctgtgttcaagagatcctcccacctcggccttccaaagtgctgggattacaggtgtgagccaccagcgcccagcctgattaattataattgtgatcttatttcaacacagtggctctgcaacaacacaaaatccggagataaaatctttctgttaggccaggtgcggtggctcatgcttgtaatcccagcactttggaaggccgaggtgggcagatcacttgaggtcaggagtttgagaccagcctggccaacatgatgaaagcctgtctctactaaaaatacaaaaattagtccggcatggtggtgtgcgcctataatcccgctactcaggaggctgaggaaggagaatcgcctgaacccaggaaggggaggttgcagtgagccgagattgcgccattgcactccagcctgggcgacaagagtaaagactctgtctcaaaaataaaaaataaagaaataaaaaaaatctttctgttgagcactgttacatagtgtggatgcgctagtattgctgttataaggtgatatcctatatagtgctgaagtccaatatcccgttcttagttctttattttttgcattccaggatgaaaacaattgtgtatataagagtaatcatgtttaatatataatatttgggcttgtcttttaatagtctgctaacttgtgcaaattagcacagttttaaatatgaaattctatgtagcaaaagtaactttgtgattggacaatctctcctagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtaagcttccaacgcgttttatctttaccagtcaaagagggtgttttattttatctatctatgtgtttattgaaatgaggtcttgctttgttgcccaggatggagtgcagtggctatgcacaggtgcagtcatagcacactatagccttgaactcctgggctcaagcgatcctctcacctcagcctccggagtagctgggactgtaggtaggcacagccacctcacccagtccttgtttttatttttaaatagtctaaaatgctgggtagaaccaatgaattaagttatctcaggagtagtgaacttttatcattgaaagtgtcagacgtttcaatctaccttactcttttttttttttttttttctttttttcaagacggggtctcactctgtcacctaggctggagtgcagtggcaccatcacggctcactgcagctttgacttcctgggctcaagtgatcctcccacctcagccttcccagtagctggacaggcctgcactatcatgttggctacttttttttttttttcctgtagaaatgaggtttcactgtgttgcccaggctggccttaaactcctgggctcaagtgattggcccagacctcagcctcccaaagtgctggtgttacaggcatgagccaatgcacctggccccttattgttcttgatggaaagttgggatcattttggactcctcttctcttatttcccacatctaatctgtcactgggaactgtcaagtctgcctctaaaactgtattaaatcagttacttctttatctctaccactatccttttacccccaggcctcctaactgggctccctgttgccaccccagtctgttctctgcctagtaaccaaggtgcagatattaccttcacacacctccactgttgcctttaggtgaggtgacatgaccaggagaccttacatgttctcaaacactctccttgctcataccgacccacagctcagcaagctccttcccatttcagggtcctcacatgtgctgctgtatcatctacctgggaagttcttcttggtccctttttacttacttagctttcaggtcatagcctaactgtcataatcaggagagaccatttaggtcctgtcatactttttcttcatgggcttatcattattgtgatcgtaccagtcttatgtgattcttgtttataatctctcccctacagaccctaagccccgtgaagatcagggaccatcattgtcttgttccctgctctatctttagcacctgacctagtgttataatgattattagaaatgtcataaaggattcctttcatgaaaaatgattgaactggatcagtggttttcaaccatttagagttactgccctcagaaaaccttatttctagctatgtaccttctccctagaatatatacacatgcaaacacaaactaatttcagggatctactttgactggaggttaaaggttcctaggttaggctgaatggtaattaagcctccttctaacactgtgattcagcgatcatgccctcagttcttgtaagtagaacttatgagtactagtgttgtctttcttaaatgtattacctgctcaataaatttgtctttcaagtcactgaaaataagatcagttgtaaaaattaacttgaaatacaaaaatgcgtttgttctccctaaattatttgtgtataatacttaaaatgtttaaactgctttagaacctaagtatataaatgaggggaaaagtatagattttgtttacaaagatttttatctgtgcaaagaaaacttaagggaaaccagaactttttcagcttataagatcaaaggacacttgatttatctgggtttgtttgtttttagagacaaagtcttggtccgttgcacaggctggagtgcagtggttggatcacagttcacagcagcctcaaactcctgcgctcaagtgaccctcccacctcagcctcccacatagctgggactacaggcatgtgccaccatgcctggctaatttttgtactttttgtagaggtgaggtctgttgcccaggttggtctcaaactcctgggatcaagcagtcatcccaccttgtaggatctacaggagtgagccaccgtgccctgccagtttcactgttttctgttggggttttttgttttatgtgttggtttggttttacagttccctaagtaaatcctgtgtcacagttcctgatgtatcctatttcctgtgtacttttcttctaactaataatgttatgttacccacttttaggcttttctttttccattaaccctgaattgtcagatagacaataagccccaatatgagcttactttgatgtgaaccttcaggaaacatccatctagctctagtcacatttcctctgtgttgtatcaatcctgctactactactttctttcttttttttttgttttgtaatcctgctacttctaaggaacttggaatgtaaaacactgtctgctttagtttctcaataacgtgttccctcctttctttacaggtactggaaaactgggcttctcttttgtgagaattacagctcttatggtgtcttgtaatcgtttgtgggtggggacaggaaatggtgtcattatctccatcccattgacagaaagtaagtatatttttagataactgccatggaacaaataggagaattataggaaatagttatgtctgaaattcaaatctgtgttagctcagaaaatcagtgatggcaaagatctagctatagttacttcactcaatgaaacttataaattctaggaaaataagttttcatgtatcaagaccaatactcataattaaaagtttttcgttgtcaaaacattttcacagttcaggaatcacagtcctatttcatcttttgaaataaaagttaaagtccatttttcttaagccttattataccattatccaaaaacactacctagcattcatcttagtttttcatatctccttagcagatagtttagtatattccatttgtcttatttgaggtttaaaaaaagttgtggaagaagtttctcaggagttcagcaagcctttccatctatcttctattttaaaagaatgtgatttattgtttttatgaataaaatatacctcgtgtgtttctcatatgatgttccattacattaatcatccattaagtaaatgtttttgtgttgcaaaattcatggcagggaatggtttaaaagcaaatactgtaagtctataaaatacattaatacatatacacttcaaaatcaccataccttttttcaggccagaggagggagaaagactagaaggtatttcggaagcctttaaaagaaagcaaggtttcaatcccacctgtcttttctgcagttacttataaatcatatttagacctctccttatatcctaagagattccaggatcccctagagttcatttcagttatttgtaagagcttcattttagcatagttattggaacaggatttgttttttaaaacacacacacacagagaaataaaggagaaattttagcatttaggaaatgctgcacattgagttcttagtgttttgattcagattcactaaaattgctttattatttaaaaaaaaaacaccataaatcagattttcctttttcagcagagattctaatagaagccttgggaagaactttatgtattacttggtattatgccaagtgggatcttgttattttcgttaggggctttgagcaccaggtttaccagatagaagacgctgagagtggtggctcacagtaattctctcctccctgtcatgcacctctccatgtcccctttcctcctttctcactttagccgtaatcctccaccagggacgtttactggggctgaggggtaagtgcagattctgaaccaaactcttcttcctggcttctaatagccactgtaaggctgttaccactcctctagaataccctcttgaatgttcctaaatgttatccacttgcagtcactgcatcgcagcaggtgtcttttttttttttttaatgtttgttacatggccaccaaactgctcagcagcttagtctatttatcatcttttgttgcagctgaactttctttcagactttgttttccttccagtataaacatgaaacatctcttaaagctgtcattaatttacatcgtttactcttgttaccgatcatatttctttcatttacttacttgcccatggaatggggatgttttgtgagtctggtcttttacagtacgcagcacaccatcagtctggtatcaataaaagctgctctattgtagtggctggattcttgtaagcacaactttttaccaaccccctcaagggaaatattcttactgtgagggagaaaaatcagaagataaactataaagaaagactttatttgcaaatatacccatttactttaaactgtataatggttagttttctaacatgtgcattaaaaacaaaacaagaaacaactaagattcaaatttgttttttttttaactaaaattattttttaaatgaatagatgtgtttaaaaaataagcttacttattgctagactggcaaaatcccctactccatttactgaggtacttaaaaataactagcatgctgtatctctttttttcccagctttgtcttgaattggcattgccatccttgttttatctcaactggctgtagcttttagataatatcataaggattaaccagtaacctcttacattcattactgttttctaggggaaaatatttggtatttggtttttctgttgcagcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtatgttagattattctgttgagatgttccatgtaattgtctctcttctgtcatctcttggttccactacctaatagtctaaggctaagtactcgaattgcaggtaatttcaatatatacgaaggaagttctgtaatggaggtgtgactaaggtgctatagggatacttgaatgaagttactttggaatatctctcccacccccaaagataaatttgttgatttttctttaggagacttgcttacttttgaaaagcagtagtattattttatcatcgtggattgccaaaaatggtcttgacctaataagagaaatcactagaaagaagcttctatcatcaaggctgcatggaggaagagagaatgcactctggtacctttagcagcttaataggaaaaagcagtgaactaggaggcctgggggtctggcccctgtgtctctgccactaacctcgagcaaggcacttaacctcagagactcatttcctcactcctaggtggatgtgattaatatctgctctgcctacttcatttgttatgaaaattaatgaaaatgctactgggagctataaagcaccacccagaaaaaagatggaagtgatgatgtccagtgaaaaatgacaaattatccattgacaatacttaagtgatgtcactgaccatctgtaagcaggacacaggttttgaatttttttttcccataagaggcaagtttaggagctagacgaagttcagatctgactttcccccaccaactaactgtgtgatgtagtatattagtcagggttcttcagagaaacagaaccaataggatgcatgtgtatgtgcgtatgaagagagagttactgttaagaaattgggtcacacagttgtggggactagcaggtctgaaatctgcagggcaggctggcaggctggagaccccgggaagagtggatgttgcagtccaaatctgaaagcagtctggaggcaacatttctctttcctctggatccctcagtctttttcttctaaggctttcaactggttaaatgaggcccacccacactgtggcgtgtaatctgctttactcaaagtctgttgttttaaatgttaatcacatctaaaaaagacttacaatgatatctagactggtgtttgaccaaatatctgggtatcgagctaacacgtcaaattactcatcatacttattttcccaagggtcttccaaagattaaatgattttatgtacatggggcaagggctggcatatggtaccctaagcaattattcagttattcttaacaacagtgataatgagctttctgaaacctcatttgtacattttatatatttgtatagtcatttccttcctagaaatgggattgctggtaacagtgtttctcttgcttaaaaaaaaatgaaatatcacagtttcctttaaatctcctttgtatccctctccaatcccattctcctctccttttcctctccattggtaaccactatcttgaagtcgatgcaaatcctcttgcccctgtttttgtatttttactatgtttgaatgtgtttataaacaatgtatgattgttttgtggttttggactttacatgttaaatgttgtgttttatatgtatgcttctacaacttgcttctcattttttgagatttatcaatgttcatacataaaaatctagtttattcatttaactggtattataactgaataaaagtgctacattttattcattcttctgttgatggacctctaggcttctcccctttcttttttcactattaaaaacaatactgaagcagaccttcttgtgtgcatgtgtaaggattttttgttgggtataaatctaaaagtggaattagcaacatggttgttgcgaggccagttggccctaaagattaaaccattctggttggccttatcagtaataccactgtgctcttgcttctgtggcagaactaactcgtctaccaacagaagtcattgctggcatgcttgatttcttccaaagtataattgagtaatgcatgaatgaatccctgtggggatacgtcagactatcctatccactttcaacatacattaattttgttacagtgtgtcgcattaatggctgtccagctagctcctggaggcgcagtctgtgtagtttgaccaaaggacagcagattctgacaaggaaaaaaatatcccacaattaaatcttgctaagagggttggcttagagattgctcatttgttcatagttgtgaataatatttaaaggtttctctctttctattatttcacactcaaggattctaccttagaacttaagctttagaacaaacagcacatttactagtaattttgtttgcataatctaaattaaaaataacctgtattttccttaaatatgagaggaaagccatagatttgaaataaatttaaatgttaattatgactatgcaaactcatagggcttaagttgaagacttttctcagtctcttacacaaataagcacattccttttcaagggagagaccttttccactgtcttctcagatcaaaagatttagactataatagtttgaagcaggtaggctgtgcatggtggctcacacctgtaattccacaacttggaaatcaaggcaggaggatcacttgagcccaggagtttgagaccagcctgggcaaacatagcaagacttcattaaaaatttttaagagaccaggcacagtgtctcatgcctgtaatcccagcactttgggaggcctaggtgggtggatcacttgaggtcaggagtttgagaccagcctgaccaacttggtgaaaccccatctctactaaaatacaaaaattagccgggcgttgtggcaggcacctgtaatcgcaactacttgggaggctgaggcaagagaattgtttgaaccccagaggcgaaggttgcagtgagccgagatcgcgccattgcactctaacctgggccacaagagcgaaactctgtctcaaaaataaataaataaagtaatttgggccaggtgcagtggctcatgcctgtattcccagcactttgggaggccgaggcaggcagatcatgaggtcaggagattgagaccatcctggctaacacggtgaaaccctgtctctactgaaaaagttagccgggcatggtggcacgtgcctgtagtcccagccactcaggaggctgaggcaggtaaatcgcttgaacccgggaggcggaggttgcagtgagccaagattgtgccactgcactccagcctgggcgacagagcaagactccatctcaaaaaaaaaaaaaaaaaaaaaaaaaaggtagtttgaagcaggcagctaagacccaccttgccatgcatatatctcatattggatttggggcctattcctgctttgttacaaaattgctttacttagattttcaaattgggttttgtttgtttgtttgtttgtttgtttgtttgttttttagaagcaaggtcttgctctgttgcctaggctggagtacagtggcgcatcacagctcactgcaacactgaactcctgggctcaagtgatctttctgcctcaacctcccaagaagccaggattacaggcgcataccaccattcccggctaacttttttggtagagatgaggccttactatatttgccaggctggtcccaatctcctggcctcaagtgattctcccacttcggcctctcgaaggtgtgagccaccatgcctgacctcaaatcgggttcttaaaaccttcatgtaaatgttttctgatcatgcagagccttctagcttccccagtatttggttattagaatatatttacctttttgtttaactctaaaaatacttaaaaaaaaaaaacaaaacagcctcccttctgtgataagtaatattcacttttgtttctgtataaaacaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtatgtcattggttctgggtgctcagtttgcactgtgtgctatgacttgggttttgtcccaaagtaaataagaaaccactctgataatgatttataagaggttctctttgagctctttacacacgaaaggattttgtgggtttttgttttttgtttttttctttttggtatttctttcttttttttttttttttgagatgacgtctcactctgtcacccaggctggagtgcagtggcatgatctcagctcactgcaatctctgcctccaggttcaagtgattctcctgcttcagccccccaggtagctagaattacagacatgcaccaccacatctggctagtttctgtattttcagtagagacaaggtttcaccatgttggccaggctattctcaaactcctgacctcaagtgatccgcctgcctcggccttccagctgggattacaagcccgagccaccgcacccggcccttggtatttcttttcataccaaaatgtatttgtttgaaaggagcattagaaatagcaggatgtggtcaatgtgaagttttatgtgaaaagcataggatttagggtcagaaggccttggacaagtcattcaacctcttagagcctcggttttctgtcaaaatggagaaataaaaatatttcttaaacaacttcatttgttcattttctcacctaacaaacattaattgagcacctactgtgtacctgtcattcttaaactggagatacagaaacaaatcagacaaagccttcgtctaatagattatagaacagtgcagagatagagacatgttaataaattaaaatgttactgatgctctggtagtgagtagtcagttctttccaagggtagggagagaaggaagtcaagaaatgatgcttgaggtgactcagcactgcatagtcttagcacaaagggtcaggttggggaatggggtggggaggaccaggggttggcactccgaggtaagagaatagcttggccaaaggtttagagatatgaaaccattttaatggaagaaaaactattttaaaatgacaagagtgtggagtagaagaaagtatgaatttgttgtcaaaagggagggagggactggagtatgggaggcctttacataccagattaagaagattgtactttatctttcaagcaaaagagaactataggagcaatgtgattagagttgtgtgaaggatggactggaggttcaagactagacctagggaaatgagttgggaacaagtgaatgcccaagaaaggtagtaacagtgtgaacagataagaagcatgatgagaatgtggggaaggagagaatgggccatagagctcaggactgtcaacaggagaagcaggtctggagggacggaaagaggagtccagtgctgatcatgttgatcttgaagagcatagtggtgatttaggtgggaaatttccactgggcttctgaatatacaggtcctctatcttaggagggagggatttgggggctgtcagcatggagtggtactaaaagccatgagggttggtgagttcgcccaaggagctaaaagaaaaggttccagtggctaaacccagtctctaataaaaatacaaaaattagctgagcgtgatgccgtgtacctgtaatcccagctattcaggaggctgaggcaggagaatcacttgaacccgggaggtggaggttgcagtgagccgagatcacaccactgcactccagcctgggtgacagagtgagactccatctcaaaaaaagaaaagaaagaaaaaggaaaggttccaggatagaaccctgaattcatactccatttaaagatcattagagcttatggagggatctgagaaggaatggccagagaggtacaaagaaaacatggagaactgatgctcgtgaaagagtagtgctttgtaaattgtaagacactgtacaaatatgtttatttatttgctataatttttcttttttgagacagagtctcacactctgtcacccaggctggagtgcagtggcacaatcttggctcactgcaacctccacctcccggtttcaagcaattctcatgcctcagcctcccgagtagctgggatttcaggcatgtgccaccacgcctggttaatttttgtatttttagtagagacggggtttcaccatgttggccaggctggtctcgaactcctggcctcaaacagtccacctgcctcagcctcccaaagtgctgggattacaggcatgaggcaccgcacccagcttatttgctataaataaactgatcccttggactcgcttaaaatctcagtgcttcaaaaagttcccagacataaggcagtaggcagtttgagagaatataatagtgttgtagatcagtaacaaatactttagatatgaattctgtaaaggaataaaaaaaaattagggtcatttaaatgacaatgtgacaaatgtgattagtgtcaccaatatctgatgcaaaaagtttgttgacacttttaagaggggaaggctgttagtgtgaactttagaaattgattccagggatgtcagcaggaatggagtcatttcaaagtgttttgaataattgactattgttgaattcccttttatgagaggagttgttagggactccacttggctggggtgatttttgtaactttgtgttggagtgcagtatgtcagttggaaccgtactgaggagtttgttaataaaatctctatgtggtttttccatttccactaaaaattccttccattgtggatcctgaaaatagaacaaaaattgcttaaccaggtttggcagtatctctagttatttccagcctgaaaaacagacttgtctttagcataggctaattttaatagtgaatatactgttgtaaaaaatcaaatttgatcttttttgggggtccatttcctttttcatttcctgtaatattttaacagtgagaaattgattctaaagtcccatatttttaatgatttaaacttaaaacttaggctgtagagaccctagcagacaggataattttcttacaagtaaaatcttcagaacaactcagaagagaaatggcgacagccttttgtctcagccagttaatttttttcattgaaattttttaaaatttaagagccaaacttaatttttttaccttctaaccacctgggtatgtttcagttcagagatgggagtttgaactgagtgttctcctctctctagtttgatattgctgtgaaaaggccattacagggctgggtaagggaaagtttggcctgcagagaaaaatgcagatatttagggttttttctcttctgttgtttctagtcaacagtatcaatattttcttttgtccagctgaaattcacatggggcacattacaaaattctgttagatcagtggaatatatctttaggtcctgtggtgtgtatgtttttaggattctgctgaagaatccatcccactagacaacttttcactgggttgtgccaaaataaccctgctctgtgacaacagatacaattgatgcaagcttgtatcgagaattatggtatgccctgcactgggtcttatggagaggagtgtggtgtaccccagactgggccttggaagccagtgtctgatcaggacaccatggatcacattcacttagccgtgatgcagaagaacctgtatcttggctgctaccccaacctctttgtttctccttttccattatacactgttaatttgtaacctatcctaaacttgaaaatcattggaagaaaaacccagtagctggtgaatctgccatctgcagtgctgcaggctaattattttaatttccatatgcttgtgtcaattatcttcaattggagaacattacacctgtcattgataattgtgagttatttgggtttagttagtttgctctgtacctgtgctcacgcattttataacactattctcagttcttagtttaaaataagtgacagtagactcttcattttggatgaacacagaattgccttcttagcttcccatgtctggaccatcggtatgcagacatgttggggtggctttttaacgtagtatagtgaactggattttataaatacagtctgaaaaatgaattaaccttttctgaagtcaagcagtggcttgggtgaatatgggtgaggattctgactcttagtatttcttctactatttactctccagtgaaagtcagacaagttttgggcatcttgttcatggactaaccacgagcattacatctgactcacatcattctatattttatgtgttcagcctaacttgagtcttcttatcattcactaggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccaacactttaggaggctgaggcagatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcaccacattggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttga

SEQ ID NO: 37714 - DNA, 35466 bp, Homo sapiens
actctgccccacagccacagcccctgactgccgcagcccccacagagcccgccgcgcaccccacgtcccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtgaggtgccctccgctgggccgctccgggctgctgggagtcctctctgtgcggaaggccggggtctggagcccagttgggggtcgcagacacctgcgggaggataggaggctgatgctttggcggaggaagagcgaggggaccattgccttccttggatggggtcctgggctggaagaggggtgacgatcggacccacccccagcagggccagtgcgaacaaagtgagtttgacagagagagagttggcgggggagggagagtgagaacgttcgtgagcgaggtgtcgtttgcgctgggaggttgtgtactagatagggcggttggggacatgctgtgtgtgtgtatttgcgtgtgtttgagcgtatgtgtgtgtacgtgtgtgtgtacgtgtgtgcgtgtttgcctctggtgtgtgtgtgcatgtgtgcgtgtgtgtgtgtgtgtgtgtgtgtttgagacagagtctcgctctgtggcccaggctggagtgcagtggcccaatctcggatcactgcaacctccgcctcctgcgttcaggcgattctcctgcctcagcctccgagtagctgggattacaggcacccaccatcacacccggctaattttgtatttttagtagagaccggatttcgccatgttggccggactggtctcaaactcctgacctcaagtgatccgcccgcgtctgcctcccaaagtgctgggattacaggcatgagccactgcgcccggccatttgtgtgtgtttgagcaattctctgtgtgtgtgcgtgagcatttctgtgtgtgtctgtgtgtgtatctgcatgtttgagcatttgtgtctgtgtgtacatgtattgtgtatgtttgagcgtgtgtctgtgtgtatctatgtgtttaagcatttctgcacatgtctgtgtgtgtacacatatttgtgtgtttgagcaattctctgtgcgtgtatctgtatgtgtttaagcatttctgcgtgtgtgtgtacacatatttgtgtgtgtgagagcagttctgtgtgtgtgtgagtgtatctgtgtgtgtttgagcctttctgtgtgtgcacatgtgttgtatgtgtctgttttacgtgtctatctgtacatgcacatatgtttcagctgaaaagagtgcggaggggtaaaggtgactgtgagaatgagtgtgtactaggagagctgtgtgtgggacgctgcgtgcggctgttggaaagtaggtgtgaaagagtgtgggtgtgtttgtgagcctgtgtgtagatggtgggggtctgtgagggtagcgggacaggctgactgtgtgtgtgcttgagcaaacgctggtatgacagtgattgaaagtacatgttgatgtggctatgtttgtgttggcatctgtgtatcagggtgatgggtttctgatggcgtgtgtgtgtgcacccacgcacatgtttggatgtgtgtttctgttgtgtgtattggtgactgtgcttctgttggggtgtgtgtgcatgtttagatgagtgtgtgtttctgttggtgtgtttatgtgtatgagtgtgtttctgttggtgtgtgtgaatgtgtatggatgagtgtgtgtttctgatggggtgtgtgtatggttgtgtgtttctattggtgtgtatgtgtgtggatgagtgtgtgtttctattggtgtgtgtgtatgagtgtgtgtttctgttggtgtgtatgtgtgtgaatgagtgtgtgtttctattggtgtgtgaatgtgtatggatgagtgtgtgtttctgatggggtgtgtgtatgattgtgtgtttctattggtgtgtatgtgtgttgtgtgtggatgagtgtgtgtttctattggtgtgtgtgtttctattggtgtgtgtggatgaatgtgtgtttctgttgctgtgtgtgtgtgggtgagtgtgtgtttctgttggtgtgtgtgtggatgagtgtgtgtttctgttggggtgtgtgtgtggataagtgtgtgtttttatggggttgcgtgtatgagtgtgtttctattggggggtgtgtgcatgtgtggatgagtgtgtgtttcgattggtgtgtgtgtgaatgagtgtgtgtttctgtcggggtgagtgtgtgtgtcagtgactgtttctgctggcgtgtgcatatggatgtgaggggggctgtgcgaacctgtgtgtgcgtgtaggtgacactatgcccctggatcaggaagcctccactgtgacagaagcccgctgtctcatgggcacctgcccaggagaatggcacggcatgtgtgtgtgtgtgtgtggtgggggcccagggctgtgacctgctgcaggggtgactgggtggggtctggggactgggatgggagtagagttgagagtgagtctgagaatctcattgtgtatgtgggggtgtccctgctaaaagcctggaggccggggcaggtgggctgcccgtggtggacggaggagagggaggccatttcccatctcctggcagccaagagcccacacagacccagaactttggagacaagagtcctgggaaccctggcaatgagaatgcattggagttccaaggccgtggccatggtttggggcagagcagacaggagcagtgggtgggaggaaggaagggagtcccctcccacagagccatgttccccacaatgtttatccacaccccgatgtcaactgccaagccctggggagcatccaggtctccgataaaccctgggagatgcctaggaccatggcaccgagtgcccagccccacccaggccaggagccaggccagcccggcagctaaaggcgaaagctcggagctcagactggccatgtttgagtcatggctcagtcgctaggtgtcccggacgcctgcatgagtgagatacggaagtgacagtagggcctcccttgccaccccatgacaggattagaggtgactgtacaggtggaacccttggcccggagcctagctcagagtaagcactcaataaatgtaggttgatttcctgccccgccctacttcccctttgggcctccccagccccccgtgccccagggctgccctaagagtatgtggcacattcgtgcaggccaagccccaccccagtgttccctgccacaagctctctccgccttctctgtgcccctccctggcaaacacagacattcatcctgtgctgggccagcttctagccatcatttagccctcaccatgagggacttagccagagattcggagagaaacaagtttatagcactaattcttactaaggtgtgagtggctatctcccaggacagccacaagttcaaaaaggaagaatcctcaaagcctccagccagctgcgtggccaaggaggttatgccttttttgtcccacaaagatgcccactggagtagacttgggctcaaagcaagtctacacagactagctttcaggcaaacctccatagactagcacatactttgtgtatatcagtctttaaatgtatttttattttttagagatgggggtctcactctgttgcccaggctggagtgcagtggtgcaatcacagcttactgcagcctcaaactcctagggctcaagcgatcctcccacctcagcctccccagtggaggtgcacacctccacgcccagctagttattttatttttagtagagacagggtctcactattgcccaggctagtcttgaactcctgggctcaagtgatccttccacctcaacctcccaaagtgctgggatcacagacttgagccacggagcctggtctttgtgactctcctagcttcatgactgaggacacgttcctgcacatttctgagccctcagtgtcctcatctgtgaaatgggaacacgtgaggccttctgaagttcaggtgtggaactcaagatcccagaattccgaagcagaagccagcgccccacaggagctaacggccagtcctgctggggaatagaggcacttagagcgcctgacgctgcaggaggccagagagagcagctctcgggccagcctgatcccagcagccaagcactgatttctggccctgcttacccagtgtgggaaaaggacaaagaggcccagcccggccgcttcctgcccactcccctcccagggcagcaacatcctccaccactggcctttgaccccacatcctgcctcagccctgccccaaggccccatttgcagggactaaggtaatcctatgacagatagggaaactgaggctcacagagggacaatgacgggcacgcgccaccaggcccggctaatttttgtatttttagtaaagacggggtttcaccatgttggtctggctggtctcaaactcctgacctcgtgatccgcccgcctcggcctcccgtagtgctggaattacaggcgtgagccactgcgcccagctctcatttattttttatcctcactgcctaccactgaagggtttggggttgtgtcttcgattcatcccaaacacttcctacagtgttctaatgctggggcccatagtggcctcagtcccagaactgaccctcaagaaactccaagctgagggagacagaccatgaatacctccagctcagaggtcagggccggaccagagggagggacagaggctgggacagctgtaggcgtggcgaaagctctgctcagggcagcagagcaggccaccagggttggggagccttgggactgagcatggagggacggtagatgccctcccagtgaaaagtagaaagtcattcttagcagtgggtccagcatggtctagaagtcaagcaaaccagctttggaatcagactaacaaagattcaaatcccccatctgtgtggcatcaggcaagtcccttcccctttcagagactcagtttgcccttctgtagtatggggcttccctgagacaatatttgtaacacgccctggccaggcatagtggctcacacctgtaatcccagcacttcaggaggctgaggtgggggatcacctgaggtcaggagttcgagaccagcctggcaaaaccctgtctctacaaaaaatacaaaaattaactgggcttggtggcatgagcctgtaatcccagctactagggaggttgaggcaggagaagcacttgagccagggaggtggaagttgcagtgagctgagatccagccactacactccagcctaggcaacagagcaagactctgtctcaaaaaatatatcaaaacaaattgtaacacgcccaacacattctaaatgccagatagccccctgtcggccttatccctgtcctcacatgttcttgcccaaacatttcccccaaaaaagtagtcaaaaccccaaaccaaacaaaaaaaccccaaaccagccaggtggggtggctcatgcctgttgtcccagctactcgggaggctgaagtgggaggatcccttgagcccaggagttcgagaccagcctggataacacagcgagatcctatctcaaaaaaacaaaaacaaaaacaaaacaaaacacccaaaccatcttcataccctgatgagtccatgctgtcagatttgctctcactcttcctacatgttaggagagtcctgtgttgggcacacagttggcacccaataaatgctgtgatccacagatctggaaggaagtcaggtggatgctgtaggtcagggttgacctatgaaacgtctttaaggaaactggctcattttctcagtcaaggcagaagttcaaaagcagctgccggaatgctcagagaccagcatgtcaaggtttctgttctgcagatggagaatctgaggccagaaaaggggacgggggtcgcagagcttggatttggagtcaggcttccaggctccccacccggaggtcaaggtcaggccctatagactctgaccctgccctgatcagctggccaccctggattgggccctgtcatctccccatagcttgggatgctcctgaggacttcagacaggatagccctccctgctctctgtcacatctcagctagagacccttgcaggtcacctcagtgacatcagctgaacctccagctgccagcctccaccccatcctccagctgacacccagcaggccgcaagatgggaagcctggagttcacactttccagctactcaggaggctgaggcgggaggatcgcttgagccgaggaggtcaaggctgcagtaagctatgatcacaccactgcactccagcctgggagacacaggaagaccatgtaaaaaaaaaaaaaaaaaaaaaacgcaaaaaaaaaaaataatgcacacacacacacagcaagatcaggttaaaaaaaaaaaaggcaaaaaaaaaacatacacacacacacacatatggggcacctggtacattttgcacatccactcaggggtgagcacgtagcccagacaggattcagagctcagtctagaagccacgggcacagcagcttttttaacataccctcttcaagaaaaaaaagaagagaagcaagtcagagagggaggaagggaagctggcctagtgtgaggaacagggccaagggctttgtctttgtcagctcaggcagttataacaaaacaccatagactgggtagcttcagtaatagacatttattgtttacagtctggaggctagatgtccaagatcaagatgctggcagattaaatgtctggtgagcgctctctagctagcttgcagacagccaccttcttgctgtgtcctcacattggaagaggataaccaagttctggcctcttctcataagggccttaatcccatcatggtgggtcaaccctcatgacctcacccaaacctcatcatcttccaaaggccccatcaccaattaccatcacatggagatgagggcttcaacacatgaattggagagggggcaaaagcaagcattcagttcattataggcttatattccagaagacctgggctcaaaccctgtgctgtgtgacctggggaaagtcatcccacctctctgagcctcctgctgtggggaggaagcaggagaatgaagctgggctcagtgggggctgtctgcccaccctgggagcaggaacaagatcagtgtcaaaccatctaaggcaaaagtcagatccaagccaggtgtggcgactcacgcctgcaatcccagcaatttgggaggccgaggcgggcagatcacttgaggtcaggagtttgagacctgcctggccaatattgcaaaaccctgtctctactgaaaatacaaaaattagtcagtcgtggtggtgtgcacctgtagtaccagctaccggggaggttgaggcaggagaatcacttgaacccaggaggcggaggttgcagtgagctgagatcgtgccactgcactccagccttggtgacagagcgagactctcaaaaaaaaaagtcagatccaggcatgagctggatatgatcaccctaatccagagttgggggcccagggagggagtttcagcctggaggtgacagaaaagtcttcttgagccaactctagaccggtgtggtggggggtgacaaagagaggtgatggggtctgtggtttgtaatccataggcctgagcttctcaaactaggagtgatgggaggataggactcttgggataaacagaggactgaaaatttagggaaagtaggggacatttttattaaaatgaacatggcctatatgcaaaaattttaaagatttaacccgagccttcaaagaaagtgatcctgtaggggcgagtctcttctagccaagctccccaaagcccagaaatgagggactaggtctgagcccttcagcccttcagagtattttggtaagacagtctaagaaccactgccttgggccatagggagccatagcaggttctaggcagaaagagggcaggcgtatttgttagaaagtttctctgaccccgtgttggggtcagaaccagagggagaaaggctggggacagggatgggcggagggatccacgcgcagagaatgagattgcttaactccagatcatggtgaggctgcacctctgaaactggaatgtgtgtatttctggaaaacatttggagtcttcagtttcccaaaagctgccattgatctccctagagtactggggaccccaataagcccaaaacagctggtcctcaggacgagggaaagatgtgaaaatcccactatcaggtagcatggatggcgtggtgcatgctatcgcaacccctgttctacagataaggaaactgatgcccagagagagacggaggactcttgtgaatattgggggggaccgcccctgcacctcggggacgtgaccccccccccaggctgacccgttcctcgctctgtcgtccccaggtggaggaggagctgacgcacctccagaagaaactaaaagggacagaggacgagctggataaatattccgaggacctgaaggacgcgcaggagaagctggagctcacggagaagaaggcctccgacgtacgtgtgcagggatgcgggagcccgcggcggggccaggccggagccccggggccgggaaggcggggagagccgcagggggaggaggaagaggaggaggagaaggcggcgcctcccagcgctttctccaaataagtcccgaaaaggggcactttccagcagctgtggccagcggtgccgacgtcaggccctcccccagcggtgctgacgtcggcggtccggccgggtgacctcatcgccccgacggcagccggcccggggggcggggagaggcgggggcggcccccgcgcaggcaaaggcttggggggccggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagtgagcgccccggcctcgggccccgcacccgcagcctcctcccccgcgcgccctcctttcttcccggcttcccgcgctgcccgcccgcgcgcagtcctcgggccgcctttttacgccctcggacgccgatcgccgacccacatccctgcgcccgcagccaggaccccctacttcctccgccgtcctccttcctgggcctgggacaggggagggggcgccgcctccgggtcgggcggggccggccaagcgggaaatggggggatggggcggagggggtgagcgatctccgggtggagaagtggagcggcgggagggggcgtatcgtgcaggctccgactccggggctggcgccggggtcccgggccgaggggaacccgcgaccggacttgtgggggagaatgaggatgaaaacgtggagcttccattgtctagggtttgaccggccgacagggatttcgacgggggaccggggatctggggagggggtcgcactttctcgcctctttcgcggcttcccggcttctgcttgcttccctgaccgttcccaggggcgcggcggcgacgtgtctgctccaggcggcgggggggatggggggtggaggaagttcagccccaagccgcccgcctttctccagctgattcctgcgggaaccggggcggcgggaccctgcctctctccagaaggccccgggaacgctggcgcggggccctgaacccacgatcgtttgagcgcctgctgtgcgcctccgccgcgagtcgcagggcccgagataaacaatgggtctgaaaaaggagggagtttcaccatcctctctgcatcatcctcctggctgtccctcgggacagatggtggcaccgccagggtctggggacagatttggattctggtcccatatcatgccacccacaggcttcatgacttggtatttgctctctaggagcttttttcccatctgcgagtaggactgataagaatcccgaccccccagagtagcagggagggtcccaggagtaaatctcaggcgtggagcctggcgctttgtaaataatcaattgtgttgttgttttttgttgttttgtttttgaggcagtctcactctgtcgcccaggctggagtgcagtggtgcgatctcggctcgctgcaacctccaccccccgagttcaagagattctcctgcttcagcctcccgagtagctgggattacaggtgcccgccaccacgcccagctaatttttttttttttattttggatttttagtagagacagtgtctcaccatgctggccaggctggtctcgaactcctgacctcgtgatctgcccaccttggcctcccaaagttctgggattacaagcgtgagccacggcgcccagcctcaattgtgttttctctgccctgggaagagctcatagacaaatggaggcaggggagctgactcactgatggagcgaggtctgcattccacgggttttctgtgcagttatgggagcatgacaggggaggctccaaaatggaggttgagctgggtcttatagaataaataagtttgctgggaccagagacatgggtgtgcacagactcagaggcaagaaagttgtatgatgagggtgggggggtgtgcggatagaggttgaagcccaaaagccctgaaagttcagtgttgaggctcagggtggggaccctagagaggcaaaagatgcccagccagatggaattggtggtgtgaattgccaggactggaaagagcccagatgggggctgcagcatgggccttggttgaagcctctaatcctgtaagggctgctttggcccaagaggccttagaaacccggtgtaagcctcaatcggtagccggtctggcctctttctcacacttaaccgacacagctcttgctctgatctcatcccaagtcatctcgctggaggacaattaactcggcttcaaaatggccctcagcctggagccaagatttaggagcaagaccgtctagttgggagagaagatgtttttggagagttgaagacttcttgaaaaagttcgaaaagttcttgaaaaagcaaaggatgcttctttccgtctgggagagggaaaacctctcccagggcaaaaggaactaagaccaggggtgggttaaaaaaaaaaaaaaaaaaacctttcactcttgtagaataagccaggagccggcgtgtggtagacttctgggcctgtttcccgacagctggtttcgtttagatttttgtgtgattaactgacatcttcctgttcctttgccacatgtatctagcaagcctcttttaccttataagggaaatcctttgtagcgtgtggaaggctttgattgcaggaaggggtggaacccaaaatgactcggccgtgactagcagtttttcaaaaatacatatatatgtatgcatgtacagatatgcgtgtatctcccaactccagacagctgaaaatctgccaaaagcgttgtttgccaggattcagaatttcccacataagggctactcacttcttaaaagacaactcatgaatcaagcacctctgtttgatctttaaaatcaattcctcgactgctaatgggtacacagttttttgtttgtttgtttgtctttggcgggttatgaaaatgtcctggaattcgataatggtgttggttgcagagtgtttttgcaacatcagttcctggcccagttactgaaggtggtaggaggagttaagatctaggcaattaaaaagaatgaaaggcacccattcatgggaaggcctcagtgacgtttcttaagacagtttcatcagtggttttcacaattctctgcatttggtgtttcagaggacactgcaatacgaaacacctgtgggagtgccctctttctgcttctaggaatctgaggctgagaaaccttcctgactctatttgtgtagtttttcggccacgttagcctcattctatttttttttcccccagtatgaactcagggcaggagagggagtggtttcctaataattttttttttttgagacggaatcttgctctgttacccaggctggagtgcagtggcgcgatctcggctcattgcaaccttcacctcccgggttcaagcgattctcctgcctcagcctcccaagtagctgggattacaggcgcctgcccccacacccaactgatttttttgtatttttagtagagatgcggtttcaccatgttggccaggctggtctcgaactcctgacctcatgtgatccacccacctccgcctcccaaagtgttaggattacggatgtgagccaccgcgcccggccttcctaataattttgatagccttccccagttcagggattcttcatttgttctgataggaaaaagctagcgtggcttcccttttcctctcggttgaggcccgtttgacccgttctcaatattccttccaaagagcaggcatcgctggaaaactcgccttgcctcgtagccctggcaggacctaggggacaggttctgacaaggaagagccctgggtgggtcttaagaggccattcatttcttaccaattctgagtcactgaataaaaccacttcccccagtggggcccctcggtttcttcacctgtaaaatgggtgcgatgtgtgaggatgaaattgcagtaaaataaaaccgtggcagtaagagatgcctttctctggcacatcccacctgctgggcataagcggcgccaccctctggagttacagcctcaaggcagtccggtaactaatcaggctttgggatggagagggccaggatgaggaagcaaccttcccaacaccacgtggctgtgaaaatgacaaagcacggtcgggcgcagtggctcacgcctgtaatcccagtactttgggagaccaaggcgggtggatcacgtgaggccaggagtttgagaccagcctgaccaacaagacgaaaccctgtctctactaaaaatacaaaaaaatagcaaggcgtggtggtgtccgtctgtaatcccagctactcaggaggctgaggcagaattgcttgaacccgggaggtagaagttgcagcaagccgagatcatgccattgcactccagccttggtgacggcgcaagactccatctcaaaaaaaaaattaaaaagaaaatgacaaagcggggattccagcccagcactttttggccctggagttcctggtttaatgcttcccattgtacttcctttcttgtaggtaaaaacaccttgaaaagccaataacactattggggtatgtcttccatgcctgcaaccaagttttctttccctttccatatctttttgtcctgccatctctcagccaggcggattgaaggatggaattccaacgaggctcccccgcctcgtcccaccttggtaattgcatggccaacatttaactgagggctccatagtcttgcatttatcttgccattcaggtgaatgggagcggaactcacaggacacaatgagccgggtcactgatggccttgctttctaagaatctcacagtgagccctagaactctctacgtggtaacactgtgtgcctttttcagagaagagcctatcttagatcttagcctaacgttgggtctattgtgttgctggagagaccagcactgacattcatctcaaagcacatggtatgtttgactcctatgttgactcaactacccatcttgtactgggacactcgctttttttttttttttttgagacggagtcttgctctgtcaccaggctggagtgcagtggcacgatctcagctcacggcaacctccgcctcccgggttcaagtgattcttctgcctcagcctcctgagcatgtggaactacaggcacgtgccaccacactcagctaatttttctatttttagtagagacagggtttcaccacgttggccaggatggtctcgatctcttgaccttgtgatacacccacctcagcctcccaaagtgctgggattacaggcatgagccaccacgcttggcgatgctcatcttttgctatggagtggtagatgtttttcccagacattttccgggaagatcatactgaaattttggtatgagtgtaaattccctatggcctggactcctgggtgggctttgacggggaagatcaggttaacagagggcaggacatgggggaggctcccactggtggctggcctgatacttcttaacatggctgcacctccgacctccccaggctgaaggtgatgtggccgccctcaaccgacgcatccagctcgttgaggaggagttggacagggctcaggaacgactggccacggccctgcagaagctggaggaggcagaaaaagctgcagatgagagtgagaggtaaggacgctttgaatctggtggcatccgtgtttgcttttagaaaatggggatcatgctgccgacctcgcagagctggtgtgaaagtaaacaaggtcacaaggacatgcatgtgtccacaaaaaagtgcatgacagcactttgtaaaccatcactccatgggtagagatgtttatccgtggccaggcacggtggctcatgcctgtaatcccagcactttgggaggccaaggcggacggatcacctgaggttgggagtttgagaccagcctggccaacatggtgaaaccccgtctttcctaaaagtacaaaaaaattagcctgccatggtggcgggcacctgtaatcccagctactcaggaggctgaggcaagagaatctcttgaacccaggaggcagaggctgcagtgagccgagatcgtgccattgcactccagcctgggcaacaagagcaaaactccatctcaaaataaagtgaggggtgtttatccttacggtaaccatgaaaagaaacttccgacagacagaaaggcaaacagaacgggcagatgtgagactgcaagtatgactgtccatggtggtcagtttgcaaagcactgcttctcgtattttctctgaaagccacagtgcctcttagtgttctctagacaccaaatttcaggtaggccggatgcagtgattcctgcctgtgctcccagcactttgggaggcagaggcgggcaaatcgcctgagctcaggagttcaagaccaactggggcaatgtggtgagaccctgtctctacaaaaaatacaaaaattagccgggtgtggtggtgcacgcctgtactcctggctactcaagaggctgaggtgggaggatcacttgaccccaagagtttgaagctgcagtgaggcaagattgtgccactgcactccagcctcagtgacagatgagattctgtctcaaaaaaaaaaaaaaaaaaaaaaaagcagagtactgtggagaggaggaaaggaaacttgggatgcacaggtgattgttagcagagctgtcaggctttaggcttttggacggtgacagctatttcagggacagttgcaaaccagcatggttaatgtacttgcaactgaccatgcaccaggtgccgtggctcacgcctataatcccagcactttgcgatgacgaggcgggtggatcaactgaggtcaggtgtttgagaccagactggccaacatggtgaaaccccgtctctattaaaaatacacaaattagctgggcgtggtggcgggcacctgtaatcccacctactcaggaggctaaggcaagatcccccagcttgaacccaggaggcagagggtgcagtgagccaagatcgcaccactgcactccagcctgggcaacagagtgagactctgtctcaaaaagaaactgaccacgttcctcacccgcccatggtatctgtgctgcaacccagccaccagtagggtgccttctcctcggtagccagatcattctctggcacgccttggcacaggctctctggaagactgagggtagattgtgtaattcacagaagcagcagtctgtgtgtggtggaaaaggagttccttgtgtggcaatggtgtgggcccgaccagtgatcatcgcgtctgcccctcattcacaccggagttctcacttgagccagccaccatgcttttgcagtataaacacctcccaaagattcatttctttttttttttttttttttgagacagggtcttactctatcacccaggctggaatgtagtggtgcgatcacagctcactgcagcctcgacctcctgggctcaagcgatcctcccgccacggcctccagagttccagagtaaagctgggactacaggcgcatgccatcatgcccagctaatttttttttgagacagagtctcgctctgtcgcccaggctggagtgcactggcgtgatctcagctcactacaagcttcacctcctgggttcacgacattctcctgcctcagcctcccaagtagctgggactacaggcacccgccaccacacccggctaatttttttgtatttttagtagagacagggtttcaccgtgttagccacgatgttctcaagctcctgaccttgtaatccacctgccttggcctcccaaagtgctggcacgcctagctaatttaagatgcatttctggttgtgctgctgtgaccactaaccagagattagaaaccagctaaggaatcttggagattgcatgtcacccaagctggaaatttcttcccaagtagtggaacagccagggcagagggaacagacgctactgcagactctgcttcagccactgaatcaagggagagagtggcagctccggcagccacggggcagtggaaggacccagtcacgagagttcctggctgtgcctgtggcctgggttagctgctgttcacagtcagaccagcctggctggatgctgacgttgagggctcccatattggcaaaccaagggaggctgcgaaggccagtctcttgtttgcaccatgtccccagaggcctttggtgacacccctgttaaagactgctgtgtctcagtagaaagaattatatacttgaagcttggggatctagagtcagcttctaccactggcactttctatggagccttaggcaagtcactttgatctcttgggtactacaaggggttttggggcaataaataacccagagagcttgctcacatgctgagggtgagacctcgtacaggtgggggagggtgttttgagacttagctgagaacgggtgacaccccacgtgaacatatttattggacagcaagaagcatatggtctctgtgctgggtgggaatgatacatatcaatgacacattatcccaggctggcctcttcttttcttttcttttcttgttttaaatacacaaggtcttggcagggtgcggtggctcacacctgtaatcccagccctttgggaggcgggcggatcgcttgagcccaggagtttgagaccagcctgcgcaacatagtgagaccccatctctacaaaaaaatattaaaaattagccaggcatggtagtgcatgctggtagtcccagccactcaagggactgaggtgggagaatcacctgatcccaggaaggcaaggttgcagtgagctatgattacaccactacactccagcctgggcaacagagtgagaacctgtctcaagaaaaaaaataaataaatacacaacgtcttgctctgtcacccaggctggagagcagtggtgcaatcacgactcaccgcagccttgaactcctgggctcaagcgatcctcctacctcagcaacattgcaaaacccccacctccacaaaaaatttttttttagtttagctgggtgcagtggtgcacacctatagtcccagctactcaggaggccgaggcaacaggattgcttgagcctgagaggacaaggctgccgtgagctctcagggcaccactgcactccaacctgggcaacagagtgagacaccatctctcaaaataaaagaaaaagaaagggggcacagactctggagtcagactgccaagggctgagcctcagctctaccacttaccagctctgtaaccttaagttacttaccctctctctatgccttagtttcttcatttgtaaaatgtggataatttacctgctccatagggcagttgtgaaagtgaaggcacttagaaaagtgcctggtagtaaagatgaagggaggctgggcgcggtggctcacacctgtaatcccagcactctgggaggtcaaggcgggcagatcacttgaggtcaggagttccagaccagcctggccaacatggcgaaaccccctctctactaaaaatataaaagttagccggtcacggtggtgcatgcctatagtcccggctatgctggaggctgagacaggagaattgcttgaacccaggagatggaggctgcagtgagctgagatcacactactgcactccagcctgggtgacagagcgagactccatctcaaaaaaaaaaaaaaaaaccaagatgaaggaaatgtgtgcacagagttccatctttgcagtgtgttacagtgctcagtagattcagagactcatttagatgagagatgggactaggggtggtgtctcacgcaattagccagacatggtgacgggtgcctgtaattccagctactcaggaggctgaggcaggagaatcgcttgaacccgggaggtggaggttgcagtgagctgagatcgtgccactgcactccagcctggatgacagagcgagactccatctgaaagaaaagatagatgagaggtgggtggaggggtgtgagtgaacggccgtcctgatgagattgctccttgcagaggaatgaaggtgatagaaaaccgggccatgaaggatgaggagaagatggagattcaggagatgcagctcaaagaggccaagcacattgcggaagaggctgaccgcaaatacgaggaggtgagtggggctggcagatggcgcagcagcaggaagtgggaggaaatgcatctgctgagatagggaggacaccggggccaacgaaaggaagctctcggttaggtcagctgtcctcctgcgtgaacatatgtttgtccagagacaaccacttggctaggaaactatctcccacgatgccagaaagtgctgcggacgcttgtctaacgtaatgggaaaaccgaatgatcagctcacttgtgtcgttagctgggagttttggcacagttgggcaaaaatggaggattgtggtcccaagccatggagtttcagaccatgcaagctcaggccctcctttgcctccctcgatggctcggctcttccctcccgcctcttgtctgcctcgctcctcaggcttgaggaagagaatcaggatttcctccaggccccaggatggctctttcagttgaagcgccagcaaaaggccaggcgcggtggctcgtacctgtaaccccagcacttcgaccgaggcgggaggatcacctgaggccaggagtttgagaccagcctgggcaacatagtgagaccccatttctaaaaataataataataataattagctgggtgtggtggcatgcacctgtagtcccagctacttgggaggctgaggcaggaggatcgcttgaacctgggaagtcaaggctgcagtgagctctgaccacgccactgcactccagccttggagacagagcaagaccctctgtcaaaaacataaaagggctgggcatggtggctcacgccggtaatcccagcactttgggaggccaaggcaggcagatcacctgaggtcaggagttcatgaccagcctggccaacgtggtgaaaccctgtctctacaaaaaatacaaaaattagccgggcatggtcgtgcatgcctgtaagcccagctatttggaaggctgagacaggagattcacttgaacccaggaggcagaggttgcagtgagtcaaggttgagccactgcatttcagcctgggtgatggagcgagactctgtctcaaaagaataaaaaaataaaaaagaggccaggtgtggtggctcatgcctataatcccagcactctgggaggccgaggtaggtggatcaggaggtcaggaattcgagaccagcctggccactacggtgaaaccccatctcgactgaaaatacaaaaattagctgggcgtggtggcacgcgcctgtagtcccagctacttggaaggctgaggcaggagaatcgcttgaacccaggaggtggaggttgcagtgagccgagactgtgccactgcactccagcctgggcaacagagggagactccgtccccctgcaaaaaaaagaaacaccagaaaaacccatgttgcagctggtctaggggtctgggtggggcatcattgggggctgtctgcagtggatgggagaggacacggctggtggggatcgggctcagctgggcctttctgtctctgcaggtagctcgtaagctggtcatcctggagggtgagctggagagggcagaggagcgtgcggaggtgtctgaactgtgagtggcagaacaggactgagcgaggctggctcgattcctggggcggagtgggaaggagctggctgtgttgggaattggctctgaccggggtctctgctcaagtggacgggcgtcaggggctcatggctcatcttttctcttggcttctgtgacaaagaggtggtgacttgttcttactgccatgggaagcactgcccacgtgttgaccctttctgcaaagatatgaggaaataggagtgagacaggaggcagcagggaagcccagaagtcccattttcccagagaggatatctcagggggctgtgccatcttaacagaacactgacctgctccagaaggcaggctcccccggtcagtatgtaaatgcttttgctcctgtcagtgtttggccgtgacacattcctggcgggaaggtgagaagcttaaccagaatcccacaagcaagcaccgaaaaacaaaacacctgtcctcttggccccgggtgaggaattcagccccacagagcatccgggagtgctgagagagatctggtttcacaaatccactccgggcttccttcccggagtgtcccctgcaaactcccattgctctctgcccgccttctgccctcagtcccattcttacaccttccggagtcggcctcatcaatcatagatttcacaagtccttgcagccttacccttggcaaaagaccaggagtgttttccaagccctccaaatactcttcgggcgcacctcgcctctgcctggtatgataagcctttgataagcccatagtatcacactgcagaaaaatccattaacattttctccccacattccttctgccccccaccgggggagctgtgtaggtttctcctttggaaaatttattgttggggcgattgctattattgccggctgtaagggaagataagacacaaaaatcctttgtctttgtgcagaaaatgtggtgacctggaagaagaactcaagaatgttactaacaatctgaaatctctggaggctgcatctgaaaaggtaggtggttggcttgagctggagggtggcttgctggactttgttcttttcttctcccgagggatgcaggagcctgtcaggttatggggaatctgccctttatttaacagtagcgttggtgcctggcagccagggtttttcccctacagaaagagctggatttctcctgcacactcttgagtcctcttccatggggtctgagcaccatctttgatctccatctcaggaggatagagatagaacatgaggctcttcttagcgagatctgagcatagttgtataaataaatacagagcctgcctctcacctgattcccctggttcctccagaaataccatctcaaaggtatagcaatgatcagaggtggaattgggctttttagtttgaaacagcacccaaagcagttgctacgtggcagctacgtcgggaacaaaggacacacttccacggccgaaccccactgaatttcccagcctcttcctcattcttgctcctgcttttgcagtttcacagacattctttgttctcccatcacctccaccccccacttttttttttttttttttgagacagagcttcgctctgttgcccaggctggaattcagtggcatgatcatagttcattgcagccttgaactcccaggctcaagcgatcctcccacctcagccaccacctgctattcactcaactgggtgtggctttccttttgcttgataaacccctattcagcctttttttttcttttctttttttttgagacagggtctcactctgtcacccaggctggagtgaagtggcgtgatctcagcttactgcagccttcgactcccaagttcaagcaattctcccacctcagcctcccgattacacgctaatttttataatttttggtagagatgaggtttcaccacattggccaggctggtctcgaactcctgatctcaagtgatctgcccgcctcgccctcccaaagtgctgggattacaggcatgacccactgcacctggcctagagatgagatcttgctctgttgcttaggctggaagtgtagtggcgtgatcatagctcactgcaggccccaaactcctgggcttaaataatcctatcacctcagcttcctgagtagctaggacttgcaggcatgtgccactactccaaaactgtatttttttttttttttttatagagcacagtctatgttgcctaggctggtcttaaactcctggcctcaagtgatcctcccaccttagcctcccaaagtgctgggattacaggcgtgggccaccgtgcctggctaatttttctagtttttggtagagacaaggtttcatcatgttggccaggctggtcttgaactcctggcctcaagtgatcctcccaccttggcctcccaaagtgctgggattactttgggaggccgccgagcctggcctcctgttcatcctttgagcttctgcttaaacatcacttctgagagtccttctctgatttctcatctaggttaggtatttctctgctgtgtagccctgtctatacttttgctggcattatgatttcttacatttattatagttactccattaattgcatgccttccttgctagattgtaagttgtaaggacaggaaccatgtcatcttgttcagagttgtgtccctagtactagcattgtgcctggcatatatctgtagtgtgtgtgtgtaattttttttttttttttttttttagtagagatggtgtttcaccatgttgcccaggctgatctcaaactcctggcctcgagtgatccacctgcctctgtctcccatatgtgccagccctggcatatatctgatactaggatgtgtaaggaatgaatccagttggtgtgtgtatgccagacactgccccgggccagggggatagatgtaacaccactaatacctcagctgctttgttttgttttgttttgagatggagccttgctctgtcgcccaggctggagtgcagaggcacgatctcagctcactgcaacctccacctcctaggctcaagcaattctcctgcctcagcctcctgagtaactgggaatacaggcgcacacaccacgcccagctaatttttgtatttttagtagagacggagtttcaccatgttggccaggctcgtctcaaactcctgacctcaagtgatccacccacctcggcctcccaaagggctgggattacaggtgtgagccactgtgcccagcctggcatctgctcttgaagagctcagagtcgagtctagtggaagggattgacaaagtcacagagtgctttgggaatacaatagagggaccttggtaggttgtgaacggtgtcaccaaggaggcgacatttaaaacagctgtaggtccagcacggtggctcatgcctgtaattccagcactttaggaagccgaggcgggaggatcgcttgagctcagaagttcgagaccagcctgggcaacatggagagatcccgtctctaccaaaaatacaaaaactagctgggcatggtggtgcatgcttgtgatcctagctacttgggaggctgaggtgagaggatcacttgagcctggagggcggaggttgcattgagccaagattgccccactgcactccagagtcaggcttcagtcatgacttgatcacttaatagccatgtgaccctaggcaaaataataacttcacctttctgtgaccctttcctcccctataaaatgggattacagataccaggctgtgatgccattaactatgtctggcccatggtaagcagctaataagtgttagttattattgggaggccgaggcaggcggatcacctgaggtcaggagttcgagagcagcctggctggccatcgtagcgaaaccccatctctgctaaaaataacaaaaattagctgggcatggtggtgggcgcctgtaggcccagctacttgggaggctgagtcaggggaattgcttcagcctgggaggcagaagttgcaagtcacagtgagccgagatcgtaccactgcactccagcctgggtgacagagcaagattctgtctgaaaaaaaaaaaaaagaaaagaaaagtataatttctgatgggtcatcatggggaggggaacattccatgctaaggggtgcattcatggacagggactgggactcaggagtccacagattatgatcagggagtgcctgtcaccctggggaaggtggtggagaatggggttggaaatacagagggggccttgagtaacagattcccagttatctccctttcttcgccatactttttatctcaagttctcagtttaggccttctgatcaataccatcctacaggactctccccaacatcctccacatttcacacatatttcttctgctggggaaaggtgcctgcctctactctgcctacttttttttttttttctttttgagatggagtctcactccatcgccccaggctggagtgcggtggcgccatctggcctcactacagcctccacctcctgggtttaagcaattctcatgccttagcctcctgagtagctgagattacaggcacccaccaccacacctggctaatttttgtatttttagtaaagacagcgtttcgccatgttggccaggctggtctcgaactcctgacctcaagcgatccacccgccttggcctcccagagtactgggattacaggcgtgagccaccgtgcctggcctgcttacttctttttatgcttcttcctccttttttttgagatggggtcctgccctgttgcccaggctagagtgtagtggtccaatcagagctctctgcagccttgaattccagggttcaagccatcttccctcctcagcgtccccattagctgggactacaggtgctcaccaccatgactggctaatttttaaattctttgtagagacggggtctcactatgtgacccaggttggtctcaaattcctgggctcaagtaattctcccaccatggtcccccaaaacactggaatcacaggtgagagccaccacacccagccctccttttctttctttctgttttttttttgtttttgttgttgttgttgtttgtttttttgagatggagtcttactctgtcacccaggctggagtgcagtggcgtgatctcggctcactgcaacctccacctcccaggttcgagtgagtcttctgcctcatcctccccagtagctgggactacagctgcatgccaccaagcctggctaatttttgtatttttagtagagacggggtttcaccatgttggccaggctggtctcgaactcctgaccttgtgatccaccagcctcaggctcccaaagtgccaggattccaggcatgagccaccatgcctggctgggcctccttttcttaaagcagtgttttggtttctcccacagtattctgaaaaggaggacaaatatgaagaagaaattaaacttctgtctgacaaactgaaagaggtgagtgtggtggcacccagcgagctctggtttctcctggggctggtcttgaagccatgatagtaactcctttcttcttatctaggctgagacccgtgctgaatttgcagagagaacggttgcaaaactggaaaagacaattgatgacctggaaggtatgaggttaccatctaaatgtttgccttgccctgccttcccctctgggacacatccacggacagttggggaatgtttgtggaggggctgggttgggctttgtttgccttaggaaagtaaagcgcatagtgatgtcatatctggatgtcctggaacactggaataggataatgcaaagcattcaggcttgaatggcccttttttttttttttttttttttctatgagacggagtctggctctgtctcccaggctggatggagtgcagtggcgccatctcggctcactgcaacctgcgcctcccgggttcaagtgattctcctgcctcagcctcccaggtagctgggactacaggcgtgtgccgccacacctggctaattgaattgccactttcaggaggtaaaatatctctgcttagttagtcccatgagcaagtatagagaaaagagtatggctctctctgattaaaaaaatattaataataaattaaaaatctcaggccaggcgcagtggctcaagcctgtaatcctagcactttgggaggccgaggcgggcggatcacttgaaatcaggagtttgagactaacctggccaacatggtgaaaccccgtctctaccaaaaatagaaaaaattagccaggcgtggtggtgcacgcctgtaatcctagctactggggaggctgaggcagggagaatcccttgaacctgggaggcggaggttgcagtaagccaagatcacgccacagctctccagcctgggtgacagagccagactccgtctcaaaaaaaaaaaaacttcacaatttccttctgtttgctcatttctgatagatgccttgcattttttttttacatgccttgcatttttgcagaagctctgtcccagggagctcaaagcttatcatagtatttaaaaaaaaaaacagaaatacagaaagtgtagggactgcaataaagactagtctgcaagtctggggcccacttctcccagaattttttcaagagttccagtgtttaacattcggcctcagaaattccagaatcttggggttcaaatggaatcttccaaactgcccatcccacccagaaaggacacattcttcagaccatatcttccaatgtttttttggggaagtgaggttcccatataagggaaaatgccccattccaaaatacgacctttggacagggtgacgtcattggaaatccgaaataaactgaggggtggggaccagtggggggaagctctgtcacttctggttaccactgttttgaagcttcattgtggctaatccccctgcagaacctcaaaccacttagagatcaactccatagatctttggttttcttcatctgtttcacatggaacacagctttctcctagtctgtgctttgtttgctcacgtgtttttttcttcctcttgtggttcatctgtggcactccattccgacccttgccttctgtcccctgtacttctgaactgtctccctggggacctccgccctctagatgagttatacgctcagaagctcaagtacaaagctatcagcgaggaactggaccacgctctcaacgacatgacctctctctgagaggcagccaggtcgctgccctctgtccttctcacatggtgcctcctacgcccctgtgggcttctaggagctccggtggcctgccttctggtttgaacgtcagagccttcttctgatgtgtctgtgactctacaaccgaaataaagacgggcagtcctcctcttcatgccccctcattctcattttctccacttgctgcctttgagctgtagctgtgtgcccttaaccatagcctgaaacacaaagtgggtggttagcctctctcactcacaaatgaaaagcttattacaaaaagaaaattatgcctacaggatgcttttctgaagacgtgaaaacaaaagcaaactgggcatgtgctctcagataccgctgttagctaacggcatctgcatgccaataatttttttttgtttttttgttttgagacagggtcttgctttgtcacccaggctggagtgcagtgacaccatcatagttcactgcaacctccacctacaaggctcaagctatcctcccacctcgacctcccaagtagctggaactacaggtgtgcaccaccacacaaggctaatttttgtactttttttttttttttttgaggcggagtctcactatgtcgcccaggctggagtgcagtggtgcaatctcggctcactgcaacctccgcctcccgggttcaagcaattctcctgcctcagcctcccaagtagctgagattacaggcatacaccaccacacctggctaatttttcttttggatttttagtagagacagggtttcaccatgttggtcaggctggtctcaaactcctgaccttgtgatccgcctgccttggcctcccaaagtgcagggattacaggcttgagccatcacgcctggccatttttgtactttttgtagaagcgggagggtttcactatgttgcccaggctggtcttgaactgctgggctcaggcagtctgcccacctcaccctcccagggtgctgcaattacaggcatgagccaccgcgcccatccccaatggtttttccttaaatagaaattgttgtgaatggaggctcatccttgtaaaccgcttaggcagcttaagagtcaacagggatttggaaaaaccagcaagcctgtgtcaaaaatgaggctccccttgaatggggcttgagctacagattcaaacagcggcagtgacattttgatctccatttcctccttttcttgtgtcttttctctgtgttacactgtgagtgtggtgactggggcttcccgtggctttactcttcactgttcatccagctcccagtcctgggaggaagttcacctccacgccctgcccttagaaaactgactgtacaaggagtgaacgggcctccatgaacagggaaagtgctgtgacgtcagaagacgtgaatttagaattcttttcccgaattccagaattgcctgagactgctaacatcaatctccattcatatttcagttagttataacaggaaccttgctttagtttagaatagctcttaaggttgacctgtgggtaataaaaggtcatgctttttcctacatgaggaatatggagaaaacaaggtcactcttttttttttttttttttttttttttttttttttcaagacagggtctcactctgttgcccgggctggagtgcagtggcgccatcttggctcactgcaacctccgcctcctgggttcaagtgattctcatgcctcagcctcccgagtagctgggattacagtcgcggaccaccacactcagctaatttttgtactttcagtagagatggggtttcaccatgttagctaggctggtctgaaactcctggcctcaactgatccgcccacctcagcttccaaaaatgctgggattacaggcgtgagccactttgcccggcccaggctatgctttgcttttttttttcttctttctttttgagacggagtttcgctcttgttgcccacgctggagtgcagtggcgccatctctgctcactgcaacctctgcctcacgggttcaagcaattctcctgcctcagcctcccaagtagctgggactacaggcatgcgccaccatgcctggctaattttgtatttttagtagagacagggtttcaccatgttggccaggctggttttgaacccctgacctcaggtgatccacccgcctcggcctcccaaagtgctgggattacaggtgtgagccactgcacctggcccaagctatgcttttctaatgatcaaaaacataccaatttgtcccaaaatttcaaatagtgcatctggttctcccctgcatcctaccaccactaccacctcaaattatcacagataattgacatttagatgttcaagccacatcttccagactaccccttgaacctggaaatggcatgaaaatctccaactagatcctgaattttcggtatccattgttattcctcatcctatttttttgtccaggtgggaagctctgtccccattactctctctattcatccattcctccaaaatgcacctcccctaaaccacctccacctttccaccctcagcctctccctgctcctaactgccgtccatcctgaacttctgcaaaaaccattcccctcacacattgccatatatatgcccttggaaagattacagactgtgtagggggctggtttttgtttggagtctgtgtgtttgtccctggaatttctccaggcatttctggactccaccctttgaagtaactatgcagcctgtctatccagttattctacctaactaagcacataagtggaatttcagagattagtgctatggccgggcacggtggctcacgcctgtaatcccaacactttgggaggccaaggcaggcaggtcacttgaggtcagaagttcaggaccaacctggtcaacatggtgaaactctgtctctactaaaaatgcaaaaattagccgggcatggtcatgggggcctgtaatcccagctactggggaggctgaggtgggaaaatcaatcacttgaacctgggaggcggagcttgctgtgagccaaggtcgaacctttgtactccagcctgggcgacagagtgagactccgcctcaaaaaaaaagaaaagaaaagaaaagagattagcactatggaggtctacactatctgttgatagtctgtgagccttgtcgtgattctcaagggcagttaacactttcagggaaagtcattttatctcagacctaataacaaaatagatgctaaagcatctgagtgacaagatgaagcgaagtcaggatttgtagtcaagagaccagggtttaaggcctggcgcagtggctcacacttgtaatcccagcactttgggaggccaaggcaggcggatcacttgagctcaggagtttgagaccaatctgggcaatatggcaagaccccatctctaaaattattcataataatattttatttttaaaaaattttttaataaaataataaataaagagaccaggatttaaaatcctagctctactactttaaccatgccaacgtgaacaagctgcttaggttttctgcaaaataaaggtgatatctctgttatgaggattaaatgagataatggagaaactggctcgtccaacatagtcagcattcagttaacatctattcacccagactggataggcccaggtcactgatctgtctgatagaatcctcccaggtcatagtcacttgactctgtgtgtgtgtgtgtgtgtgtgtgtgtgtgatggagtcccactctgtcacccaggctggagggcagtgacgcaatctcggctcactgcagtgtccgcctcccgggttcaagtgattctcctgcctcagcctcctgtgtagctgggattacaggtgtgcgccaccacacccggctaattttttgtatttttaagtagagatggggtttcgccatgttggccaggctggtctcgaactccttacatcaaggatccatggtgtctcatgccagtaatcccagcactttgggaggccgaggtgggtggattgcatgagaccagcttgggcaacatggcgaaaccccatctctactaaaaatacaagaattggctgggtgtagtggcacgcacttgtagtcccagctacttgggaggctgaggtagaaggatcacttgagcccaggaggtcaaggctgcagtgagctatgatcatgccactgcactccagcctgggcaacagagcaagaccctgtttaaaaataaataaataagaaaggctgccatcttctgcagtcatttttttctttctgtaaatttccaggctgatgatatcacattttatgaggcattttgctttcccccagcattttaatgagtcttggccttgtcccttatcagccatcacttactgcaaactaagttctctctcgtgctctgtcacgcatagctctaaatggcgtcttttttctctctctctttcttttttaatttaaattgtttcatcagctcagttacttaataacatgcctgtagaatggcttaaatttcgcatttacctggggtttgtctccgttctcctggattcatagacagttacacaattatgtgtataatttaaacagccattcccagaagctccgaaggaaagatgggttacaggattttagatttaactatcaaaggctcaggggctaattaactagcacttgggtggaaatttatattaagtcacacatatctaggactgaaatcttcatgtagcagcacgtcataggttctgaagtatttctcctttattcctcatcataacccccacaccacgcattgatatcgttacccccatttgacagacggggaaaacagacctaggaaggttagatgcttacttaagtgatacaactggagcttaagttcaggtattctgactcaagggttaccagagttcacaaggaaaaatacaggacaccaacttaaatctgagtttcagataagcaatgaataattttttaatcataagtatatctcttgcataagtacatctcatgcaacatttgggatatacttacactaaaatattatttgtggtttatctgaaattcaatttaactgggcgccctgcattttatcttacaactgtgactcccaaatttggtgcttgttccttagtattctgtgatgttctgctgtaattaaaaatacaaagtactggacaggcatggtggctataacccacctgtattcccagcactttgggaggctgagcagatgggttccttgagcccaggagctcaagaccagcctgggtaacatggtgagaccctgtctctagaaaaaatgcaaaaattggccaggtggtggcatgcacctgcagtcccagctatgcgggaggctgaggtgggaggatcacctgagcccagggaggtcaaggctacggtgattcgtgattacgccactgcacttcagcctggacaacagagtgagaccctgtctcaaaaaaaaagtactttctctcttgtgactttcaccctggcagtttcaggtttagaaatctttgggggggtgctgggcatggtggctcacacctgtaatcccagcactttaggaggccaaggtgggtggatcacttgaggtcaagagctcgagaccagcctggctaacatggtgaaaccccatctctactaaaaatacaaaaattagccgggtggtggtggcacgcgtctgtaatcccagctactcgggaggctgaggcaggagaattgcttgagcctggcaggtgaaggttgcagtgagccaagatcgcgccactgcactccagcctgggtgacagaatgagaccctgtctcaagaagaagaaaaaaaaacaaatctttttttttctttcatttaacaaagacgcttattaatttatctttccccatactcttaatcctcaccagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactac

SEQ ID NO: 37715 - DNA, 895651 bp, Homo sapiens; identical to SEQ ID NO: 36080

SEQ ID NO: 37716 - DNA, 201088 bp, Homo sapiens; identical to SEQ ID NO: 36390

SEQ ID NO: 37717 - DNA, 201088 bp, Homo sapiens; identical to SEQ ID NO: 36390

SEQ ID NO: 37718 - DNA, 17354 bp, Homo sapiens
gctggccgtctgcgcaccctctctcccctcggctctttgtgagtgtgggttcgcgggagaaggtggggaggagaggaggccgaggggtggggagctggcggaacgtggggattggagccgggagggaggaggaggaggagcgggctgccacgggcgcgggcgcgggcgcggggcgcggcgggggcgggagggagcccagccgagcccggccgcccgctcccgccactgccaccgcctcctcctccgcgtccgctcggcgcgggcacgggcgggatgggctggcccggcggctccccctgctgctgccccgccccgccgcgcccccgcccggccgggcgccccccgcaggtgagtggccgcgccgcgctgggcgggcggcggtctctgcgtcacggccgcgcgggcagtgccaggggcgggcgccagggggcgcggggccgccggaggtcgagagggcgcggggcgcggggcgcggcccagggctggggccgggggctctggctggccgcggagagctgggagcagcgggaggccgggacagtgactagggggcggggcgcggccgcggccctactcgatcaggccgccacgccttccagcacccggggcgcacggggccgcacgccgtgccacacacgcaggcccgggacccggcagcagctggcagcggcgctcgggccccggcctggcagggtgcgggcgaacgttttcctttcctgcttcacatgtgggacagaggccgtaagcgggcacagatgaggctgattcgactcgccagccccgctctgcggccccctccagtctgcccccatcctccagacccttctgggaacacccccagagccgccgccctccctcgctccttccctgggccttacccctcctccgcggcggccgggctcccagcctcccttccaaccacagctatttccagaaaggggggtgtgggtggaggggtttctccaaacaaacccaagacttcggagagagagggggcccggctgggggagaggttgacaggctctggaatgttacaggcgggaggagggtgagggtccaagagggtctagtgatgccttcccagccctcctcaagtgagctacttttcccctcgggactggctcatagggatcccatccctgcttcccttccgaggtgcgagtgccacaggatgggagggactcacagccacagtggatcctgaccaccccacccctcaccgagctcactgcttgggcacctccttgctgggtctgggtggggagtgtgagaccagtgaaggtgagaggatgtctggggacctgttccaggtgaggggactttcagcccctatggaggcagcaggagagtgaagcatgtagaggagtcctggtcagggccatgtgccataggagcagaagctgggactggacagaaaaaagccacccccactgcccaccttgtcacactgccccatctcccccaagcagggctgggggctcgacaaggccaggcccggttgcccacactggccgggggcctggaatgtgctgggacacagccaggctggcaggatgggggtgggtcacagagcccgtgctcctctccagttacaggcagggagcccaggcctgccacacagatgccaccttctggccaggatatcctggggacacatttcttggcctggaaaattggagcttccagggagaggtgtcaggctaggcccaatccagtcaggtcctcgcaagggtctcaagtgggcacccacagcaggcctcaccccagagaatgcaggattcttcatcccagggaacccatcctggtggatatgaaggagcaggaagcaagtagaagggactccgtgggagaagccagggctgggggagttgcctgagtactgggacattcaataaataccatgcaaatgagaggggcacatttgcacattctttcaagtgacagctatagcctgtcccaggggctgctgtccacagcttggggctgaagactcccaggccattaaccccttagcttttaggaagattactccccctttttcaaggccccatccacctccctcccttgactcccaggacgggaagttggccatgttcccaggagggaggccggaggcccatggatgggggtggagtatgtgttgggaggggggacctcctgtccagtcctcaggccctgggacagctgctgaggaaggagagcagacccaggagagccatgaaggtagtactcaggcttcggggttgccgcggggggagggtgcagcccttgggtagagagcccaagttgcagggctggaaagagggctagggatctgtgagatcatgtctgaaacaaagccagggaatgggtgagtggggggcactgtgtcaggagcagaaacctgggggctttcaggagaagggcctcatatgccttaggctgtggcaggagaatggattactccccaaacctgagcaaagcagtcttgtggctggaacttggccttgcaaggtgtattgagggtaaaggtgggcggtgcatgctttccttttcctacttcataacgagtgaaactgagacaggaagggggcccccagtcccatttttacctgactctcaggacacactcgggatcctgggcctgcctgctggtagtagttcccagctccactccctccccagcggaagtccctcgagagcttgagagttcaggctggagcctggctgggacacactgttccccacttgccctttagccctgccccgagaccagaattctcacccggccccaccgggggtgggggcagaatctcaagaccatggatccctgcagatccctggagagtgtggtgtcccaggtgtgggacaactccagagttgggggagtagggggagcaaaagatcacaggctgacactcccagcagggtagatcctgggaatctgatctcctggcctcccccacatcctcccccctccacttcctggagcagcgacctgcccccttcccgcctgcacttccctccacttccagggccgggcttctcctcacaccagccagacagcctaccctccgcccaggggaagcggctgcctccgccaggccgcttccaggaagccccgggccaggccccagcattgttcaggccctggggccagcaccccagccagccgaacaccatgaagtccagcggccctgtggagaggctgctcagagccctggggaggagggacagcagccgggccgcaagcagggtaggagtgcccaccagctgggcaaaagaggggcaggggtggaggtgcgggcagtgggggaggggaccaggaatcaggccaggccttcttcccaatttcagcttcctcagccttcttccctggcccagcatcccctccggagtggccagggctgtagtgtgaggggatgtttgggttagagtaggtcctgctgtctgttttggctcctctcaccttccctgctctagcctgggccaaccccaggaggtcctggccccccaacataagccccaggtgcctcactgcaggactttgccatgcgctatccaggtatcctccagcaggctcagagatcatcaggccccttccctggcccagggaagtttgagggaaatggggtggcagggtggaaaaagagagaggagagggagtcaggagtgctttggaactggaggtttgctttccactgacaacatccatatctgctgctaatgccaacatgctcccaagtgtcttagtgggtcccacaaagttgatccagcccagaagagttgcagggacagtcaagaaaccagaggtgctgcccacatccccatcactccctttcccaacttcccagccttgccccaaaagcagcagctcaggacaacctgagatactactgtgatgggtccccgggaggaggacagcaggagtctgaactccagaggagggggaatatgggtaaaacagagagatggcaaggagacaagctgtccccagacagaggatgggaggagagaacccacagtgggaggggaagggactgagataggcctgggccataagggggcatcccaggctcctgcctcactgcatctctgggtcaggaggggctgaacagggaatctggtccactcctttctcattcaatgcgtgaatcccaagtgccagggtgcagggggtcgggggagaactcacagcatccaaagccagctaaacatctctccccagtgacaggcttctatctgtttccctccagcatgaccacccccattacacaattgctgtctgctgcctcagtgcacaatgagtaaacatgttgttctgaccgtgggggaggagggcatgtcagctgcctggagcgtggggacagcaggagctaaaggagcaggactggctgaggccactcctgccggctcagtctggtgctgcaggactgacatacaacacatatgtttggaacctccctgctcactctgcacacaggtctccatgcggggaggacaagatgggaagagtcagggagtacccttaccacaccagggggaaagcctgagcatggaggcttttccacaagggcatcacacaccagggccatgtgaggggcccaagtgatcccctggggaggagctgacccagcaaaggtgacgcaaggggtcagattccatgcacagttgaggacaggccccatgaccgccctgaagcagctgtggccaagtgcgtcctacaagtttgagggcttgatctggacggagaaaaccagtgcagtgctaaggcaaggctcctgcccagtcccggagatggagatgggcccactgggaactcacacctctgtttgtccctccaccttcagcctaggaaagctgagcctcatagcttccgggagaaggttttccggaagaaacctccagtctgtgcagtatgtaaggtgaccatcgatgggacaggcgtttcgtgcagaggtgaggctctctgtcctgtgactctgagaccctccacccagtaccactgtgttgcacaactccagcaggccagctcacacaatctcaaatgtaatatgctgctcctggattaggcacaatggcagctaagaagcagctgcctcccccttcagatggccctggctccccatgacagacacctcccataacccaggagagccagtactctccatcaccttcccatcctgacttgtgacggtagtcttccttccctctcttcctcctcacctccacccaccctggaacgttacccctggcctgggcagtagtaccccactgccacactcttccctcaaaacctagccctgctcctctgccccagccagcccagtccaggtgggatcttggaagtcccagggtctggttccagggtctgggagatgagggaaggccattccttccactgtcccacaggcccctgctaacccctctcctccccttaccttccctagtctgcaaggtggcgacgcacagaaaatgtgaagcaaaggtgggtatctgattctacctgatagggggagagggtctggagtcccttcctcctcccaaacaggcttctgcaaccacactggcatcaaccctccacctccacccctctcaccactggggaacccctcctgggtgggaggggtgctgtactgggccctttaagaaccaccctactccgccttctggagggctggccagcccaggcgggtggacagcaagacagcgtttgtcttggtgctgtgcccagactgcagctggcgagaggatgggggtggggaagaggaggagaatgaggaggaggaagggtggggtgggtggggagtgggggagcaggatttcagagactgggcagccggatgggctgtgccttccctctggggaagggtcctcaaaatgcctgggcgggtcttgtcctgggccctggaaaaactgggcctttccaggtataagctgtggatagcacccactgtccactggggacctgagacagccctgtctctgaagaggtcccctggtcctcttccttcaggacagggggaggaggatcccagggccctggagctggcttgggggagctgtgtgcccaggggcggggtctcccggtgaaagaagccagtgtccatccctggccatggcctgcctgcttggctctatatataactcctgccctacagctggatgaatgggggtctgtgtgggctgggggctgagcgccaagagcaacaagtggggggcctggggggtgggggaccaagaggccagaggggaggtgcccttaaatagcgcaacctcagctggagcctgtgcccatccactgaaggcccctccaccttcctcctgaagctgaggggctgccccatcctcaagcccacgagagcccttcaccaggagctcagttccttactcggtccccttccaggtgacttcagcctgtcaggccttgcctcccgtggagttggtgagtgcgctctgggatggggtggggagggcaaggaacctggccatggtgtccagaggtctggtggctccagagagggcccccaggagatgaccttgaacggagtgctgtgggtattgctcatcctatgaggaaagaaaaaactgtctgagtcctctgctgatcttgtgcccttgggcctgctgggggtaggactcctctccccttatccagtacagccttcaaaaggacactgacattcccttcccctgtccccaaggcccacattggtccttgcccctgctgtaactaaccactcccttttcctcccccatctccctctagcggcgaaacacggccccagtcaggcgcatagagcacctggtaaggtgatgctggagcaggagggggaagcaggtagctttgggagtaaggatctagatttcctgaagacaaaaagggcatggctctggagtgggcagtctagagtagggggtacccaaagagatgtctagacactgtctgttaaccaccagggatccaccaaatctctgaaccactcaaagcagcgcagcactctgcccaggtaagtgagggtgctggggtggtcccacgtgaccccctttccgccggccccacacctcagcccagggcactgccccgcaacagagctccccgggacagccccccacccccaaagcggtattctccctccagaccgatccacccaccctcaggacccagcaggcttcacctgctgcccaacagacagccttcccgtcacactagccacctccgggtgccccgcccctgcgttcatgcgtaggctcctcctccccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctggtgaggggcggggccatcaggagtccgccaatgagagggatgtagggtccagatgggcgaggctaatcactgacgtcaccagcggaggcgaggccgccagggggcgggaccagagtggtggggtgggggcggggcccggagcgcggcctggagcggagcggagaatcctggaacgctggcgacttggctgtgactggctaggccgggccttagctacctttttattttctttatttatttaccttttttttgagacggggtctcactttgttgcccaggctggagtgcagtggcacgatctcacctcactgcaacctcctccacccgggctcaagcgattctcccacctcagcctcagtagctaggattacaggcgtgcgtcactcacgcccagccaatttttttttttttttttttttttttttgtattttttgtagagacggggtttcgccatgttggccaggctggtctcaagactccagggctcaagcgatccacacccggcaaattgttgtaattttagtagagatgaggtttcaccatgttggccaggctggtctcgaactcctgacctcaggtgacccgcccgccttggtctcccaaagtgctggggttataggcgtgagttactgcgaccggcctgcaccttattttagaggaagattcttacttaggatccacctccacctcgtgcctcattgccggagatcatttctgtctaaagccctccccctttatttcagctcttcaacctttcagagaaaaggcatgacctgacccgcttaaaccccaaggtatgaaggaaatggcctgcccaaccattaaaccaagccaccccaaccccagaagcccccagcttcctcgttattaatagtagcaattggcatctacttcactcttaagcactttcccactctcccatgatatattactggagacaccccaaaacgtgatgcagcaggtatcagcccattgtatggataaggaaagtgccgaggctatcatggacaaccagcagacccccagccttgcccccggacccctatgccctgtcccctttccaccctgcccatctctctctgttggtggcccccggccccagttgcacccctgcattctccccaggttcaagacttcggctggcctgagctgcatgctccacccctggacaagctgtgctccatctgcaaagccatggagacatggctcagtgctgacccacagcacgtggtcgtactatactgcaaggtgggccaggacctcgggttccctggtgcctggaggttccaggtcagcctggagctcccagaccctcatccctgtctctctgtctgtcagggaaacaagggcaagcttggggtcatcgtttctgcctacatgcactacagcaagatctctgcagggtgaggctcccagcgcctgagtagctgcttccccagtggccctttctccagctggccccttaggaacccatctcccctggagcccacctcttcgttgagagtcctttgctgtcagcttagcacttccacctcccttttatcactagtactgcaacatagtctgcagcagatggtctgtagagtttcctggggcagccacaaacagggtggtgtaaaacagtggaaatgggccgggtgcgttggctcacgcctgtaataccagcactttgggaggctgaggtgggcaggtcacctgaggtcaggagtttgaaactagcctggccaggtgaaaccccatctctaccaaaaatataaaaatataaaaattagccgggcgtggtggtgggcgcctgtaatcccagctactcaggaggctgaggcaggagaattgcttgaacccaggagacggaggttgcagtgagcccacacggtgccactgtactccagcctgggtgacagagtcagactccgtctcaaaaaaaacaaaaacaaaacaaaacaaaaaacagtggaaatgtactctctcacagttctggaggccagaagccccaaaccaagctgtcagcaggcccttgctccatctgagactcgggatggaatccttccttgtctctttctagcttccagtggtgggcggcaagccttggcattccttggtttgcagacacatcactgtaatcgctgcctctgtcatcacatggtgttctccctgtgtgtctctgtctgtgtctcttcctctcttcttataaggacaccaatcatattggattcagggtccaccctccttcagtatggtctcatcttaactaattatgtctgcaacggccctatttccaaataaggtcacattctgaggtacatgtcttttggggggatataattcaacccataagatggttttgttgccctgttttacagatgaaaaaactaaagttcagggaacaattgcctgaggcccaacaactagtaaagtgactgtacatggtgcttctcattctcattaccactactctgggcttcttctagacttagagaatcatatttctcctccatcccctggggcttagggatgggaggccaggatgaagattaatccctaatccccaacactggccttgctatccccagggcggaccaggcactggccactcttaccatgcggaaattctgcgaggacaaggtggccacagaactgcagccctcccagcgtcggtgagcagcctgggtggggatgggccagaggagcagctcccttcatggctaccaaggccaagactctcttattcatgcagcacactttcactgagtgtgccaagcgccgtgccaggtgctgagaattcaaagtggacaaagcccctgctctcatggagctttcatgctagtagggtggaaggcagtagacctgggaataaatagacgaggagatcagtcataaagagaacctgaaggacagtcagggcctgccactataaagtgaagcagagctctggggaaagagctttgaggcagaggggagcaggagggattgaggttagatgcaaggaagaactttctggtgacccggaagatgggaaggaagtgttgagcagaagagcgagccttctaagggtggatggttgaaatgatacaaggtgacctccagaggaaaaggcttatgttctccttgacacgccctccaccagatatatcagctacttcagtgggctgctatctggctccatcagaatgaacagcagccctctcttcctgcactatgtgctcatccccatgctgccagcctttgaacctggcacaggtgagtctgcctgagatgtgctccctagggagaaccaccttcaggccctctccactcagcacccctcctgtgccttctcctctgcccctccaggcttccagcccttccttaaaatctaccagtccatgcagcttgtctacacatctggagtctagtgagtgctctattcccaggcccctgacacttcatgaccagggcccctcttgctcctgcattcctgcttctccagcctccctagacacctgggcagggctcagactctggtctcctggctccccctgactgcatagctgcctctgcacgcaggagcttctggttcatctctgccttctcctctctccccacagtcacattgcaggccctggtccccagcagctttgcatcagcctggagccagccctcctcctcaaaggcgatgtcatggtgaggggggtcctgtcaacaagaagaatcctggagatggggcaggggttggtggtgtaacggcacagtcaccaatttgagacagattggagagcgagtagggagatcaccttgagatcgaggcagggcagaagctgtgaccaggcagtccccagggtggaagcgcagaagaggacatgaggcctgatccgcagcctcctgcctttctcccaggtaacatgttatcacaagggtggccggggcacagaccggaccctcgtgttccgagtccagttccacacctgcaccatccacggaccacagctcactttccccaaggaccagcttgacgaggcctggactggtgagtctgagacaagtggcctggggctggagtccaggtggcaggcaggtggcaggcaggtggcaggcaggcaggagagtgtggtatgggccaggggcctggttcttcactgtccactccccatagatgagaggttccccttccaagcctccgtggagtttgtcttctcctccagccccgagaagatcaaaggtaagagcagggacatgggctggggactgagggccgcctctcccctgctccccaatacccgagtggccttccacaggcagcactccacggaacgacccctcggtctctgtcgactacaacaccactgagccagccgtgcgctgggactcctatgagaacttcaaccagcaccacgaggacagtgtggatggtgcgcaggcagcctgcagggtgggaggtacagggttgtggcgggaccctggggggtggtgccagggagaagcacactccctcctccccaggcagagcccactcccgagagacacccccggcccgacagctgtctccagtgccatcccctctcatgaattttctctctccctccctgttccccgcttgccctccctccctgatcctcttccccactcaggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcaggtgaggggcaccagagtgcggagtgcccagggcagaggaggttctggaagatggtggggaagtcaagggggaacagggtgagaaacagctaagccagacagaagagccccatcctgctcacagcccacctctccccttcactgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaaggtatgcagaggggccggggatgctcgagtgctttcttgtccaagcagttgatgaaggcaggtggggtgggagcagccacaatgggggctctgctgaccatctgcccttccaccctacagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccaggtataaaggccttgagggggttggtgccaccttgagagaaccctttctcctgggatgtagcatggatggggacccgggtaccctggggtctgaacctactccctccctgtcctagagcctcctacacaagagagccaaagcaatgtcaagtttgtccaggatacatccaagttctggtacaagccacacctgtcccgtgaccaaggtgagaagccagcctgcccccaccccactgcatcccaccttccagggtgtctgtcttggctttaagtcccatcctgttgaagctcttggctcctcctgtctgagctgtgtttactcttggctgagtgtttaccagcaggtgattctgggctttgggccaaggcggtgagatccaacatggtcaaaacccctgtgaactctagagccctggcctcagactcttaccgccaccacagctgtcagggcagagaccatggagcttggcagcagaggaggggggctgcatggggctcagtccacccctgtgaaaactcctccccactgcccgctacccctcaccctgcagccattgccctgctgaaggacaaggaccctggggccttcctgatcagggacagtcattcattccaaggagcttatgggctggccctcaaggtggccacaccgccacccagtgcccagccctggaaaggtacagaacacccaaacctgagtggggtggggatgaagttgggggtggtgccagaggcaaggtaacagggcaggtgggggtgctgtgctggccatgccgctgtagaggggagaggtaggaaaagacctcagctgctcgggaaagaatcccattagggaagaagctggaacctggaatcctaaagccgcaatcttcccctcgcctcctctcaggggaccccgtggaacagctggtccgccatttcctcatcgagactgggcccaaaggggtgaagatcaagggctgccccagtgagccctactttggtgagaagcaggagcctggggaaggctacgttgggtcggtttagggagatgccaagggatctcaggaggatggaagggaaaggcggggcaccctgggcatctcgggactttcctacctcctctcccacaggcagcctgtccgccttggtctcccagcactccatctcccccatctccctgccctgctgcctgcgcattcccagcaaaggtgagtgtctggtcatctgtcctccccacctctccctaccccctgcagccaaagcaggatccagaggtcttggctccccgccttcccttggggaagcagagggagtgctccagcctggggaacactctgccttctgagcttccctgtcggttctcattgccctcagatcctctggaagagaccccagaggctccagtgcccaccaacatgagcacagcggcagacctcctgcgtcagggtgctggtagagacttcccctccactcccctccctctccctgggcaccaagggggcattgtggatacagggcatggggcactgaaaggccttgaggtgggtgagccctggccaacccatgagggcaggggagccccatactgtcggggatgaggaattgggtcctcagcctaggttctcaaagtctcatgaacaagacgatcatggggtggtagcagggaggcttctctgcctcgcttctgactgtagatccagtagagtcatggaatctgcctttttaacaagtcacctatgtgattgtaaagcatgtgacagcagtagctggggaatgtgcaagagctggtgggggtggctaggggatgggcactccctccctgacccactccctgcccctgtagcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagtatgtatactcagccctgtagaaccccatgcttaaggcccctgggggctcatgtttctgagtgtgaccttcctcaccctcctccttgcaggctcttctttcgccgccattatccagtgaacagcatcaccttctccagcactgaccctcaagaccggaggtgactctccctccaaaccctttgccccaaatccccatggtcccaccaggtcccagctcccagccccagccccagccccggccccggccccccttcagcagctgtcccctggggtgtgcatcttcaccttcttctccttctgcagatggaccaacccagacgggaccacctccaagtaagcctccccacgaattcagcctcttccttccaagggaccagggcgctgctgtcctctcaatgctggcatttgatttgtctcaccaaggccagctacattcccttgtggaaggaatgttaagccccttccccaccctttatccccctaggatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccgaaa

SEQ ID NO: 37719 - DNA, 19816 bp, Homo sapiens
cgctgctggtgctgttgccgccgctgctctagctgccgtcagtcaggctgcgcccgcgtcttcagggcccagtccctcggacccatcgccgcttctagaccctactgcggtctcggatattgccgggtgaggctgcttcggtactagtgggagtcgtgaaggggaatcggggagctggggttgcggagcccgcgggcgcggccaagcgggaagcgggcgcggtgaccgaggtgcatcgagtcacgtccagtgctcgggccgtggtcgcctgcctggcaccaggactaagcgtttctatcggtcgccttcctccacgctgcgggctgcctggggatcgccccccagggagaaggtgtcggaggccgctgacgtcgcgcccgacgggtttctgggcgcctgacgtcaggtctggctgcggggcggggcgggcgcgggccggcccctcccccaccccttcccggcgggcgcgacccgctaggaggccggttcgctccggttgatcccggactccctttgttcgtgcgtccctaaacggctgccggcctcgcgccccttggccccgatttcccctctacccccaccctattacactcattcattaatttttaataaaaagggaaaggcctgaaaagattcttacaagagtctcgggcgcttgttaatccgcagtgtgacaacgttctggttatgacttactagaggaattgctcacggatacattagatgaatacccagggcaaaccacgagaagggcagaattcagtgatctccttttttaggactgaggagcacatacctgcgatagcgtatgcatagctggaccgttttcctctttaccttgaaaagcaagagtacagcttttaataggtaaagattccagtgttaaagcatgaagccaggctcactcgaccgcaagaattttttttagttttactactagagaaatacacacctgggggttgtaaaggtctgtttcgaaaaggaaccctcattacaggcaaaggtagccttcagaaacatttcataagttctttgttcactggtgttctttgggggaagaatagaaatttttcatgctggcatctctgagcccacaatgcaaagcgagtttgcttcagaaacttggagtgaattgcaaatattggaatgttcttttcctcactccaggcggaatgggtaaaatccatccccagtctcttaactgaaacttttgaagctagtgtgttttgaattcaaaaatacttggattttatcttcatctttttagaaagtcatgttagacgagagataacacccccagcagagtggggcaccccataatccaacattaatatttgcagcaatagatgtgaacattcattctaagtgggggcgaatagaaactataaatagcttcaggtcacattttgccaccatgtaagttttgtgccaaactagggcagataaagatttatggacctaaaagtaggcatcataaaagctaatatttgttgaggttttgctatattccaggcagcgactaagagatttgtttattaaaagttttacagcaaatctatgatgtgggtacgattccgatcttcctttgcctcaagtttggagagttggacttgtcaactctggccgaaccaaccagtgaagagctgcagttatagctagataatcatactttaacgtttacttttttacctataagctagatgtccacatacaaagaaaagagaatttggtatttgttttccacccaagcactatttttttaggcacttgattggacagagtcccatttagttcctcgcaacattactggcctggtttttatttgttttgttttttaaactgcgtgctttttacaaatagtatggcctgttctttatagttcgggttcattcagatgagccgacttttagtgaaataattcaaaccctcgtctaaggtcactctgctaagactttaatacaacccttccctttctcgctatattctaacccatctgaactgcttatacctccccagagattctcccagtttttacactaactgctcttctttccctagggcccatttcaccgccctctactcccggctctttccttatggtccttatggactgcaaaagacagcacatctcaggaatctccatgtaatactataatttctctaaaggccaacacattgtttggcatatatgttccaataagtatataactaaatgccaagaaatattgcaggttgcatatcctttatcccaaatgcttgggaccagaagtgtttcagattttggattttttttacattacaccagttgagcatccaaaatccagaatgctctaatgagcatttcctttgagcggcatggtggcactcaaaaagattcagatttttgagcatttcaaaacccccgtttttgagttgcccaaatgtaaaaaatggaacataagcagataaatgagccaatactaaaaactagcatgtattctaatttataatttatattttcttttttttttttttttttggagacggagtcgcttactgtaagctccgcctcccaggttccagcgattctcctgcctcagcctatcgaagcgaagtagctgggattacaggtgccttccaccacgcccagctaattttctgtatttttagttgagatagggttttaccattggccaggctggtcttgaattcctggcctcaagtaatccacccacctcggcctcccaaagtgctgcgattacaggcttgagccgccgcacccggccattaatttatattttcagtacgatacatatcatccccccatactaaacaaatcaacccaaaaattttgatttcgcttaatttcgcctaacaaatatctaacatgtatatagcactttatagattaagtgtgttactattttctgtgcagtgggcaggaattataacttctacagatggaaaatggtctcttattgagaagttttttgtcaaaagataaccgtcaaaaggattcatgtccgggtttcatcactgtgtagtcccatactgtttatcactccatcacaatttgaaggctgtctgaaatatccatgaactccactggtaattcatggagttcaactctcttaaccaccctcctccctgacccatgatttttaccctaacagccatgagagtttccaaaaatgttatgttttacttttctagtgtatgtcaaaagacattttgtactgttttaaaattactattcttgctattcaaagaataaaaagtattgtttttcagatgatgggtggatcatgctataaaatggtaacaaagttttggaaataatagctttagattattccaaaaagaaaaaaaagaaagcctttcttgagtataaattgtttttatgagttcaaggttacattggcctcatcttaataattagcgatgattcagatattttggaatagctttatatttttatttatttttctttttgagacagagtgccactaatattgcccaggctggtctcttaactactggcctcaagcggtcttcccacctcagcctcctgagaagctgggattacaggtgcacactaccaagcgcggcttagaatagctttttagaaaacctaaactttttatgttctgcaactctcctcatattgaaacgttcatgtccaactgtttttcaccttttctaatgaaagtattctccaaagaacaaattggaatgcttccaattatagttgttcccccttatcctagggggacacattgcaagactccccaatgaatccctgaaactgaagtctgtatacactgccgaagcctaagtataccatgttttttagatctaataaccaagatgggctgatagcgtatacagcatggatacactggacaaagggatgattcacgtcctaggcaggagggggcaaactttcattttgctactcagaacatgctcttgccccatttaaaacttaggaattggccaggtgcagtggttcatgcctaatcccagcactttgggagactgaggtgggcggattacttgaggccaggagtttgagaccagcctggccaacatggtgaaaccccgtctctaccaaaaattaaaaattagccgggcgtggtggcacgtgcctataatcccagctacttgagaggctcaggtaggagaatcacttaaacctgggaggcggaggttgcagtgagtcaagatcacactactgcactttagcctgggtggcagagcgagactccatctcaaaaacaaaacaaaaaacttacgaattatttatttctggaatttttcatttaatatgttcggaccttaggtaattaaaaccacagataaggggggatcaccctaacatgaacgctgtttattctaggaatggagagctggtcactttactaagacagtgccgtagaacagaacttgttactaattcctatgcttagggctttgttttttaatcacaagattctagcacctcccctatcttccagacttggattttgaactttaaaattttgaagtagtgttgtgaatcagttgaatattattaacttgtagaataatttatgtaattccatgactaggtaactgtataattctgaaaacctgaacagtcaaggccatttggttcactttgattctcaactccagaattaatatgaactttgatacagaatcattttctatttcagaaaggctaaccctgtttaaaaagcatgttagccttacaacttaccgtatattttctacactgttagtcctaaaaattttattgtgtgatgtgattgacgttaaaccttaacatgggaatgggttgtatgtgggtttttttgtttttttgtttttgagacggagtttgcactgtcacccaggctggagtgcagtggcttgatctcagctcactgcaagctccgcctcctgggttcgcgccattctcttgcctcagcctcctgagtagctgggactacaggtgcccaccattatgcctggctaattttttgtatttttagtagagacggggtttcaccttgttagccaggatggtctcaatctcctgacttcgtgatccgccctcctcggcctcccaaagtgctgggattacaggcgtgagccaccgcgcccggccatgttttttgatattctgaataaaaaggatatagcagttgggataggcttgggttcttgtcctttatgttcttgtcctttcctcatgataatcaaatcataattagaaataagatgctaagaatacaaaggtggctctatgttaatactgtattgataggtcaaaggagaaaaagcatgagatcaattcattagatactgaaaagtcttttgagggaatttaatgtcttcttgctttctttattaacagaataggaataaataatagcataggcataaattaaaaataatgtaattttttaaaatctcaaactaaaaatgggaatcatacttaaacattagcattcccaggagagttggagcaagacctctgtgcccactatcactcaacatttcattatttaagtcctagcaagtgcaaaacagaaaagatgcataaatattagagaaggaaagttattttttgcaaatggcgtattttttatctggaaataccagagaatcaagtgagaaactttgaagaataaaataattcagtaatgatgcttcctaccctaggttaattaatataaagaagagttaaattcctatggcatatttctggtaacaaaaacatcactaaacttttaaataaaacccaaaacacttctagtattaaacatttaaatgagctgggcgcagtggctcacgcctgtaatcccagcactttgggaggccaaggtgggcggatcacaaggtcaagagatggagaccatcctggacaacatggtgaaaccccgtctctactaaaaatacaaaaattagtgggtgtagtggcccgcacctgtagtcccagctactcaggagactgaggcacgagaatcgcttaaactgaggaggcggaggttacagtgaaccaagatcgcgccactgcactccagtctggcgacagagcgagactccatctcaaaaaaaaaaaaaaatttaaatgatttctactaaaaattttaaaaattagcatgcctatggtcccagctactcaaaggctaaggtgggaggatccacttgagcctgggaggtggaggttgcagtgagctgtgatcacaccactgcactccagcctcggtgacagagcaagaccctgtctcaaaaaaaaattgaatgaatgtgagctgtgtatacatttaagaaagattaataaaaagataattatttgcctccctcttccagttcagggtctcaatggctggagcctttcttggcaattcagagtccaagttgggaaccagccctgaactggacgccatcccagcacagggtgctctcacctacacccacgctcacagactgggccgcgtagacacatccattcatgtgcatctttgggatatgggaggaaactggagtacttggagaagacccataaagatgggagaatgagccagcttcacacagacagtgacctcagctgagactttttgttttttcttctcatcaacattataacaaaacaaagttgaatgaaacgtctttcgaggacctgctatagactaaaattttaaaaccctgtcccatatatgaacgaacaattagaaaatacagtagaagaaaagagcctatttacaaccacagggaaaagtttaacagaaatcccttaaaagaaatgtatataggagatctgatcaagaaaataaactacatgaaaaggacaggaactaaacagtcctctgtgtctgcatttgcgggtagaaaatattcagggagccgggtgcggtggctcatgcctgtaatcccagcactttgggaggctgaggcgggcggatcacgtgaggccaggagttcaagagcagcctggccaacgtggtgaaaccctgtctctattaaaaatacaaaaaattagccgggcatggcggcgcttgcctataatcccagttactcaggaggctgaggcaggagaatctcttgaacccaggagatggaggttgcagtgagctgacatcatgctattgcactctagcctgggcaacagagtgagaccctgtctcaaaaaaaaaaaaatacttgggggaaacaataaaaataaccatagaaaatataagttaatataattatatagtattcacacttttaagtattataaataatatagagatgatttatacgggaagatgtgcataggttatatgcaaatactacaccattttatatcaggtacttgagcatcctgggatttgagtatctatgggggtcctagaaccaatctccctcaggtaccgagggactatactataccttgttcttgaacgagatgatttgacattttaaatagatgttcccctagattaatctgtaaatataatacatttccaaccagaatgctaacacattaatttttttttttaacgatctggaaaaaataaaaatacataggaaaatctgaaaaaaaaaaaaaaaaaaaagacagtagggtgactcacattaatgtttatttaaaatatattgtaaagcttctgtaattaaaatggaatggtacagttgcagaccagtagaaaagaataaagtcagctgggcacagtatctcacgcctgtaatcccaagactttgggaggccgaggcaggcagatcacttgagctccggagttcaagaccagcctgggcaacatggtgaaactccatctctacaaaaaaactagctgggcaggatcgattgagcccagaaggtcgagtctgcagtgagcttatgatggtgccactgcactctggccagggaacaaagcaagactgtttcaaaaagaaaagaataaagtccacaatatctgtgggaaatgaaggaggctctatagcctgcttgttaagagcctaagttctggagtcatactgggtttgaactgcttctctccttgtcattagctctgggaccttaaacaagttaacttgccaagcttcctcttctccagctgtaaactgggggtgaaaataaaatttgtatctgggttctggagctaccaagtgaggtggtgcacagtacaccaccatgttccatgtttcatggtaaatattggatagatgctagttataaatggcagcagtatagtgtagtaaaggtagcttgtccaattagctgagaaaagatagatagttgataattattgtttggaagaatttaaaggttttaaacaagaagttaaaccataaaaatactatatgaaagcaaggcagagtagggaaggcctttgtaaatatatcacaaaatccagaagccacgtataggaaaacattgatagatttgatgacatgaaatttaaaacttttgtataaccaaaatatgccctttaagagatctacagataaaaggaattttggagaaatttttttttttttttttttttttttttttttttttgatatggagtagccctccgttgcccaggctggagtgcagtggcgcaatctcggctcactgcaagctccgcctcccaggttcatgccattctcctgcctcagcctcccaagtagctgggactacaggcacccgccaccacactgggctaatcgtttttttgtatttttagtagagacggggtttcaccgtgttagccaggatggtctcgatctcttgacctcgtgatccgcctgcctcggcctcccaaagtgctgggattataggcgtgagccactgcacccggccaaaaaattttaatctcatatatgaaagctagtctgcttagtatcttacaaagcagtgagagaaaaagatgtgctactgagtaataaaatgatcaaaggcaaagagtacctacagtcttttatttatataaagtcaaagaacaagcaaaattaagtcaaaaattgactgccatgaggcaaggtagttgattggaaaagagcatgagtaaactttctggagtgagaaatgttctgtatcttggggtggttataggggcgtatacaattatcagagcttgttaatctgaacacttaagatctctgcattttgttgagtgctaattacacttcaatttaaaaattggtaaaagtactccaggacatcaataaatttaaatttgggagtacacacagtggctcatggctataatcccaatactttgggaggctgaggcaggagggtcctttgatcccaggagtttgagaccgggtctgggcaacatagtgagacacctgtctctgcaataaatttttaaaattttaagaaatttgctgggcatgatggcacacacctgtagtaccggctattagggagactgaggcaagaagatgacttgagcccaggaggtcaagattgcagtgagctgtgatctctctcgccactgcactccagcctgggtgacagaatgagaccctgtctccaaaaaaaagacgaggaaatgtaagttaaaataagacgctaatttttaatatctattgtcattataaacaataaatttaataatatccagtggtaaaaggagttagagaaatgagtgtaaattggcatggacttttcaaatggattttagataaatttatctgttgactctaaattccatgtccagtgctttttcctggtgttagattctcacacacaaacaaagaagtgttgagagatgttcactgtatcatacttaaaacaacttatactgctacaaaaagaaggtaaattaaattgcaaatcatttttgtatgatgtgcagccattaaaagggatgaagttaatagagctgtatgaactattatggaaaactttcctatgtaaagaaaaacacattacataaataagattccgcttaagtaataataatgtatgcatagaaagttccttaaggaatatttaagaaatggtgaacactgattttgaaatttttctttcttccttcatttcttttctttttttaggaaaatgtctgatgaattttcggtaagttgatcagtttatctgtgataagtttttcatctcttaagaaaaacaacatggtcctaactgggctacgtaaatcttttcacttaaaagagatgctttaaccaggcatggtggtgtgcacctgtagtcctagctacttgggaggatcccttgaccccaagagtttcaggctgcagtgagccatgattgtgccattgcactcctgcctgggtgacagagtgagactctgtctataaataaataaaagagatgctttttgtgattcttggctttgggggtagtaaagagattttgataggtgatttgccttagtttactgagataatagcatgtttggaaatgtttcctgtatttatgaaaatatgtatttctttaaatgaaaatttaagatgttacttctgttgttctcttttaccctgatagtattaatagccaacatttattagaaattattatataccaggcactctgtgaaagtgtactacatgaaatatcatatttaagcctcaagttaaccctaaaacagttttgaaactgaagaggctctatctcagagtatgtagctcctttgaggttaagccaggattcaaatccatatcttgactgttagttctatcttcttaattactgtattttgttgtattaatacagcagagaaatgaagcacaatatgattagttgtatttagaaaacgagtttctctgaagaatttgcactgtaaagttgatacgcaaagtagcatctcaaggtttatgttaaatagagtattttttaaatgactagcttagcttttgaagatattcttgaggtttataatccctgcccctataggttactattctctgtgggtttataatggtgttcgatgtaacttttccctagataggaaagacgtatctgttttgtgttccagttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccatgtgagtgttcaatttgttatttaaagtgtactaattgtacatagcacaactgacattgtttctccccagttttggatggaagattaagaaggcttttaagtttttaaaagagggtgtgtgtatattaaataagtaaatttcaaaccttcaggtaaagcatttaaaaggatgaaagcactgttttaagtattccttgtgctaaaaagaagaattttccaaagatccccaaagactttgtaatgtagtaagcagtgtcctcaatagcatcctttaggtaaactctgagattcatttcattgggctttttgttttattattattatttctcagtattgttttatagcatcacaccaaagtacagttcagtaaaagcagtctctacctgtctagcttgatagaggtagatttttagagaatccaaggcaatgagtaggtaatgttcatctttcaagcagttctcgagctcaagattacacccctattctttattgtcagttacatgtaatgctttatgctttactgtcagacaacccagtgtggggttaacatcttagttgaggagcctgccttggtcatataaccaaatggaaaagtaccccacttcccctgtgaggtaagccaaacgagtatccaaacgcagagtaaagattttccttaggaaaaaaaatctgttaactcttttttttttttttttttttttttttttttgagacagtcttgctctgtcacccaggcaagagtgcagtctctcggctcgctgcaatctctacctctcaggttcaagcgattctcctgagtagctgggattacaggcgtgtgccaccacaccggctcatttttgtatttttagtagagatggagtttcaccatgttggccaggctggtcttgaactcctgacctcaagtgatccgcctgcttcagcctcccaaagtgctgggattacaggcctgagccaccatgcccagccaggaaaaaaaaaaaatctgttaactcttagtacgaaaataactagccagatctctgattagattagtcaaacatccaatccagctataaaggaaaagaaatctttaaagtacccctaaaacttcctccttgcattagtgtaatttctttcttgctatatatattatctaaaaatatttgttttgcaaagtgtatgccagagtaaatgatgtgacttgctgtttggatttattaagcaataaatttactttaagccacagtaaggagttaataaactccatttgcaaaatctagaagttgactttttcttttttctattgcagtcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgtcaagaatgccaaatgctgccagttttttggtttgatagctacctccttctaagaaagcaaaatggttacctttgagaggaacattcagtgtttaatcatcccttatgttaactagatgatagattcaagcttttagaaatgagaaagtagaaactaatttgttaagatattttcagactgcggaatgttgttagctttttctttcacttctcttcaaggacaggtgttagctgtctacaatactgttgaactctgttgtcaaagtagcccccttagtctacaaggcaggtagccttggcttgaattatcaatatcaaaatgtcagttaaccatggagggataaagtaatgtgaaaagtgagatggctgcaaagatagctctccttacagttattttggctgtcctacattgggataagctgacaaattagcagtatttagtttaacactggagcaaatataatttgagtaggaagaagagatagcaggtttgggaatctataattatgaagtccattgattttgggagaaaatctgttgctaaaggatttgaagggccatgaacacaatttgggattattactccctataagtataataattttgctagtgacccatactgtccagtgtgccctaaatcatactgctattgtactccctttgttttcaaggactttgcaactggtatttgggggagatttttttttttttttgagacggagtctcgctctgtcgcccatgctggagtgcagtggtgctatcttggttcactgcaagctccatctcccaggttcacaccattctcctgcctcagcctcccaagcagctgggactacaggtgcccgccaccatgcccggctaatttttttttttttttttttttagtagagatggggtttcactgtgttagccaggatggtctcgatctcctgacctcgtgatctgcccgccttggcttcccaaagtgctgggattacaggcgtgagccaccacgtccggccgatttttttttttttttttaatgtaagaatggagataaaagggataatataatttgcttttatattgttatttttgtaaagcatcttttcttcaattcttgttggcattctgggccaaaatatttcaggttggttcggtgtggagttaagaaaagcaggcgttttagtggagaaatggggaacagcatcaagaaaggcttttttccttttttcttttttttttggagacagagtcttgccctgtcacccaggctggagtgcaatggcgtgatcttggctcgctgcaacctctgcctccaggttcaaacgattcttctgcctcagcctcccaagtagctgggattacaggtgcccgccaccacacccatttttgtatttttagtagagacgggggtttcaccatgttggccagggtggtctgaaactcctgacctcgtgatccgcctgcctcagcctcccaaagtgctgagattacaggcgtgagccaccatgcgtgacctttttttctttttaaaagggaacaatgttgctttcaaaacaagacatgctaggctgaaactgatttatggaaaagactgcttgttagcaagtatatttggtcttgagggggatacagattatagaatatgctgacatttgggcttcagaggaagaattttcaaatctaatggaaatagttgaggtgttcaggaatgctgtttcttggagttggaagcttaggttttgaaatgttgaaaccaaaaagacaaaaattaaaacatagaccttaggtcgtcattcacacccggttctcaagaatcaagtggagcacttcaaagaccttggcttgtctgtcccatcctgccactttctcatcttttcatgcttttgaagacaccatttacagctctgactcagccctattttgtgtaaagtaatatattgattattcagaaatagacaatacattttttaattacccaaggactgactgttttgtgcattttactgttggttgtcttcagtagagaatagtaatagggcagagaaaagtatatattttgcctcagtcagtcccaccaccacaatggactattgggatattttctaaaaaaccaatcaatttgcccatgattacctcacaaataattagtgctacctggggtactctcaaatatacagcttttgaaactgtagatgaaaaaagctctactcagagtttttgtcaagactgtgcctgggttgaatatcagtcaattgcctacacttctaaacaataagtgccaatgtctcaattttctcaccctgaatgatagaagctagctttatcaaatgccaaggttagaaagcctggaaataaaacttaagcacagacattcaagtttttgaaaagcataagcctaaattcagataaatcacactgatatattgtactatgcatagaaagttgtaggtggcgttcagggaagactttgattttaataaagcaatatttagtattgaagacaaacactttttattttcagatttctgccaagtaaaacagaaattgccaataaaataatcagtattttgtaaatggcaggcaagcttctggctgtcgaaaacatctgagtcatttattcagtagacaatatgtccttgatccaggttctttgccagctataagggaatccctgtccttgagaggctcatagtctataagtaacattacagaatttgttagcatacccattcattattagttttacctaaacgtgttaggatcactactggtggaaattgtaaccagcctttgggcatcttaaagggtgacatgtggcatgcctttttttttttttaagaatttaatgtttttcaagattgtagtgttgatcagcgcaacaattcaagtgtgcaaagtaacaggatagtttgcctcttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggcccaattctgggcttctctgagcaagtccagagcctaattaactgtaaatttgttgtcaaaaaggaagaaaaaagggcctgagatacctctttgcatgtgacctgcattcactaaggatatctggaaaccacccttcctccgcaaaccctctcagcaacatggtgtccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactgctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggccagtttctttttttcctgttgtgagatgacattgctctgacaaacatgctatcgtgggttacctgacccaggcaagtccttttttatcaccgtattaatactcttagcaccaatccttttgcaactgatctccaaagcaaaatagaattctaaatcttagctcacttattttaaataaggcatgcaatagaattcgagtgccaggagaggatttgggtcatctcatagagcttattcctgtggcttttacttatttttgggacagtctcactctgtcgcccaggctggagtgcagtgatgcaatctctgctcactgcaacctccgcctcccgagttcaagcgattctcctgcctcagcctcccaagtggttggaattacaggtgcacaccaccagtcctagctagtttttgtatttttactagaaatggggttttgccatgttgaccaggctggtctcaaactcctgacctcaggtgattcgcctgcctcagcctcccaaagtgctgggattacaggcttgagccaccatgcctggccctcgtggcacttaaacttttttctctcatttgggaaaattgattttcccagtgctgaggagaggaccaagtagagcttataacgcttagtctctccctgctttccctagagcagttccactctgcacttcgtgtattttccttactgataagttgcttcaggaaggggacagatttgctgcttttaaattttaaaaaactaccattataaatgaccatgtctgctacttgaggtttatttagatcatagtcagaggttcccaagtgtaatagaattgggtcatatgggattctaagccatacttagttttacgtaagaaaagaggaaatagaacattttaagttttgctctgattatgttttatgtcagagcttgtcgttttatttaatggtcatatagtctagctttccttaaagatacgtagatttaaaagccactttagagataaggaaaccaagtttaaaagagatacgcagtgactcatgcctgtgtaatcccaacactttgaaaggccagggcaggaggatcatttgaagccaggagtttgagaccagcctggacaacatagcaagaccccatctccacaagccaaaattgaagaattagccaggtgtggtggcatgtgcctctagtcccagctactcaggaggccaaggtggcaggatcacttgagccccggagttagaggctacactgcactccagcctggacgacagagcaagatcctgtttagaggttaaattcccagagtcataccac

SEQ ID NO: 37720 - DNA, 414175 bp, Homo sapiens
cggtgcggttccgccgggcgcgaggagccgccgagacctccgcctgcgaacaaagaggaggccgtgcggggcgcggcgcccgcggagcatggcggaccgcagcctggagggcatggcgctgcccctggaggtgcgggcgcgcctggccgagctggagctggagctgtcggaaggtaaccgggcccccgccccgggccgggccgcgctgtcaccggggagggccgcgcgcggagggctgggggcgcggggcctgcggcggggcgggggccgggcccggagggggaggtgcgaccccagcccggagcgtgcgcgtcccccggacccccagaccccgcgccctagggacgtttgtgaggccgcgatcccccgcgctctggggacgtttgtggggccgcgattccccgcgccctgggggtgtctgtggggcctgggatcccctcgcgctctgggggtgtttgtggggccgcgatcccccgcgccctgggatgtttgtggggccgcgatccccccgcgccctgggggtgtctgtggggcctgggcgccgcgcggggacgcaggatgcagcgggcccggcgggatcggccttcccgtgcgctctgcgctggagccgcggcgtccttggtgcagcagcgcggtgcgcgccacctcctcgctggcgggttcggcctggaacgcccggccagatttcaatgcgaaacttgtcgttggaccccgggttcgatctctggtggctcaggccgtgcagcggtcctggcgcggcccgggggatcccacccccattgttcgcgggcgctgcgcggggagggctgggcggaatcgtcaacctccccccgggccgggctccggccttgccgtcctggtcctctcgtaggagggtttgtggcagatcagccaccgcggtcttatggagggttgtgtacgcctcttatttgctcttcatggcggagatcatgtgctcaactgtcataagtttcagatcgggctttgccaggtcttttccccaaaaccactgaagttcccaaatctgaaatgtttgatgtgcatttagccgtctctgggctcatcctggtcaggccattcctgtaacgtggggtggggtgggggtgggccggcgcgtctcacatttatatttggagcagtttagcatggtgaactttttttgggtaacggttttgtgagggccggcagccagaaagtaaactcattcgtgccaattttcaccggcagggaggagctggtgttgactttatgttttcctttttaacactttcagggcaaagaagggagtgagcaggggccatggtgtgcagccaactgcctttccagacttctggggacgggaaatggtactgtttttcagtttcagatgtggggttccgcgaggtgtgtcagtgtcctgtaacgtgacacagttggcggggggcagagtcttccaggcctgtgggcttggctgctgccctcctgaggagctgaggatgaggagggcatggctaggaggcgggagctgccgtgtgcagggttcggatgtaaactggtaagtagattgtgcagtgcagacagctcgtttggtgggtaaggagtgtatcatttgcaaaaggcccaccctggttatctgattgtgtcagccttgggtaggtttcccggcttgcgtctcggcccaggtgcacccctgcctgcagcaccctccgtgttcgctgtctcaggacaggggcttctgtgctgcctgcatcacactgatgtgaagtgtcagtgccccatccaggtcagcagagcgtagcgcccctgagctcagcagggcgagccccatctgagggttcccccacccactgctagcccagaagttggacccacatttgttcccagagtctgggatgtctatgggaatgggtgtcctgtgttgggcattgtggccttttgaggtgacgacacttgcctgtcagttgctcttggagggtgagtgatactgtcttgctgcccagatgatggcaaagccactttcgacgaaggtgtgctcagccgaattccctgtgaacaccttgcgtctgtacaggttttttaaaaagggcttaatgagttagtttcttattgagagaccaggcagagaaaggggtgtgtgtgtttgcatgcaggaagcctaattatatttttccttccacatgaatcttgctgagatctgagctacacatttaagaagaaagggtgagagggttgctccgtggctctattcagcctctctgcaccctccggcctgtgctggccccactgcctcatctgtttgctggatggtctttaactttgctgtgaagtgtgggtttgcccaggttgagtttatgggggtagtgctgtaaggtcatttggaattctctgtctcataaccacataaaacagttttacaggcttaaattagatgaatcaacttgttttccagtattgcttaatagaaatccaagaattgaaggatcaaaattctgtgtttctttatgttattggacttcaaaaattcctcaatgtatctgctttcagagtgaaagctgaaaacagctgttaatgctgaattatttcccatcttcaatcaaaattcaagtggagagaattctttaagttggttgtcatcattttattaaaatatcagaaaatattatagaaacatatgtggaatttccagtgctcatttcctacagaggaggatggaaaaagttccgttttaagcacataacatagactgaaggaaagagtagagcattcccctgaggttcctgtgtgggctgccagcctgcgtgggttacgcattgtgtgggtttctagaccctggtccagttctgctgtgcccgcctgctgggcgccattacatgcactgctggtgtcctgctttgcagggctgcaggggcacttcctgctgcggggccgagggctccatccttcttccactgcctgtccctgtcccgtgccctgtgccccctcacaggggaaggtgaggccagctcacaccacagagcatgcggccagcaaaacacaagggctctctgtggggagaagtgctgggcagccctcttgtgggagctgatggcctcgaatccatgtggggatacattcaggttgtgtggccaggggggtcatctcctcacatacttgggtctgagtgtgagccagggaggaggccatgcaggtaaggaggccacacggtcaggaggctgtgtgggtggggaggttgtgcgggtggggaggctgtgtgggtgcggaggctgtgcaggtggggaggccatgagggtgcggaggcccctcgggtgaggaggctgtgcaggtggggagaccacgtggggggaaggctgtgctagtggagaggccccgcaggtggagaggccgtgagggtgcggaggccctgtggctgaggaggccctgcaggtgaggaggccatgagggtggggaggcctccaggtgatctggagctccattctggggagggtcaaggaatgagagggctgtggcggctgctttctcatactcctttccccagaatattttcttctcccttctcttccctacatttttgccctttataattgggtattcttttttgtggctttaaagggcctaaaaataatttcattaataactgatactttacatggaattgccaaacaaattggagtggaagcagaaaacttccccataaagacaaactcatgtcttatttattttttaatttttgagacggtctcactctgtctcccatgctggagtgcagtggtatgagctcaactcactgcaacctccgcctcctgagttcaagtggttctcatgcctcagcttcttgagtagctgggattacaggtgcccgccacaatacctggctaatttttgtacctttgtagagatggggtttcatcatgttggctaggctggtctcgaactctttacctcaggtgatccgcccgcctcgacctcccaaagtgctgggattacaggcatgagccactgtgcccagactcatgtcttattattattattattattttaaaaaagattgcatttagctgttgattcaaattaggaagtaagtttctctgttgactggtcactgatctttttgggcagtgcatgcttcagaaggagctctttcccatttgtttaggaggtgctgaattattttgatagaactcataatatagcctgcaaaaattgttggtttttggtggaagagaagttttgaaaaataggtgccatgctttgtactctgtggctttggtaattgtcagcgtgttccatgcccactgactccatcctccatgctctgctctgctagttaatgtagccgattccttcagcgagcagttatgctccacagtagtgcagcctaatgttttttcagcaggggagaacctgcttgcagagggaggtgaaggctcgcgcacgtgccaggtcttcctgtgttggttgagggacctgtgtgcgtgtgtttatatatatatatatatatatgtatatatatatatatatatatatatttttttttttttttttttttttttttggggaccaagtttcactcttgttgcccaggctggggtgcagtggtgcaatctcggctaattgcaaccttcgcctcctgggttcaagtgattctcctgcctcagcctctcaagtagctgggactacaggtgcccgccaccacacccggctaattttttgtatttttagtagagatggggtttcaccatgttggccaggctggtctcgaactcctgacctcaggtgatccccctgcctcagcctcccaaagtgttgggattacaggcgtgagccaccgtgcctggctgtgtgtgttactgttagcacatatgaatacgtgtcaagtacagagacatggtcttcacacagcctgcacgttgctgtcgccaaagaggggatcctaaaatgatggcccagtgggaggtttgtaggttttgggggtggctttttcaggacacttggcacaaggtcacagatatttgtggctttggaatggagttctgccctcggcacccccagccctgtgcatttcttggaggttccaccctgcacagtgaggaagtcacacgcctgtgtaagagctgaccaggggaccaccttccagagcctaagagaaggtcctgaggactctgtacacattattttcattgaaaagaaatagtttactctgaaaaaacaaacgtgggaaagctgagcttcattgagcctcacggacagtttgttgtaactgagaggagggtaggagggtcagtgggttcaggagggtgaggacttcttggccaggtagcgttgttacatctatctgaaagtcacagataactaagtatcaagtcgtcacagatatttaagtatcctgaatgagatggctacctgcatgatgcattgaaaacatcattactggttgcgtgcaagatgcattgaaaacattgtgacctgcacagtggcagcactgatatgtgtgggcttttgaacgtgtggactggaatgttaagagtccttcagagttatgacaatagtttgatttgaatgttcttttcttggcgaataaatgctatacatcaaatttagccaggaagctaggaaagcgaacccacatgaagggcacaggcccataggctgctccaggtgccgttaggggcccgagccacgcgcttcccgctcagcctcctgagagccatgacggcgtctctgttctgcctcacactggacttgctagtttcatattcttgttatggttccgaggctacaagcggttggattctgtgagtcactgtcttcctcctcccagctgctttcaaatgggtcgtctctttttttagaactgattttttttaatcagtgatttatggggtgagttgtagcgctctcctgaactgcagagggagcgcactgaggaacctgggttttgatgctgtgcacattggctgagtcaccagcccagggccccgtcagtcccattattaagctcatttcttgctcttctcatcgttactcagacgcctttaaaaaagcaaactcctgcttgccgtcactggctgtttggcaaatgggtgtttaccctggaaagacgggcattttgtcctctggaacgtctatggcgccctttggtgacgtggtcggtttctgaccactctatcttgtgggtgtccttcctgcttccaccttcccttcccgaacgcctccacctccagggctttaatcttccttctgtgtgtgtgccatgcagggtttatgactattgtgccaaaaacttgctacatctcaaaagaagtaattgcatccatttgttggtgatgatcataaacagtgccctttaagggagactaattggtaaacccggctgctgtgggtagaaagacagcggtggctgcggaacgagggctccgcctcttcggagcctgcacaaccgtcctgccttctttcttcaatatccagtaggggagttaattttaataagcccttgaaagcaacaaggcaggaaagtgctaagacattgagttgtgagatttacaattacaaccagcagcctctcattttcccttcgctgggggttgctgcttcggttttgggctgcggggtatgttggtagtgacatcggccctttgtgctgcgcgactcatgaattgagataactttttactaagtgctttgtgcagtaggtatgaaaatggggaaagaaggaacactgtccagggtagagaggcgtggagagatgctgtgactgatggtaggtcttttcttttgggctcctggttttaaatcattttttgtttcgctaatagcttggaagatggtttttgtgtcttaattcaaagattgaagactgtgggccggacccaaactaattccattggcatcagagagagggattctttacatatttatctataggcacgattgattttttttttttgctgaattatctggttagtcaaatcatatattagagaagtaatataccattaaaaattaaaaaataaaaaatgtatctgtaaacatatcccccttccattccagtctttgtctctgtgtaattttagaacccttgagccatgacgtacatagagtttgtattcttttaatatcttgctacttcatcgttttaatgtttaatctttgggttgatgtatcacagtttacttgaccatttcttacaggtgtttggtttagtttttttttttcctttaactttaatgtaaatttgggtgtttggctggtagttttagcaggatttaaggcagagcctcagttaaggccttgtatcgatttatggtccctagtttgaggagggaggtggcaatctgccctttcttctaaaattggtatgttaaatcacaatggacatttacttgattttgagcacttggggctcccctggggttcactggtgttgcaaggtcagggctggggatcttctgctggagaggccccagtgtgcccagcgcagggtcctgagtgcgttgctgcaggaagaagccctggcctttgtcctccagcggccgttgctctgggaagagctggttgctccaggaatgaggtctatgctctgaagcccatggtcagcagaccagcaaaggtcagcacagaagaccttattatgtgaatcattcatttaacaagcattcatggaatacacactccatgcagttggaacttagagtggaaggccatcagctcactgttgcctgagcagaggcttggtctctgggtccctgttgcagcctctgctcctaggagatacacggtgagtgttggggggccctccacaggcacagttgccgaacagggacctctcccaagggccttagccctgggccctgagctctgaagaggaggaaggcgttcctggggccaacttcccttctggatgctgagctctgcacagagagaaactcttccacaatcactgcagtgaagttcataaaacaaataacactttagagactggggtctgcattccctggaatttccgtggccgtagatggtggctgtaccatgtgactgagggtctgtgttccctggaatttccgtggccatagatggtggctgtaccatgtgactaagggtctgtgttccctggaatttccgtggccataggtggtggctgtaccatgtaactgaggggctgcattccctggaatttctgtggccgcaggtggtggctgcaccatgggactggggtctatgttccctggaatttctgtggccatagatggtggctgcaccatgtgactgagggtctgcattcctcggaatttctgtggccatagatggtggctgtaccatgtgactgagggtctgcattccctggaatttctgtggccacaggcggtggccataccatgtgactgagggtctgtgttccctggaatttccatggccataggtggtggctgcaccatgtgactgcggtctgtgtttcccaatatccgtggccatagatggtggctgtaccatgtagctgaggggctgcattccctggaatttctgtggccacaggtggtggctgcaccatgggactgagggtctgcattcctcggaatttctgtggccatagatggtggctgtaccatgcaactggggcctgcattccctggaatttccgtggccacaggcggtagctgtaccatgcaactggggcctgcattccttggaatttccgtggccgcaggcggtggctgcaccatgcaactggggtctgcattccctggaatttccgtggccacaggcggtggctgcaccaggcaactggggtctgcattccctggaatttccgtggccacaggcggtggctgcaccatgtgtcaggtcctctgtctcaggagttggtgccattgtctctattactccctcgcctgacacagagcggcagttcttgactttaccactcccaggaagcacacaggcaaaacaattcagaacaatctgttttgaatccttgttttatttccccattccctttctcatcgcatggaaattcacatccctgtaaagctgaaaatggtgtggatctcccctgatggtctttccaaggaattatcagcaggtaaactagaccgtgtgggccagtttacctgaaatgaaaacagaaacgtcactgggctttgctgggagattcagcgtctttgtcagtgatagaatcatcctaagcaggttgtttgttgtgctgcagatccacacggttagctgtgtcaggattaaaattacccagtgcggacagtgtagcttaatcctcatggaagggtgtcaagtacattgaagagcagctgccgagcctgccattgttgggagaggggcaggtgcatctctcgcttggcccagtgctgcaggaggccgggctcatgtcaggccgtgcgtgtgagcgggttggatttttagcatgctgggacggtaaagcacaaacatctatttttaacttgtgggtgaccttcttctgtgctgcttgagtctctgtgggcctttctctgcttccttcctgaggagtctgtgccagggtcccaagcgttctctgggctgcacttctgtgcctgcctgctcaggagcctcctcctggtggctgtgggaccgggctgggcccacactgtcagcatcgtccagggtaagcaagcccatccctccccacctcagtgtccccagctgttgaatggggctaataaaccgactgtcaggattaatgtggatcagatgcgctcatctcacagccctgcttggtaaatagccgcttccactctgtcctccaatgtggtcctccatttattttctttacctccatttatccaggcgattccaggtgacagtgactatcaagaagggcgtacagaggaaatctgtggaagggagctcgaggagcagatatgggcgcagggaacgcagtgcggggagcacgggtgcggggatcatgggcatggggagcacagatgggcgtggggaggacggatgcagggagcatgggcatggggagcacagatatgtgtggggagcatgggtatggggaggacgagtgcggggagcacgggtgtggggagcatgggcatagggagcacagatgggtgcagggagcacaggtgtggggagcatgggtggggggaggatgggtgcggggaggatgggtgcggggagcatgggcgtggggagcatgggcgtggggagcacgggtgtggggagcaggggtgtggggagcaggggtgtggggaggacgggtgcagggagcctgggtgtggggagtacagatgggcgcggggagcctgggtgtggggagcatgggcgcggggaggacggatgcggggagcatgggcgcgaagaggatgggtgtggggagcatgggcgcagggaggatgggtgcggggagcctgggcgtggggagcagagatgggcacagggagcacgggtgcggggagcaggggtgtggggaggacgggcgcggggagcctgggtgtggggagtagagatgggcgcggggagcctgggtgtggggagcatgggcgcggggaggacggatgcggggagcatgggcgcagggaggatgggtgcggggagcatgggcgtggggagcagagatgggtgcggggagcacgggtgtggggagcatgggcgcggggaggacgggtgtggggagcatgggcgcggggaggacaggtgcggggagcatggacatggggagcagagatgggcgcggggagcacgggtgtgaggagcatgggcgcggggaggacgggtgtggggagcatgggtgcggggagcatgggcgcggggagcatgggtggggggaggatgggtgcggggagcatgggcgtggggagcagagatgggtgcggggagcacgggtgtggggagcatgggcgcggggagcatgggcgtggggagcatgggcgcagggaggacaggtgcggggagcatggacatggggagcagagatgggcgcggggagcacgggtgtggggagcatgggcgtggggagaacgggtgtggggagcatgggcgtggggagctgggcacagggaggacaggtgcggggagcatggacatggggagcagagatgggcacggggatcacgagtgtggggagcatggctgcagggaggacgggcgtggggagcatgggcatggggagcagagatgggcgcggggagcacgggtgtggggagcttgggtgcggggaggacgggtgctgggagcacagggtatggagagtgcgtgtgtgcttcctctgctctgacagatgctgccgaacacgtactctgtgctcagatgggtcagagcctcagtgcctcttttttaaaaaattctttctttttttaaagataggacttctctcttcctggtggccccttttagtcgatactcttttaagcctgcttttccagaggaaagctgggaaggatggcctatataggttccagtctgggcatatctggaagaatggcctgttttaggtttgagtctggtgtatctggggacatctttaaacttccactcagagttccagagccacctgtagggactccccaaatgtctgctgggactttccccactgctcggggatgatgaagagcaggacctcaccctgccacgacctctgaggtcctccttcctggagggcagtgccttggtggccagtgtgtgcaggaggctgggctggcaccttcgggctatgctctgcagcgggggctcatgacatgggcattcttgtgctctgcactgggactggtgacgtggggcatcctcatgcactggaccacgccgggtgcacatgagccagacagctcctggaattcggagcctggctctgtctcaggccacccacctgtctgtggcacttctgggggattgtggggactgtatgagtctgggtctccaccctcactggctggacacctggccaggctggggctttatgtttcaccatcccctgttccgagttgtgtgaatatttattttcattacctactctcataagctttcctttttaaataaaaaaatcagagacagactttgaagttccctggccccaccctttgtggacctaatggtattgcagaaattatggcttcaactatgtataataactgggactactttaaaagtaacataaaggaacaaggtggagtgtccgtttcaagcagtacatcatgctggattcttaagtgaacattatcaggctttcaacacattttctctttttatttactttggagaatataatggatactcagaagctgttgggatttagtaacaggaagtcatccttaaggagctatttaagcaagggggcagttggagtaaatgtaagttatgaacacacacctattccaaaccagagaaataaaggcttcaattgtgctggggttgaaacttggtggctagtgtgtctttcctgcccacagtgactgtggcagtgctgtgggcaggaaattctggaaacaagacttggtgccagtggtagtttttgtggtgattcatttgctttcagctcaagtgactatagtcttccttgcaagtggttaggtctccaccaatggaccacaacattgacataggacaaatgagaaatagcacttgggtttttaacaattattctttttaatggacacattatagtacatatctatgggatacagcgtgatatttcaatacatgtttgtcatgtgtaattagcaagtcagggtaattagcatgtccatcatctcaaacatttgttatttcttaatggtgggaatcttcaaaatcctctcttctagctgcttgaaaatatacaataagttgtaaactatagtcaccctacaaggctatagaacactaaacctcatttttcctatctagatgtaattttgtatccattagttaacctctccctttctcccttcccgccaccctttcctgtctctagaatccactattctaccctcagagggtagaatattattttcctcatagagatctttaaccctcttggttagatttcttctgaggtatttttatttttattttatatttttgtagctaaatgggattgctttcttgatttctttttccactggctcattgttggtctatagaaatgctactgatttttatatgttcattttgtattctgtaagtttactgaatttgtttatcagttcaaagagatttttgctggagtcttttttttttttaatatataagagcatattgtctgaaaacagacaattagagctcctcctttccactttgggtgcccttgatttctttctcttgcctgattgctcttgactaggactttcagtactgtgttgaataggagtggtacaagtgggcgtccttgtcttgctacagatctcagagaaaaagcttagtgtttccccgttcagtattatgttagctgtgggtttgtcacatatggcctttattgtgttgaggtatgtttccttcagtgcctagtttgttgagagtttttatcatgaagcagcgctgaattttatcaaatgctttttctgtatctattgaaatgatcctatggcttttgtccttaattctgttgatgtgatgtagcgtgtttattggtttgtgtttgttgagccatccttgcatcctgggagaaatcccacttgatcgtggtgtataatatttttgatttgctgttggattcagtttgttagtatttcgttgaggatttttgcatctgtgttcatcagggatattgacctatagttttctctttttattgtgtccttgtcttactttggtatcagggtaatgctggccttgaagaatgaacttggcagaattccatcctcttcaatatttttggaatagtttgagaagaattgaaataaaaatttgtagaattcagctgtgaagccacctagtcctgaggttttctttgttgggagactttttattattacttagtcatacatgttactcattattggtctgtttaggatttccgtttcttcttggttccgtcttggtaggttgtacacgtccaggaatctatcgatttcctctaggttttccactctgttgacatatagttgttcataatagtctccagtgagcccttgtatttctgtggtatcaattgtaattctctttttctgtttctaattttacttatttgggatttctttttttttcttagtgtagctaatggtttgtctattttatttatcttttcaaaaaaccaacattttttcccatcttttgtattttttagtttaattttatttagttcctctttgatctttgttatttcttttctcctaccacttttggatttgatttgttcttgctcttctagctcattgcagttcattgttaggttgtttattttaaatcttttttttaatgtaggagtttattgctataaactttcctcttaatactgcttttgctctataccgtaggctgtgatatgttgtgtttctgttttcatttgtttcaataaatttttaaatttccttcttaatttcttcattgacccactggctattcaagggcatattgtttaatttctatgtatttatacagttttgaaagttcttgttgttgatttatagctttattctgttacagtctgagaatatcctagatgtgatttcaattttaaaaaaatgtattgagacttattttgtagcctagcatgtgattgattctagagaatgttccatgtgctgaggagaagaatgtgcattttgtatctgttggatgaaatgttctgtaaatgtctgttaggtccatttggtctatactgtactttaaattcgatattttgttgttattttctgtctagatgatctccagtgctgaaagtggggttttgaagcccctactattgttgtgttggtctctctctctctctctctctctctctctctctctctctctatatatatatatatatatttgagatggagttttgcttttgttgcttaggctggagtgcagtggtgcaatctcgactcattgcaacctccacctcccaagttcaagtgattctcctgcctcagcctcccaagtagctgggattgcaggcatgtgccaccatgctcggttaattttttctatttagtagacacagggctttaccatgttggccaggctggtcttgaactcctgacctcaggtgatccacctgcctctgccccccaaagtgctgggattacaggtgtgaggcactgcaccccgcctctctatttagatctactaatatttgctttatatatctgggtgctttgttgttgggtgcacatatatttgtaattgttatgtcctcttgctgtgttgatctccttatcattatataattacctttttgtctcctttttacagtttttaacttaaattgtgattaatctgaaataaatatagctactcttgctcacttttgatttccattaatgtgaaacatgtttttccatccttcatgtttagtctatgtgtgtctttacagctgaagtgagttttttgtaggcagcatagagttggtttttctttttttaaatccactcagccagtctatatcttttaattggggtgcttggggttattttgctactgatatcacagtccagacattaagattttctcacttagttacttgtacacaaattaatatgaaaaggaagtagagtttttcttttgtctctttgaagatagtgatggattattattttgatttccatacaagtgagggactcaccgtccctgttgggattttagaattcatttcctgttattaggaacagcaatgatctgtaatgggttcctggaatcctccagtgatggtctcaatatcttaaaagtttcctttcatgcctcattttctgtttcgcccctagtagccacgcacctggggcaggagacggccttgcatttccttgttttcttgatgactggttaggtttagtgtttgacacagttaggattctggataaaatcagcccttctgggaagtgtgtaagtcaaacaaggacgttctggtggcgttatacaggtttcccatgccccatgagtacaggaatagctccctggggaaggagtatgggcacatgatggcagggagccattcttggatggccccgtcttctgcaggaattctcatgcagggagaagcagcacacggcgactgagcgggtggggattctgctgatagttttgattgttatgatttgctcctgaaaggtgatgtgggatgaagagcaatatttagaatgctgacattccttgaaacaaagatatagaaaaaatcttataattgtagggtgccttttagttttcagccgctctcatgtggatcctttttcgtccttctgaaatgctttcccaggagacagcattgctctctttgtacagatgaggagactgggtttcaaatggttaggaattcatcgcaggcattggaatctttggtttcctggaacattttctattcaagtatagaccacgtggcctctaaaggctggctcactcttaacaccaagattggggatccagcctcacctctggggtgggcggcaggagctccacagccatcctgggtgctctggggtggggtggctgagctgtggcagcccctcccagctgagcagcaaggccggggaaagctcattccatcccccttggttctaaccaggtacaggcttacactgcacatttccttagctgggaacctttagaactttacatttaaaatctaatctgtgatccagggggttgatacatgggtattcactgtacaattcctacattttttgtacatgtaatttttttttatgtgtgtcatggatgacaaaagaaatgcaacccctccgagttagcttttctgtatagcaccttctagaatcaggaggctgggcagggtttagtttcatcagaaatctttatgtttctggtcaagagacggcactattaaattcttggttgtgtggtttctggaaaagaaatattctaaatgagttccaggaatcacctctgtggcatttctacaggaaaagtgaccactcttgaagcttcgccatcactcacaagaatgattgtgatggtttctaagcggtcgccagccaatctttagttcttttatgcagagtgctttcattcgaagtgaagtgcccttctgtttaatggtgacctccagttattacagggattgcagccgcatttgatggatgtgaacctgctcatctctggctccccagcctcgcctctggggtgggcggcaggagctccacagccatcctgggtgctctggggcggggagtccctagtgggagtggacagtgcatggccgggacgttcctgtccgatgttccacactggcgtgtgcgcgtctctggcctgtttccttcgtccgtgggtctgtggcgttttctccatgcgtgcgtgtgtggcctgttttctccgtgcgtgcctctgtggcgcgtttcctccatccgtgcatctgtggtgtttcttccgtccctgcgtcggtggtgtttctttcgtccgtgtgtctgtggtgtttcctccgtccatgcgtctgtggcctgtttcctccgtccatgtgtctatgacgtttcctccctccgtgcgtctgtggcctgtttactccgtccgtgcgtctgtggcgtttcctccgtctgtgtgtctgtggcctgtttcctccttccgtgcgtctgtggcttttcctccgtccgtgcgtctatggcctgtttcctccttccgtgtgtctgtggcctgtttcctccttccgtgtgtctgtggcctgtttcctccttccgtgcgtctgtggcttttcctccgtccgtgtgtctatggcctgtttcctccttccgtgtgtctgtggcctgtttcctccttccgtgcgtctgtggcgtttcctccgtccgtgcgtctgtggcctgtttcctccgtccgtgcgtctgtggcgtttcctccgtccgtgcgtctgtgacgtttcctccgtccgtgcgtctgtggcgtttcctccgtccgtgcgtctgtggcgtttcctccgtcggtgcgtctgtgacgtttcctccgtccgtgcgtctgtgacgtttcctccgtccgtgcgtctgtggcgtttcctccgtcggtgcgtctgtgacgtttcctccgtccgtgcgtctgtgacgtttcctccgtccgtgcgtctgtggcctgtttcctccgtccgtgcgtctgtggcctgtttcctccgtccgtgcgtctgtggcgtttcctccgtccgtgcgcctgtggtctgtttcctccgtccgtgcgtctgtgacgtttcctccgtccgtgcgtctgtgacgtttcctccgtccgtgcgtctgtggcctgtttcctccgtccgtgcgtctgtggcgtttcctccgtccgtgcgtctgtggcgtttcctccgtctgtggatctgtggtgtttcctctgtctgtgagcctgtggcctgttttctccgtccacgctggaggccgtcgcttctctctagtcaccacttactgatcgctgtgtgctgagcctgtgtcaggcgtgtggcatgtgtcccctgtgtggcaggggtttgcgtgacacacagggacacacgctcggggagccgcagggatggggtcatagccacgtagcggagccctcggtctgaggggcttggtgcccacccagctcttcctgaagcggcctcggggcagatcccagctctgcttcctctcctggaggcacctcatgaagtaaattaagcaaatccaaggtaggaaacggttttgaaatgagacctggtttcaggtgtgtgtggtcatttctctctacatgtttacttcatataccctgaatgatatacttttccacctggtataacaattaattaccagccattactggtacaaaattccatgaagaatatttgaggaagacatagtctcaaaaacatgcttcattttcacagctgtgatttgcatggtaaagctgtcaggactgtgactttcttttgttatcttatatttttagacccttgaaaggaagttatttagtgattacttaaaattgtgaaaataatctaatgattagagaatctcattagaacaagtattatattttctgttccttatgtaaatgaaatcatcttaatccaggccgatgttggcaggaatggtcacgtttaaaatggataagatgttaatgtgatgtgcagccgtccccctatgttgtctctggaacattccagaacatccatctcaattctcacttgttgacaccctaccctgttttgtgattattcttgtttgcatcagaattttgaatccacgtacctgagatgatacttacgtatgcgtgtacacatgcatgtgtgtgcatgtgtgtatgtgtatgtatgtgcatgtacgcgtgcgcatgtgcatgtgtatatgcatgtatgtgcgtatgtgtgtgcatgtgtacgtgtgtatatgcatgcgtgtatgtgcatgtacgtgtgtgcatatgcgtgtgcatgcatgcgtgtgcgtatgtgtgcatacatgtgcacacatgtacacacgtgtacatgttcatgcatgtgcgcacgtgcatatgtgtacacgtgtatgcgtgtacatgtatgagcatatgtacacgtgtggatgtgtgtgtatgcatgtgtgtgtgcacagatatgccttttcctttcatacaggctgttttgagtattgctgttaggcagtgacaactttccgtttcctcagtcagaaaatgggtagctcatcattaataaagatgaacattcgatatcaggaatccctaaaaacaatggaaattgtcatattaaatgaataaattccaaaacaaagatagtgttctgtactgtgtgtttacattgaactttcttataaacattggtatgaatgtttcccacttattggaaatcacatgactagtttaagctgaaacgtggaatattctgtcttcagatcacttttgcatatttatgattgatctgttctgctgttctggaagctctgaaaaccactcggtcttaccctagctggtgccacagttgtgagaattcagggaaacaaggtgtttgccagtttaagtattttagatgtcaagctgcctcttacctgcatcataaaccagtcttaaagaaagacacagtgtgacttgtagtggattatatcagttttattttctgtggctgaatcatcactctacattgtgaattaatgttatttttcggctcatcttcataatgcagggaggttctccagtgttgagtgcaggttcagtgaaagcgctaacactgttaccacgggcttaaacggacttgttttctgaggcgataaccctggagtcaggcattcagtgtctgcccatcacttggttccgagttctcggtcccctcttgctctcctccccccgcacccccttgcttctgtcttgtcttctttttgactaacaggccctctgcagatggtgtgttgggggccggggtctgctgtgagtctttgataaccttgggaaagaactttttctttggagcaagacccctctcaataaactttcagtagcccaactattgtccgttgtgtgaactatttgtggaaaatgctcagcatttttccttggattctggctgatctttctccacctgccaatttctcctcagtttgccgtgtctgtaccgtcaccaaccccgttccagccgcggttacatgtaaagtaattgaagcagagctctgcagatgagagagtgtgtgtcgccccccgagttcccttcctggcctctgagtgtgagttgtgttttgttccgagggatgactgaggctcctggcccctgttttggagcaccccacaccaaagtgggtgtaaaatgaaaaaagggtttatgctatattattgtaattcatggagcagatgataaacatgcttgaatctgaacagcagctgaaaatgaggacatgttaccagtttggatgttggatgaccttcttgaaaaaagcttttgtcatactttagaaactgtgcatgtgctgttttctatttcatacttagaatctgtacagtatgtgttgtatgaatgtgttgtatgagcgtgttgtgttgtatgtgagtggcatgggttgtatgtgtgttgtatgtgcatgttgtgttgagttgcattcattgtatgtttgagtgttatgtgttgtatgagtgtgttgtacatgtatttgtgagttgtatgttttgtatgttgtatgagtgttgtgttgtatgaatgtgtgttgtatgagtgttgtatgtgtatgttgtatgagttgcatgtattgtatgttgtatgggttgtatgttgtatgagtgtgctgtacgtgtttgtgagttccatgtgttgtatgttgtatcagtgttgtgtgttgtgtgagtgccttgtacatgtatttgtgttgagttgcatgtgttgtatgttgtatgtgttatatgttgtatgttgtatgagtgtgttgtacgtgcatattgtgttgtgagttgcatgtgttgtatgagtgtgttgtatgtgtatgttgtgttgtgagttgcatgtattatgtgtatgcaatacacatatatgttgtatgagtgttgtgttgtatatgttgtatgttgtgttgtgcatgttgtgttgtgcgtgagttgcatgtgttgtgtgtgttgtatgagtgtgttgtatgtgtatgttgtgttgtgagttgcatgtgttgtctgtatgttgtatgagtgttgtgttgtatgagtgttgtacatgcatgttgtgttgtgagttgcgtgtgttgtgtgtggtacgtgtatgtcgtgttgaatgtgagttgcatgtgttgtacatgtgctgtatgagtgtgttgtatgtgtatgttgtgagttgcatgtatgttgtatgtgttgtgttgtatgagtgcattgtatgtgcatgttgtgagttgtgtatgttgttttgtatgagtgttgtgtgttgtatgtgcatgttatgagttgtgtgtgctgtatgagtgcattgtacatgtgtgttgtgttgtatgtgttacgtgtgctgtatgtgtgtatgtgttgtacgtacgtgttgtgttgtgagttgcatgcattgggtatgtgttgtatgagtgtgttataaatgcatattgtgttgtgagtagcatatattgggtatgtgttgtataggttgcatgtgttgtgtgtgttgtgtgttgtcagtgttgtatatgttgtatgagtacattgtacatgcatgttgtgttgtatgtgagttgcatgttgtcagtgtgtgcgttgtgagaggcgggggcatccacgtgactgctcctcagcaagtcctgccgtgcagccccttctgagcgtgcgtcctcccgagtagcctagaagcagcagcatgtttgcctctgcccctccccaggaggcctcagccaggtcctgtgctcagcctgccgtgggccatctgcctctctcgtctctctctcgtcgtcatcctgcgcctcctcccagtcctgagtagctgggattacaggtgcctgccaccacgtctggctagtttttgtattattagtagggatggggtttcaccatgctggccaggctggtcttgaactcctgacctcatgtcatccgcctgcctcggccttccaaggtgttgggattacaggcatgaaccaccgcacctggtccgtctgccttttagttacaacctgtgtgttttctgttttaaatttcatttttccaggtcagagcagtagtttctttttcgtggtgttgctgtgaatgtctgttatgattaggagactgggtgggtgccctctccctggtgcctggctctttcacatgaggtgggggtcagcttagctgcttctgattttgggaggcgcactgcttcttggggcagcttgccggccggggtctgcctgtggtatttcctggggagctacatctgtccccgtaggcctggggaagtaggcaggccctgagtacacgcctcaacacacgtgccttccaccagcccccaggcccacgtccagaccccagctgcgtcctgtggtagccagttcagctgctgccaccacgtttattgaacttttaatagctgtgcgcagacaggccacgggcagacaggccacgggcagacaggccacgggcagacaggccacgggccgacctcgtggctttgcttacccccagttctatgttacctgtgtgcagaaaccggctgctcccggagtcctgcaggcttggtttccccggccccgactcaggccacaggatctcagtcttgggtgattctgctgccgcgggccgggctctgggtgccagtggattccccacgcgcggtgttactcccgtgttcacatcagtgcgggagggcggtgagggagggaggcggggacgctctggattcttctccctgctcctcaccagctctgaacgcagaccagccgttcgcctcgttgcttttccagggatgttgtgagtctttcgtgggtagggagtgatgccctttgctttcttctcgctttcccggtaggtgctgaaggaataattaataataataaggccagttcggagaaaacaaaaactcacaattacatatgtcacccggactcgtattattccagatagcccttctttcccacgaactcacagctgctcttcgttcctccaccgtagccacgcgtggagggagagctgcgggacctgggcctttccagggtgctgccggcctgcgttggtgacggccagcgctgagaagttagagcaccccataagtgccacggcaaagacttcggcgtctgttgggggaggaaagcgcttctttgagtgatttccacttgattatttacctcttatcagcagattgtgtggaaggatgagtgaattcagtgtaagatttatggagtgttcctgtaagagataagcctggctcttgttttcctttcgatctcgtatatttcatcgggttcgtttgattgatgtgttttgttttgggaaagcggctgaggaggagtcacgtgagtctttgctcagggattttccagtgtgggaatctggcgctgtggtttcgcgtagcgtttggttctggagggtggaggacgatgtcccagtccgcgtgtgcctcgtcacgtggcggcgaaagcatggattccacgagtcttttgctagagaaaatccaggcgctcccaaccaactgtgtgtgctttccttttggaaatgtctctaactcatatactgaacttagaatttatttagtgtttcttatgtgaagtttcctggaactactgaaaatattttccatgctagatgatcgcgttactggactcacacaattaaaactttttctttagattacataattatttattacctatcccccgtttttcttttcagttaaaaaagcaccacctagaacaatgtcctaatgatgccaccatgattagtgttagaatttagctgtagagtgaggttaataatgaattaacaatcactagtatataatataaagcacggttaaggtatatatgtatattttatgaaccatccaaagcaaaaaataaattagggtcaagagaactcacaggtgcagaagtgttatttttattttctgttttattcaggaaatttaaatctttaaagctgtttttgttttgttttgttttgtttttttaaatttcaaggtcaactccaacagaattgatctgttcctcagcagacctaggggagagtacaggtgctgaacagacctgggtatctgctagtcgcgattcagtagatattttcttgttagttggtaattaaaacatcgttataaaggttttaatgtactttttgagctttattactatatattccttcaggagtctgtgagaactctctactttgttttttcccgtctatttagtattaagttaggagttttaattccttctaccctgatatttatttaaaaattccctatatatttgtagatatatatttggttcattttaaaatgcttgatacattaacattttaaaatatcaaaaatatttcagaatatacattttttaaaatgtaaaaagtaacagtataaaaaattgagatacataaattttaaaaaatcatccttacaactcttagtaccaatgatttctctgtagcattgtaatgttgattaacccggacatataacaatgatcaatagtgttaatgtgtcgagtgtataactgggcttatgtgtgtcattttattggatgatttattaaccacatgaaacagccagtgttacgaaaagggacgtttgaggtttaaagcctttcctgggtcccgctgggggtgaggtgggtctgggcctacccaggactgctgataacagaacacagcggacttggtgatttttagtcaagaactcacagaatttcggtgaatctccccaaaccattccttcttttctctctcctggagcaaaagagaattgttaggttcacgtgttgtgtcttgtgaacgtttatcgattgcaagaccccagagtttgcacaaaaggcagatgggagtttctgtgtggagataccctgagcaacgttgaaaacactggatcctttgtgtccgggcttttccccttggcactacggatgctctggcccagaggagcctttgtgggaggccgtcctcggtgcctgcggtgctgagtgtcacccctgcctcccaccctctggtgtggccccctggagcccttgtggggagcctttgttttttcccgtctttgttttttcctcctgggaggaggctgtcctcggtgcctgcagtgctgagcgtcacccctgcctcccaccctctggtgtggcctcccggagcccttgtggggaggaggccgtccttggcacctgcggtgctaagcgtcagatccctgcttcccaccctctggtgccatcagcatccctcctcccagtagaatcgcccctgcttgagagccgctgccttaagtggtggcgtgagacgtgcaggtttgtgtttcttcattaggagttttaaatttctgaaaatctagttgtgatgactgtgaaacatacctggatgtggaccttcgagtagacaagcttccggatctgtcatggcacacgcatttcaacctgcccaggcgtaaatccgcgtacaactttatttctcagacatctcagccttttcgaggcacggctcctgctgtctttgcgtagctacttatgcctctaaatgcttctgtgtgctggaagctgctgtcctgtccctgcttcctgggatgcagggctgtggaatttctgctgtgttccatgaagggttaaagcattccagggaaggagattctgagatctccctttttaaagacacttttagtcagggaagtgctttccagccatgtccgtctgttctctcctgggatggacagggcagctactgtccctgttcccgagcctcaaaagccattacgaagttccagccaggcctttactttcccaatcctatttcagctgatctcagccttcccttgtagatctttctattcatttagttggcatccttgctttcttgtaccatctcccagttttccacagtttatttacactggacatagaattgcaacagaaactcacccatgctgaggtagggctgccccagggatctccccctctgcagaccaggctgcccactggagagtggtatcactgggtcacggtcaccatctgccccagcagggtccagagtgtttagagtctttcctggacatagaaacccttttgtgtgacgttcagataaaaccaatcagcatgttctgttaatcacagaggtcggagctgagaaccattagcgtacatccacctctcccgagagtgttcacgcctcttccacgtggggctaggctgctgctgagtgtggttctgctggctgtgggtgtggcctctttcctcaaccacagccatcgcaggcctgccacagttttggttcttctaaaagagaataggcaacacaagagaaataagataagttagatttgaaacctttaaaaattatttcctcaaacattgtatatattttctgcccatacctaatttgataacaattttaaaaagatgaaaaagaaaaaaaaattcccccatatcaagtctttgaaaggcatccatcttagtttttatccaatcaattactctctctttggagtcatattttattggtttaagtaatgtgtaacaagtacactggcataaacagatttaggagcaaacacagctgcttcatgattagcgttcagctcgcggggcccagctgtgggggtgcagcctgtgcctgcctgtgcgccaatagggctggtcaccttgaacatccaggagtgtctgggtgagtgaggtctgggcaaggcagcatccatacacctgcgtagttctcactttgtccgcgttatctggcaatgccacaaaattatcaagcaagtgttctccaagtgcgtattcacttagcgtttggaaagtgcataggtacctcatacagtaccttcaggaggagctaggaacccaggaatgagagcaggtgtgaggcctgtactctttgtgtatagataaaatatgcatgtgcctatctgagggcagaaagttagattggggtcagaatgtggaagtccttacctgtcagatactaggaagccactgagggcttcggagagaatcgtgcctttgatgtgcggtatgctgtggagccacgggggacaggccaggctcctgcggggcactcgccatggcgagaggaggagagaaggcagccagtgagctgagcgattcagtgcctgggtcaggaggggaagagggagtgcaggaaggcagatgaagctgtgagtctacaccctgaggtcggcgttgtgctttgctggaaatcaggaggagaagcaagtgtggacctgattcagagatacttagagacaccaccgcaagctgcgagtttggaaatatggaaggaggcttggggaaaatccggaccagggtggatttgggagcctcctacatagaagtgcaggtcaaggagccagagtgtgaggtgtgcatgtcgggagagaggaggccaaaggaaagcccacatttggaaatggaggaagggtcggaagacccagaaaaggccctgcttagagtccagagaagagctgcacggtgcagttccctaaagcccagagccgagagtttccaggacaaagtcccaagtgttgctgaaaaccagggggtgggactccagctggaggcagcgaggggagcctggtggccctgattcctgggagcagccagagcctgggggtcacggcggaagctggtgagaagcgcagggagcaggtggagatggtccttcgaggcctggagcctcacacgggtagccagccgtggaccaagacacagctgaggaggggcctcaacccagagcgtctccaggtggaggagggagccaggaagggcaaaggtacacggaagaaagggggcaggcatggagccaggtccccagggaggctgcagtcttctctctctgttcagggactggttgttggttattctgagttctcaaagtcatccactcggtgcggtccagagaaagatcccaggggcctcaagcctggagcaggccttgtgcttttcccaacactgtgcgtgttgactcagggttactgtcaatggctaattctagtgtgtcttttgttgaagtctgcagaaaagcctcaaccagcaccagcttttgaaggacttacaaaacttgtgttcttctgattctgggatttttgcctgaaatgcctcgtatatttttggctaggtgttgttagcacttgtgttacggcatttggagctctgtatttttgtgatgtgctagctgtgaggatgtttaaaattagattcctagaaatcaggttataggagctctcggccacgcttcatgggttatgttttgacacctcatagtggatcccgttgcggtggctattcttagtatttgtggaacacctgactcttgatgctaggagaatgttatttgttttctttgtaagcctaaagtctaatgaccttgtagagtctttatacccatctcttataaatcagctttaatatgcttgaaaaagtcctcattgtgcccttgaaaagcaggtgcacattttaaaagtcatccttttaaaatccttttctccagtctgtgccctttgtctgtttcgtttccttcactgcaacatcatgaaacagggacaagagctagaatctgtttcatacacagagcttgaaacagggacaagggctagaatctgtttcatacacagagcttgaaacagggacaagggctggaatctccatttcatacacagagcttgaaacagggacaagggctagaatctccgtttcatacacagaacttgaaacagggacaagggctaggatctctgtttcatacacagagcttgaaacagggacaagggctagaatctctgtttcatacacagagcttgaaacagggacaagggctagaatctccgtttcatacacagaacttgaaacagggacaagggctagaatctctgtttcatacacagagcttgaaacagggacaagggctagaatctctgtttcatacacagagcttgaaacagggacaagggctagaatctctgtttcatacacagagctgaactgggctgagcgacctgctctgctgacgtctgtttctgtcatgagagggaacctaggcctcttgacatttccttttgtacattttcaaaaagattattttttcctctctctggtccgttccactgtgagattctctcctaaggctgtttctttgccttccattttgacaactatgatttagtttccgagatgatgaaagggtagtaaaaaggcctgggaaagagaaagcaggaagggaaggaattatctcatgattttagtcagaaggaaatcactcagacagaaacgcttttacaagtggtcagatcccgggaagtgggattgaataagtggcatcgtatcacacaaccctgttttacattcttgctgttgccaggggtaacgaaaagaacgagtatattcattccgaggtcaaatatatatctttgctgactctgactataattagcagaattcgttcaattcaagtttgagaatacctttacagaagagggtcttcaggcatgtgtgcctatttctattcgtatgttcacatgtatttgagtatgaatgtgtgtatgtgtgctgtgtgtgagacctcattatttgaaatcaagaaatgtgcagtaaagtagagtttattaattacaagaagttacatttgggggataaaccattttgtatagaattgaataatggggtctttgaggggtgtatatatgtatgtgtgtttgcatttatgtgtatgaaagtgtgtattgcatgtatatgtgttgtgcatgtatgtgtcttggtactgtacagatgcatgcatgtgtatatgtgtgcatgtgtatttgtgttgtatgtatgtgtgtgcatgtgttacatgtttaggcatgacatcgcacacatgtgcaagtatgcatgcgtggatgctcctgtgtatatagttataaatgtatatgtgtgcatgttatgtgtatgcatttacatatgtttgtgtgtgccagaatgtatatgcatgaacatgtatgtatatgcatgtgtgtttgagtgttgtatgtgcatgtatgtgttacatgttggtattatgaatgtgattatgtgaatgtgtgtgcatgtgtgaatgtgtgtattgcatgtatgtgtgtgtgcgcatgtgtgtgtgtgagatatgtgtctgtgcatgcatgcatatgcacatttgatttgtgagtcctctctgggagggccatgttcctggagagagtgcatgggatcctccgctgtcctctcagggagagagatattttaaaggtttgagccattaggtaaacacgcctgatgctctataaaatatatatttacatataccattggggttaaatatatgttaaatgggtgcaaagctgttatattgcattaaaagtcatgttaatacttccttgttaaaggctttgtgaatgatttcctgcacatgaaacataatacaccacacagaattacagtgggtcagtggtgatatttgccaggaggtctggctaatgattggtatttctagttgcagacatgcagtttgagcttttctggacttaaaggagggtcactgactgcccactgaatgatgccagcagctctgcctcattctgtcggcttcatccagagctgggacagctgctctcagatggattgtacttttctctccataaaggtctgcagcatttgttagcagtccagtagcagacccagcggcaggtccagggtcaggtccagtgtcaggtccagcggcaggtccaggggcaggtccaggggcaggtccagtgtcaggtccagcatcaggtccagcggcaggtccagggacaggtccaggggcaggtccaggggcaggtccagcatcaggtccagcatcaggtccagcggcaggtccagcggcaggtccaggggcaggtccagggacaggtccagtgtgaggtccagggacaggtccagcggcaggtccagcgtcaggtccagggacaggtccagcggcaggtccaggggcaggtccagggacaggtccagcatcaggtccagtgtcaggtccagcgtcaggtccagggacaggtccagggacaggtccaagggcaggtccaggggcaggtccagggtcaggtccagtggcaggtccagcggcaggtccagcggcaggtccagggacaggtccaggggcaggtccaggggcaggtccagggacaggtccagtggcaggtccagcggcaggtccaggggcaggtccagggacaggtccagcatcaggtccagcggcaggtccaggggcaggtccagggtcaagtccagcggcaggtccagcatcaggtccagggagaggtccagcatcaggtcaagcgtcaggtccagtggcaggtccagtgtcaggtccagcggcaggtccaggggcaggtccaggggcaggtccagtgtcaggtccagcatcaggtccagcggcaggtccagggacaggtccaggggcaggtccaggggcaggtccagcatcaggtccagcatcaggtccagcggcaggtccagcggcaggtccaggggcaggtccagggacaggtccagtgtgaggtccagggacaggtctagcggcaggtccagcgtcaggtccagggacaggtccagcggcaggtccaggggcaggtccagggacaggtccagcatcaggtccagcgtcaggtccagggacaggtccagggacaggtccaagggcaggtccaggggcaggtccagggtcaggtccagtggcaggtccagcggcaggtccagcggcaggtccagggacaggtccaggggcaggtccaggggcaggtccagggacaggtccagtggcaggtccaggggcaggtccagggacaggtccagcatcaggtccagcggcaggtccaggggcaggtccagggtcaagtccagcggcaggtccagcatcaggtccagggagaggtccagcatcaggtccagcgtcaggtccagtggcaggtccagtggcaggtccagcggcaggtccgggggcaggtccagtgtcaagtccagtggcaagtccagcagcatgtccagtgtcaggtccagtggcaggtccagccaactttccacatggcccatgtgaaaatgtacccactcccttgcattttttaaagcagtagttattagtagagcctactgccatttctccttgagttcctcacagtggatgttaagcatttgctttattaaagcaaagttccatgctctttgtgctaagtcacctctgcctttctgtgagaggctagaattgggatcgaccctcagctgtgccagagccttggtacctgtctcagttctggaatctactctgtccttgttgccttccattcaccgacagccgtctgtcttcctgtcactccttcaacacggagtccagcagtgtgcacacaggtgagcctgtgtggatgctggtttcgtaggatcttatcgggacctcactcatcttttcactaggaaatcagacactgcaaaggacttacagaaaagcccaaagaagccgtattgatagaatcatagagacagaattctataaccataggaaacggcattgattatcatgaaatgtgcacttacgtgtggcatagtaaaacatcacatttgaataccgcactgggtaagagcttggaaaagagattatgaaagtataactggctctgctcttatgtagtgggacatggtaaagcgatgcctgatactgtatagaatggaacaaacaggatagaattatacagagtagtgcagaatagaacaaatagtagagtgttcgataaggtagcatagagtagaagaaacagtgtaacatatagtatagtatacaataggagaaatggtatagcgttatatagggtagcatagaaggaacagtgtaacattatatagtatagtgtacaataggacaaatagtatagcgttatatagggtaacatagaatagaagaaacagtgtaacttatagtatagtgtacaataggacaaatagagtgttctatagggtagcatagaatagatgaaacagtgtaacattatatatatagtatacaataggacaaatagagtgttctatagggtagcatagaagaaacagtgtaacattatatagtatagtgtacaataggacaaatagtatagcgttatatagggtagcgtagaacagaagaaatagtgtaacatatagtatagtatacaataggacaaatagtagagtgttctatagggtaacatagaatagaagaaactgtaacattatatagtatagtatacaatgggacaaatagtagagtgttctatagggtagcatagaatagaagaaacagtgtaacattatatagtatagtatacaataggacaagtagtattacatagtctagaatagaacaagtgggatagtattgtagagtatacagttgaactaacaacgtagtattgcatagcataatgtagtctagattagaacacacagcatggtattaatattacatagcatggtgtgcagtagtagagtcgcaaagcacagaacagagaggacagtgactattacatagcatagtgtggaatagcagagtcgcatagcacagaacagagaggacagtgagtattacgtagcgtagtgtggaatagtagagtcacatagcacagaacagagatggcagtgactattacatagcgtagtgtggaatagtagagtcgcatagcacagaacagagaggacagtgttctgtagcactgctgcaggatttttgctctttagctcagctgggtccgggttcttgtctcacaaccaggaagaaacagacacatggacatcgaagactgagtgcagtagaatttattaagcgaaaaggaaaggtctcagcaaaaagaggggtcctgagagcaggttgctggttgcccccttcccagttgactacaagggcttttacatagaagctgatggggctgggctccctgtttgcataaggagcgaatttctggtggctccaccccattcccccatgtgtatggggaccctcagtctactgtgagcatgtttaggcaagccccctgagcaagttcccctatctgcacaaaacatgggctggaggctgtctgggacccttcgcttactgtctgcctaaagcaagctggctaactcctttcagtatagaagaaaatagtatagaatagaacagatagtacagtattatatagtgtagaatgaaacagtataatattgtatcgtagagaatggaatagtatagaatagaacaaaccgatcatagtagtgtagtatagaatagtagcctcgcgcagcatggggcagtgttgtgctccatactacagagtataaccaccaggagagcgttcttcagtggggcgttactggcccttcatatttctttagttctatgaaaatgaggacagggagataagagggggaggaggttggctttcttacttttaaggcactcattacttcctggggatcatttgatggtcctctttggtagtgttctgtgaagcagtctgtatactctgtgtaggatgaaatgagatgttttctgtaaacagttgtctcatgcctggcacatggcagagcctccgtggatcttgctgttgtgaatacactgatgacgtctctacagtgccctccacgctataaatactgtgcattgtaggaagtccgggccttttcaaaggctgggtttcattttaacaaaattggaaagccgtgcatatttggaatggccagatcatcctgcacctaaatgacttcacctgtccagctgggtacagaaacgggcttctgtcttttgtcccattctttcatctggcagtctcttctgagaaaccttgactttgttgtcagaaaaacactgattagcatgagatcagatagcagctgtgaagaatgaaagcgtcactaccaatctccggcagcgtctgataaggagaaatgcacctccctgcgtgctgccaaggtttatggagcagaattccctgacgccactgccctcactgcctgtgcgtgcatctgctgtggggtcatttccttattggacttggctggggacctcctgaggggtggatgggtcaggactgggtaatttggggaaggtattcgtggtgttcctgtttgcagtctgtgtcccagttggaagagatgcttttagtgcatccattaatccagacatgattagcaagggtgtctctcccaggtaagagttggtgcgtctcttctgagtgtctttctcaagtctgttacaaagagaactttggtttctcaaggtttaagaattaatgtcaaagagcaatttagtgttcgagtcaccagccttgctgtggatgattgctgagtcctcggaggttagggccacagcacaattggtgggccgtctgttccccaccctggtggagactttctcacccaaagaaatgtattctgttagtatgtctcaattagaatattttagtaggagacagttatggctcttgttttaatttgtagtggatgattactgtagcaggatcaaggttgagacttgcagcgtagctcatgtaaagcattgattttaaacacccaaaatatattgccagcttcgttgccgtggctccaagggactaggaatgcatatgttgttttttgttattattttttatttttatttttgaaacaagagtctcgctctgtcaccccggctggagtgcagtggtgtgatctcagctcactgcaacctccacttccagggttcaagcagttcttgtgtctcagcctcccgagtagctgggattacaggcacccgccaccatgcccagctaattttgtatttttagtagagacggggtctcactgtgttggccaggctggtctcaaactcctgacctcaagtgatctgcccaccttggcctcccaaagtgctggcattataggcatgagccactgtgcctggctgccatgaccattttaaatgtggcattgaatatctgctttttttttttttaaggcagtacagacgtcacccctcacacctctgttctggggctggtctgggctggccaggagggcttccaggctcgaggccgcgtctgaagtgttgttggacaatgtggagctgtgaccccttggtctttggggacgtggggcaccttgagatgcccacagtcttgcgagggtttatggctcagtgtgtggctgctgcgaggtagctgtgggcggggaggaaggagagcagggtccatctgtcctggtgtggaaaatgcccaagaaagtcaagaaatggtacaaaaaatcatcatctgccctggtgccatttctgtttaaaaaaaaaaaaatcactctgcgtgcggttctgtgcttgaggaggatagaaaatacctagaaagacgcacaaagtgttctcatggggtcagcaccgggaagtgggatgggaggcttgggagtgtgtggaaaggaggacatggtgttattttgttctgttttatttggtagagcaagtgatcaaagtgaagcttgagtgattggcgcagcttggcctggccatgggtagatcccagcatgtcccgcctcccactgcagctccgtttctcggtcacggatgagacaggtggcctgaggctgtgggcggaggaggggcagcccggtgtccccagcaggtgattgtccaggctattcttgggccagcctgagggaaggggtggaggagagctgggagggtgcacagtgcgcccccccgccaccccaccccgggactggaactcagttctcagcctcgggctgggaggtgagcccaggctgctgtcgatggaggaagatgccgaggaagatgccctcaggatggaggaagatgccagtggagtttggtcagcagccagcgtggtctttcccgcaggggatacgcagtgcgcccacttgcaggaaaaacgctgctttagtttttgaattttgctcattctgtttatcgtgctgctcatgctaagatttggatatcgttggtaggaatcagtgtcaattgcatacagttgactcttgtaccacacaagcttgagctttgtgggtcaacttatatgtgaattttttcaaccaaactcagggagaaaatacagtgttcctgccatgtgaaacgtgtgtcggagggccgactctgtacacgcaggttcggcaggtccacttgtggggcgtgagtgtgcctggatttggtgtccatggggtcctggaaccgactccctgagtacagcgaggccgtttgcagtagcaggtggtttcttttgtagtttccccattggtttcgccccacaccatctctctcatgccgcagctgctgctgatgatgactgatgacctgggtgggcgatgccaggccccctctcagctcaggccacttccttggagagactcctgtgctaagggcaccatttagcaaaagtccagattttgggatacggaaaatttgggggacgtgaattcactcaaataaatgttcaaagttggcctcagagccttgcgttcttgttttataaaagatgcaccttttgggggaaatactgcttaacaacatttaactggaaaggcactgaaacaaagttaagctttttttgcataataccttcacgtggatacggattttcatataattgtaattgttactcatacattctactaagtcttctgctatttttacttaacgacttaacatacttgttcattcagtcacgagtttggttgttccacagtttgctggggcctccctgggacctgagcacagtgctggggatgcaaaagtaggtggttcctgatgggatcgtgtccacgttggtggctctgcttgtaaggagtccacgttggtgggggaggccgactggtgaccggaacccacgctgtgacgccatcattggtgtgatgcaggtgaggacagggtctgtagatatgcgtggaggacggtggtcccagacctgggcaggtggaggtgcccctgaggcccccagtggacattgactgagtgtggcgagagctggccaggagagagtttgggaggtgtgggagagacaagagcaggaggggtggcaggggctaggatggaaaggggcttctgcagaaacgggggctggggcctgagccctggcaccgggagagatggagagagggcagtgccggctttggaagagaaacagccagagctgtgtagcctcggggtcctgcatggacacaccctcagcttcccccgtgaggcccacgaatcccagggggagtttgtgttatgccacggacctctcacaagtgggggctgaggcagaactgaggacatctgggttccatggtggatcagccaggattctggttgcaaattacagaaaacaacttaaacttatgcagggaagtgagcatgagggggggtcggcccagagcactctggccagaagccatctgggctctaaggctgggaggccccttgccagctcacgtgctgtggaatggcttccccgcctccggccctcggcaggtggaaggtgctgcctggcagcccctgcaaactgaaggggcccacgtccctcctggctctgcatcccattctcagggacacggctgtcatggggggaccagctggggcaggggaagagtatagggaacccagtagaagtggccgtggactctcttaggaacgataaccgggtcacctaccatagatgaagatgttgtcggcctgcgttcttctcgtgttggtctggggcgtgtggctgccgtgggctggcgttatccacagccccggtctggggcttgcagtggctgtgggctggcgtggtccacagccccgggcaccatggtccctggccctgaaatcgcatccagtgctgtgtcacctcgggccagctgtctcctgaggggaagggaacagggaacagccctccccgtgtggcctccccagcaccacccaccccgcaggacctccagtgttgactctgctggggtcttctctctcctggggggtccttgtcccaacgggaggactccatgggccgcaggaggtgtcaagctattttctctcctggaactgggttgctggcagctcccagatgcaggaggaaaggctcagaattgccttcctaataaggaattgttgatgtgaactttggacggcaaacactgcttacatttccttttccgttttgatgtgttaatggtgtgcggcaacgccgtgacgcacggggacgcaggtgacgggcacccccccacaaggggaccatgcacctgtttgataataaggcatgcttctcttactgcaaataaaaacttcaatggttttctgccagaaagaccctgtcttttatgtaggatacatagaggatcatttggcaagtgattggggattttgggttaaactaaaaataaattaatttcattttatagcactctgaacacatttgagttaattattcatcgagaatttgaatagcacacactgttctgacttccgacttcccccaatgaatggcatttgctgtaacgtgacaaaaccctgagtcttagaattattgggtaatgtgaaaaaaggaaaagttggttctctgttgttttgctttaaggaaattatattattttacagtcacttagttttctcctttccaataagaaaaattgctttcttactacctgaaaattcgtgaaggtcaaggggacacaccctgcagtgcattaaaagccaccatcaaatgtggacctggactcagtttccctctgttccctcccaccctcaaatgtggacgtggactcagtttccctgttctctcccaccatccaatgtggacgtggactcagtttccctctgttctctcccaccctcaaatgttgacgtggactcagttttcctctgttctcgcccaccatcaaatgtggacgtggactcagtttccctctgttctctcccaccgtcaaatgtggacgtggactcagtttccctctgttctcgcccaccgtccactgtggacgtggactaagtttcgctctgttctctcccaccgtccaatgtggacgtggactcagtttccctatgttctctcccaccatccaatgtggacgtggactcagtttccctctgttctcacccaccctcaaatgtggatgtgggctcagtttccctctgttgtctcccaccatcaaatgtggacgtggactcagtttgcctctgttctctcccaccatccaatgtggacgtggactcagtttccctctgttctctcccaccctcaaatgttgacgtggactcagttttcctctgttctcgcccaccgtcaaatgtggacgtggactcagtttccctctgttctctcccaccgtcaaatgtggacgtggactcagtttccctctgttctcgcccactgtccactgtggacgtggactcagtttcgctctgttctctcctaccgtccaatgtggacgtggactcagtttccctatgttctctcccaccatccaatgtggacgtggactcagtttccctctgttctcacccaccctcaaatgtggacgtggactcagtttccctctgttcttgcccaccctcaaatgtggacgtggactcagtttccctctgttctcgcccaccatccaatgtggatgtgggctcagtttccctctgttctctcccaccatcaaatgtggacgtggactcagtttgcctctgttctctcccactgtgaaatgtggacgtggactcagtttccttctggtctcgcccaccatccagtgtggacgtggactcagttttgctctgttctctcccaccatccaatgtggacgtggactcagttttgctctgttctctcccaccatccaatgtggatgtggactcagtttccctttgttctcgcccaccgtccaatgtggacttggactgtttccctctgttctcgcccactgtccaatgtggacgtggactcagtttccctctgttcttgcccactgtccaatgtggacgtggactcagtttccttctgttctcgcccaccgtccaatgtggacgtggactgtttccatctgttctcgcccaccgtccaatgtggacgtggactcagtttccctctgttctctcccaccgtcaaatgtggacgtggactcagtttccctctgttctctcccaccgtccaatgtggatgtggactcagtttccctctgttctctcccgccatcaaatgtggacgtggattcagtttccctctgttctctcccaccatccaatgtcgacgtggactcagtttccctctgttctctcccaccgtcaaatgtggacgtggactcagtttccctctgttctctcccaccatccaatgtggacgtggactcagttttgctctgttctctcccaccatccaatgtggacgtggactcagtttccctctgttctctcccaccatccagtgtggacgtgggctcagtttccctctgttctctcccaccatccaatgtggacgtggattcagtttccctctgttctctcccaccatccaatgtcgacgtggactcagtttccctctgttctctcccaccgtcaaatgtggacgtggactcagtttccctctgttctctcccaccatccaatgtggacgtggactcagtttccctgttctcgcccaccgtccaatgtggacgtggactcagtttccttctgttctcgcccaccatccaatgtggatgtggactcaatttcgctctgttctctcccaccatccaatgtggacgtggactcagtttccctctgttctctcccgccgtccaatgtggacgtggactcagtttccctctgttctctcccgccgtccaatgtggacgtggactcagtttccctctgttctctcccaccgtccaatgtggacgtggactcagtttccctctgttctctcccactgtgaaatgtggacgtggactcagtttccctctgttctctcccaccgtccaatgtggatgtggactcagttttcctctgttctctcccaccgtcaaatgtggacgtggactcagtttccctctgttctctcccaccgtcaaatgtggacgtggactcagtttccctctgttctctcctactgtcaaatgtggacatggactcagtttccctctgttctcgcccagcttgccaccatggctcatttcactttcactcaggaaaggaagaaacattgtttttaataggtatgaaggcagttgtttttaacctaaggaacagaacataattctagcaatggaaattaccaaccgagtctgtgtgaggtttggaagaaaaaaaggattttcacttccacactctgtgtgtgcccacctcccccagttgagagtcacagatttaattactttaattttgagcttaaaataatttgacagcctaacaaaaactactacagtcctataaaattctgcttgtgtgtttggtttttcagttgcttggcttaatatggtgaatgaatgcattatgagttgttattttagtaattgctataaaaattaatgtacgttatagccaagtgttataaaattaatttaacagcaaagtaaaactaaagctgcattgatttctcactgtacttgtgcttaaagacggctccatgaggcaggccctgtgatcctgcaggccggcaggagcaggtgctacctggctggtgcggtcgccacccgtcccctcttgctgccaggcagctttgcagtttccaggctatgggggagtcgaggcgggtggtcagtaagagacagtggggagttgggtggtgcaggttggcgtggggtggaaggaggcgtggagtgtgggtgtggagagcctgggggaggctggacagcagctccagtacctgcacagggggacagggtgcggggggcacggggcagtgagtcgctcctggaaacagcccttggggtttttatagatgggcctgtcgtcagctctgcaccacattcctgctggggctgggtggagagtggaggcctcgagcatgcgtttctccaggtgagggcccagctgacacagccagtgtttcctggaggcccctcacctgggaacgtgcccctgctcttctcagaacaaaataaatcttaaactctacacatcacctttccagaaagtgtttaagtctgtgtgcctgttaactcacctaaatttaaagagtaatgatacaatatgcttctttttaggggagaaaacttagctgatttaaaagataaaatcagaggtcgggggacgcagcattttgggggagacagggtttatgtcctagtggtcagcagtgtttcctgaactattgtgtttgctctattattacattacagaagtgacacgtcaaacctagggaaataggcaaaatagccccccccattcagagataaacgttatcaacatattcatgcacttccttctgtttttgctgtttgctttttaagaccacgttcataggatgggtatataattgtttacagtgactttaaaagcacctttcttgttaaaaagagtattttttcattctggaaaatttagacaacatgttttgtttaaaaattacttataataccaccatcaagtcatcaatgtttttatacattctcttggtctctttatggacttaatatatacaatttaacagatgggaaataacataattttatgagtaaaatgtttcttggcgttagagatggagcagagaggaggcacagggcttcctgctggctgaggtgtgtggccagggtgtgaccagtggcctcccaagtttagggtctgcatggagaaggatttctaaatcaccttacaccacaccccctgcagccgtgtgccactttgataagggggtgtactctgatagacttttcaagacaagactctgctggatctgaggctgttttggctgcttctggagactcagctctggaacgttcatgccagctctccctcaagaccccacggatgccatgtcctcatcttttggaatccagtgttgtagaggagaagtctgaggccagtttgatttttgcttcatggtaggaaactgatgttttcaggcttttcccctttatttccatgatgaagatgatgtcccacctcatccggaggggtctttcttgtcttgtcgggaacatccagcttttaggtgcctcttcaggtcctcagtccctttctcaccttcctcacagtcctccccatctcatccatcttcactgtaattcggttattttttcatttttatgctcactttcccatgcgacttttgttcttgtttcacagatgctggtgctaaattgtatgtctgaggcccaggggccgtgtttcattctgtctgcctctgcatgtacttttgagaagtaggggcagggttgccccctagatgctgtttcagctggacctgcccaggctccctgaagtgggggcattgggcagagcccatgtggctctatggtgggccgtgttgctgaaccctacgtctgagatttgggggccgtgtttcattctgtctgcctctgtgtgtacttttgagaagtgggggtgggggttgcccccggacgttgtttcagctgcacctgcccagactccctgaagtgggggcgtcaggcagaacccgtgtggctctacggcgggccgtgttgctgacagagcaagaagccgcgctcccaggacgcgcctgcagctgtgggcaagtctgggattgtgatgggatcgtttccttctctaaaatacgtctcaactattatccagagggttggctgtaggctttcaacagcttcactcttcttagtgaccaggagacaattcactaaacagagttgctgtcagggtttaattagtcaggagtttctgccagaggctggcgggacagctccctctgcaagcctcctgcagcctccccatccccactcttgggcccggccacctgccttggtctgcagaaggtgcacattctctgttctcctgaggggctcctggacttcaggacagccttggcaagctgatgtgtaactcccagtctcttctcttttttagtaaggaatacgctcacggaatcctgaccttctagattgtttcatctttttaaaacagccgcagcttcctaagccaccttgtgtctgagtgtgaatcacttattatttttcactgcagaatgaacagaactggaatcataggatttagagggtgataaaaagacagaggttaggatattctattttctcacctcttccatacactttttccttaaatacaccctcatacgtctgtgaagttcttcccaattctgtaacttcactccaccctcaggtggaacatttgtgaacagtaacaagtattgatgtgtgcaactctgcaacccagctggaattaatgctttttatttatcaatggatggtcattggatggccagagggattccctgtgcattgtgggggcccagtgcctgcttgtgagtgacatggacataacgagggttagggaatctcagcctctgtgattcgagtagtgacatcaaggcaggtggatgactctttgagcttggcatgctcctgggtggcacagcacaggtgacgtggactggggcaagggcttgttccacgggcttctgtgttgttttttgtttttgtttttttttgagatggagtctcactctgtcacccaggctggagtgcagtggtgcgatctcagttcactgcaggctccgcctcccgggttcgtgccattctcctgcctcagcctccccagtagctgggactataggtacccgccaccacgcctggctaatttttttgtatttttagtagagacggggttttaccgtgttagccaggatggtctcgatctctgacatcatgatccacccgccttggcctcccaaagtgctgggattacaggcctgagccaccgtgcccggcctgtttttttttttttgagacggagtctcactctgttgcccaggctggagtgcagtggcgcgatcttgggtcactgcaacctccactcactgcaatctctgcctcccggttcaagccgttgtcctgcctcagcccccaagtagctgggattacagacatgtgccaccatgcctggctgatttttgtatttttagtagagacgggattttgccatgttggtctggctggtcttaaactgttggcctcaagtgatctgcccaccttggcctcccaaagtgctgagattacaggtgtgggccaccgtgcccggccctgtgtttgattcttaaatcttctttttctttttaatctttctctttctggaggaccactcagtggatatgaggaagagttcacagatgtccatattacattcctttcttaaattagcctcccttgaacactgctgtagggtacagacgcatgaagggctgaaagggtggttgtgtcccagtaagtgtgagagtggagctggtctgtgagaccccggtgccggtgagggcacccgtgtgcgatggcctgggacgggggtgtgcggagccctgaccgtggcacacgcccttcagctttgatgtttcaggcccttgctctggtcatcagtgagcagaaggtctaacagcagtgatatttatcactagttgtgttggccaatgtgttaggagggtgaagctgtttgacttaagctgcttgattggtttgcatttaaatagacacctggtggcctggtgcctggacacttgctctgtgacctgccccgtgtggctcctccctctggcatgcattagatgagatgggcgtgtttagggcgatgtggccctagactggaatgcattcgaagtgcaaaccctgccccaccccagacctgccccaccccagtgtgacgttaggaggcggaggcccagcatccttcacctgccctccaggtgggtctgaggatgctgaggtttcagagcactgctttgctagcacaccagcgagtcctgcttaaagaggccaggatctgaaagggcaggttaccaaattgtgtagcagaaaaatagaaatgtttccttagaaggggtgtaggaaggaaaataatttccttcatcatatctggaaaagatttcaaattagtaggcactatttggaattattagtggtctcctgtatttctttctttctttcctttttttgatacagggtctcgccctgttgcccaggctggagtgcagtggtgcaatcttggctccctgcaacctctgcctcctgggctcaggtgatcctcccacctcagccccctgagtagctgggactacaggcgcgctaccacacctggctcatttttgtatttttttttgtagagatggggtcttgctatgttgcccaggctggtctcgaattccagcatttcttctgcctcagccccccaaaatgcttctgtacccctgccccaacaaggaaggacaagaggtgtgagccacacacacgcctggcctcctgtctttccttgttggagcagggatgtagaagcacttgccgcagccgacttgagtacatctgactttacttagctttcctcatgggtagcctggcagtgctgtgcaccagtgctgctggccagctgttttttcaatgtactggcagaaaatcaagctgacacccgggttcctttctccctgggtactgaccaggtgggagaggaggggcgttgtgtgagtatcatcttcatgagggctggtgggggaacatcagctttaaggtgcctgggatctaaggcatggaacccagcagtgcagaggaacgtaggggatgtagcctcgggagcagagatgtgcgggccggtgccctcgttcctggcggggtctgagtgcaggaataggttggtgacccagccgaggtcacaagacctgcctggatgcatggctggcgtccgtgctggccccaaaactgcccatttggggattcccctcagtcacagactcacctaggggtccggagagcgtccccactatgacctcaaagaacgaggtgttgccttgagatcttccaaggtgagggtaggatttttttttttttgcaattagcaataatttgttgtgaatgatcttggacctattttccacttctttgtataggaagagagacagaataaaaagtctcaatgtgccagatgccatgtaatgaagccatggggttaacgttgttgattattacgtagcatcacgttaattggaacatattcacacgtgtccacagcgtgtgcgtgtgcccagtccgatgagcacgttgggttagggtcgctgctggttcatgcagcccctctgggtggggctgtctctgtggcttggccaacacccttgctgctgccactgttggagtctccagccttgaccggccttgctgcccccaggttctcggagcctgcgcaccctcttcccggcgcccaccctcttcccggcgcccaccctcttcccggcgcccaccctcttccccgcgcgcagcctcttccccgcgcgcagcctcttccccgcgcgcaccctcatccccgcgcgcaccctcttccccgcgcgcaccctcatccccgcgcgcagcttcttccccgcgcgcaccctcgtcccggcacgcaccctcgtcccccgtcgcgtctacccggggtctgtcgtgtgtttctactctggccatgcccgcctcttgctgtgagctaagtttattgaggtgcagtaagaaaccaacagaggggagcagagtccgaggctgtcagggcgcaagggagccttgggcatctcttccccagctctggcgacccacccttcgggttgaagtgcaggggagaggtgagttctaaaggtaaggctgcggtgatttcctgagccttaattatctaacacttggccatctgccgtgtgaccccatcgaagggcacctctggggacaaagcaaagcccttggtggccgtgggcggggcggccgtgcctgtctgtgtgtcctgcaccgggagccccgccagccgtggggacgttcaggcacttgccacctgtgggaggtgtgtgttagccgcgtggtaggtgcggatgcgtggagggacaggcacaggcccacaggcgtggcgggtatgggagatttagccgcgtggagatgcgtggagggacatgcacaggcccacatgcgtggcgggtgtgggagatttagccgcgtggggatgcgtggagggacatgcacaggcccacaggcgtggcgggtgtgggagaaagcgcgcagagtgcccagcagatgccgcgtggtcagcggaagccttggatacaggccgggcgggggagggacatctggaaatacgctttaagcagcatcaatggataatgctgtgattttccttcttttcgtggtccaaaacacgttctagtgatgtcgctgatttgtgtgtacctgggacaaggaactaaatatattagggccttgatgtaatctgtaaaacaggcacaatatgcctatttcaaagaggcagtggacatgaaagactgctctaaactattcagtgcaatgagaatgcttcgttgtcattagcaaagtaaaatgcctccaaggcgagcttgccatgcgtttaatgaccttggacgtgagcttcctaaacctgccagaaagtgcttccagcgtggcttcatgcagtggcttcagtggagaatgtgcatatgcggctgatactgagagccgggcagcaccctgacagcctgacacatccccatgtgtggaccgtgagccgggcagcaccctcccaacctgacgcgtccccatgtgtggaccgtgagccggacagcactctcccgacctgacacatccccatgtgtggaccgtgagccgggcagcaccctcccgacctgacacatccccacgtgtggaccgtgagccgggcagcaccctcccgacctgacgcgtccccacgtgtggaccgtgagccgggcagcaccccccgacctgacgcgtccccatgtgtggaccgtgagccgggcagcaccctgatggcctgacgcgtccacatgtgtggaccgggagccgggcagcaccctcccgacctgacgcgtccccatgtgtggactgtgagccgggcagcatcctcccgacctgacgggtccccttgtgcccattgtgggacctccatcatgcaggcaggtgacatgcatcaaactgaatgcaaggaggagggtccaggattgtgtgcgggctccgtgtctcgtccttctgaggccttctgggaagccaggagggcagtggggtcttttgtgtgtttcctcctggtggccgtgggtttgtagaaatggctttttgcaaaagggcccggaggcggaattagagcctgtcctggaaaggatgatgccttcgcgggcacctctttccattactccagtgctcccgtgattttaaatatgtgcaccctgcagacttcagccttctagtgtcctgggtgaataaatgccaggattgctccaatgctggcaaacctgaaacaggaatttctctgcattaagtttgtcaccaaaatgggaggtaaggggagaggggaaggaacttcttggcctcgtcagcccttttcttgaaactcacagtcaaactttgtcaagttctaggtgatagtgcttgaggcgatgcacttatttatgttatgtcttgttttctgagtacggtgcttcgagaatttaaatatttaggtgaaattgccatgcacagttgaattggcaccataatttgactctctgtaaagccttttggtttcctgttagagtgaccattttttgagtcaactgaagcaaaccctgctgtcagcacgaaggagccactttatagttaggagatcaaattaaatagaattctcctaaatagagcgtgctcttttcataaattttaaaaattcatttattcatcaaacacatactgagtacttatcaccctggttgctagttactgttcatatatgtttttaaggaattacttccacctagctctgaaataacattgcatttagaatttagcccagaggtgattaagcatgagcttttcacagcagtcctgttttcatttttacttgagaacatgttctcagactcggtgcccagctgacgttacctgtgcattgcccgaggcacacacctggccggggctgtgtctcgggggcttcagaagaggaaggaagggctgccaggcatctggcccttccacgtttccctggtggagggattaggccttgggcaggagtcttggcttgtcttaatggatgagcttgtgtctctcagtcagctctgccttggtgttaagctctggactgactctgacctctgagtggcagaggagaggacggtgatttagaatcagtcatgcagaccagggcactcagcgggtcttgggtaaaaagtggtggcaatcgattgcttgcccttttgggagaactgtgtggattgactcctctgaagacctctttgttttgattttatcttgagactttgtagaagcaaaaatgcctttaaacaaaattaaatgatgggcttttgtaatgtttgtgtctccccaagattcacaattggaatcctcaccccggaggagatggtgctaggagggggagctttgggtggtgaggaggtcatgagggtctcataaatgggatttgtgccctcataaaagggactacagagagctccctcgctccttccactgtgtgcggacccagtgagaaggcgccgtctgtgaaccaggaagccctcaccagacaaacctgtcaggtcttgaccatggacttcctagcctgagagctgtgagaaatgaacttgtgttgcttgtcagcccccgcccagcctatggtgtgttgttacagcagcctaggtggacaaaggcaggttgtgaattttctgttgtttgtcagtccccgcccagcctatggtgtgttgttacagcagcctaggtggacgaaggcaggttgtgaattttctgttgcttgtcagcccccgcccagcctatggtgtgttgttacagcagcctaggtggacaaaggcaggttgtgaattttctgtcagattttctggcttcagatacctggtagggaaatgtcaccatcttacgcaggtgggaccgtgtggaatcagacgttatgttatgatttgaccctgttcttgccccacgcctgtgcagttcacacctccaggtgtctcggctgcccgcggcccctccaggtgtttctgatgcggggatgtgggtgctggtgcacacgagtcccatgtggtgccggtcgcagctatgccgtcggggagcaggactaggagctcccgcccctcgtgaaccagcagcctcaccgggaagctgctgagaagtgtatgacggaaggtgattgcgcctcgagactgaaacttcctgtttacagggaactgaggtgcataagagggaatttaatgatgccctgagagacagatgcatctgggggacgttctgcaggacgttggccccagactctcgaaaagtcatcacagataaagggtgtgaggctgtccctgacgaagatggggaaggagagtcactcggcgcagtgtgtggcccagatagaaaagacgttttcgggagaattgtgcttattgaatataaagtggacagcgatgctctgaaatggttcttgtctgccgatgatggttctgcggctgcagagggtcctttattcttagggaacgcgtgcgtgaggactcggcgaggtggcaggagcctgtcaccttcaactggctccagaggagaaacgaatctgtctctctgtataatctacagagagagagagtgagaaagcaaatctaccgaaatgttagttgtcggaactccacgtggagaaaacttggccactcattgtactgttcttccactttttaaatatgtttgaacattttcataatgaaaatgtgggaaagtaaaaatacatctggaaattggtatggaagtgagtcaagccaagcacccttgggttcagccgggaagagccgacgagccgacgagccgttggtgttctgtcgacttgtggggatttcctcctcctgggttcaccacctagttttccttgtgataaagttattttgtatgtagctatgagcacaggttgatgctggaaacacacatgtagtgtggattgtcattaagaatgtggagaactggctaaagaaaccacttgtacagttttgagatgagcactgcctgcctcagcatctgtggtaacggcttcacttgggtgcagagcttggcagaggtttgagtgactctatctcgatgatcgtctgtcagaggacaaggttaagtgtcaccaccgaggaccccgttgagcctctgggctggaagtaacttcccctgggccggtgaggcagcctctgggggtctttcctgacaagacccttcactgagctgcagtttggccacctctgccctcgcctccctgactgcagggcctcgaggtctcaccacctccagcctgagcgcccagtgcccaggggcaatttcccgccttccccgggggctcaggatgctggctcctggggcagtgcccgcagctgggcccctcctccagggctggccacggcctcctgctgtgtcataccagctgcttccccgcagctgcagcccacactgcgcggccgcttctgcttctgttggatgaggagacgcaggccctcgcccaggcccccatgggccctcaacgccccagagacccggcttcccggcctcgcccctgctggccctaaggctgtgccacctccccctgcccagtccctggtctctgtacagtgtctgtccaggacgtctatccatccatccttgacaacctgtccagatgaggccactgttatcccagtctgtgaggggcgatcacagcccaggtgccggccgatgtggagacgctgatggacttcagtgtgcaggaaagtgagttccttcatatccacagccagctgggagcccaccccattcacaggtggatttgccttgttttttggcccaatcacctacattaaatcagaagaatcacagttccctgctcttctggtttttgtgactgtccgcctctctcctctgccttggattggagggtggggtgtgtcatgggttcgtggaatcctctctctgttcttgtgtagccaccagggactgttatccaggctgattccacaggaggagtttggggtgagttcctgagcgagagttgggaagactgacgtctgcgtaaatcttgcttgttcgtggttattcctctcagtcttcttaaattctgaaaaattgggggccaattagaaataaggatttaggtatggatcggtgaggacagaatgttgatctaattggctttacgttgtgtgtgataattttacgctaccctccggaagaacttaagatgttgacagtgtcgtgagaatcatttttttctttttctttttctttttcttttttttttatttttgagatggagtctcgttctttttgcccaggctggagtgcaatggtgcaatcttggctcactgcaatctctgcctcctgggttcaaacaattctcctgcctcagccccccagtagctgagattataggtgctcaccaacacacccagctaaatttttgtatttttagtagagacagggtttcactcttaaggacgttgttcagtaagtactaattggtggcctgccgttgaactaatttcagtgtagtactgacatcatcagccacggcagaaacttacttggcatccctggaagagagggcagggaagcatagcaacctgaaaccacctcattctccagcgctacttccaactctgagctgatggtcattacgagtggatctgccctggacaagtagtttagtgtagctgccttggacgggcaggtgaaaagtaacaaaccgccagaaaactcagctaataaaatgttaggagagacttggggcaccaggaaggggtgaggcctgtctgtgtgccatctgtgtggagcctcagtatctaggggacagcgttgacgctgagccccaggtttttattagtgtttccctgaataaaacgccactcctgagctgtggactgggaggctctttctgatgattaggcttcataatgcgggatcactaggcaaggtggatgtgagggccataggatctggagactgtccaggactgctttctggaaggcggccagcctgctggagggggacaacaggcttgtcccttcagcagtgaagccaccaaagagagtctttttgagaataaaagagagaagcttttaaggaaaaaaagcagtttctgtctctgtttgggagttgagtgcattttcctgcatttattcagagatgttcgtcagttcccactgtgtgccggggccccgctatggggtagggtcaccccaccgcgtacctaacccaggaaaactcgtctgcagttatttcagaggctgtttgcatttcttgtgcttcaatgggtggagggagtttttcctcctactgtttttagtcagttttcttaatctagcctgttactgggataagttccagagccgagcagttttaaaaacaatctttgcaccttgcatggagagcagtccatctgtgggtggtttgttcctggaggtgctgcagtggccttgggtgacgcgagggccccctggctcaggatgggccgagagaggaatgcgtgagcagtgggcaccggccggaggcaggggaggcgtggccacctgtggctcgaactctccccatccactctacggcaccacctcggactccccgcgtccgctctgcagcaccgcctcggactccccgcgtccgctctgcggcaccgcctcggactccccccgtctgctctatggcaccgccggaatgtgaacgctgttgccctggacgttttctctctctgctcagtgcccaggctcttgggtacacaggcggccccgggttttatttggaaagggtacagagaacagtgaagtaacccacgtgcctaagctttgattgacatgaagaaatgtagaagctgctgaaatcctggtcattttagaacaaagtatcttattaacatttttctaaaagaaagaaatcattaaaaaattgatcccggttgaggtagaaggatctcgtcctcatcctcctcagttccttccagaatcagcttcgagttcagctgcagaacgggttctggtggtggctggagcagcccaggagggtgccgttgcgtctgagttcacaccggtgcctgtgtggtctccagttacggtgctggccgtggagtctgggttcacaccggtgcccgcatggtctccagttacggtgctggccgtggagtctgggttcacaccggtgcccgcgtggtctccagttacggtgctggccgtggagtctgggttcacaccggtgcccgcgtggtctccagttacggtgctggccgtcgggtctgggttcacaccggtgcccgcgtggtctccagttacggtgctggccgtggagtctgggttcacaccggtgcccgcgtggtctccagttacggtgctggccgtggagtctgggttcacaccggtgcccgcgtggtctccagttacggtgctggccgtcgggtctgagttcacaccggtgcccgcgtggtctccagttacggtgctggccgtggagtctgggttcacaccggtgcccgcgtggtctccagttacggtgctggccgtggagtctgggttcacaccggtgcccgcgtggtctccagttacggtgctggccgtcgggtctgagttcacaccggtgcccgcatggtctccagttacggtgctggccgtggagtctgggttcacaccggtgcccgcatggtctccagttacggtgctggctgtcgggtctgagttcacgctggtgcccgcgtggtttccagttacagtgctggccgcttgtacctttctgggaagttagaaggaggatcatttcatcgcctccctgtcctcccacaccttgacctatactgggccaccgcgaattcttccttttaactgtttctctcttcacaggcaacactggcgttttgtggtccacgtttgcctcttctgaaaacggattctgtgttgctttatagaatcacatggtctcttttatgaatttcgcttttctttcataaaataatcgtgcttttatctcttcaatctcaactctgttccctggcacaggctcttcccagctcaaaaattaaaagtaatctttgattacgcttaatactttctaaagttttgaagtttatcagcatgtgggttacagaacattgactatttatttaatggaaaattacattctaagtagagtattaaagtgaaagggatcttttgattttattaaaatattcaggtaaacatatgaaaatgccttcgccaaacttcatgcttgtatatcatgaaaacattaagctgctaagctctctctgctcccgggaatgcattattagagtatgtgtttgaaggtgtcattccagtcttagttttaggtattttttaaaggggttggctggagaagtgacatttagcattgagtgaatgtttgataaagatttgtctctatataaaaatatttaaaaacaatctttagcgtttcctttcagggttcacccattaaagaatggtcttgtaaaaaaaaaacatgttaagagtgttggcgcccagaggtgctaccctgcccacagtttcatcatccgctgtcgccaggtgacacgtccagtgtttagctgcatgtcagacgtggccacagggccacaggacatccctgcggacggatgttcttatgcagattaattaggatggagactgctgcagaactgtaaaccccccaggggctgacggaagcctgggaacacccgagacaccagaatccgctgctacagtgggtggaaggaaacctccctggaagatgggacatgtaataaggagaaagtaccaaggcacgtggtgctttgaaaactgagatgttttaattaaattaacaattaaaataatttaattatgtgaattatttgaactcattttagttctttttaggaaattaatactttaagcaagtttgtttttgtgaatcgtttgaattaattgagtcagcacaaatgttagcattgatatctgacccccttccagggttggggcagaggagatgggggcggaggagccaggcctccaacccgctttcccctggagctcagccagaattccccattgaggagccctcagctccctgagagccaggagctcttgcggagaagccactgtctgcacgccacctgcttcgatgaccctgctctgccatccctgtgctccaagggccgggccctgccgttgcctgtgccagacgggtctcagggagatgccggccagcaggtatgcatggcgaggcctgggcatcaaggcccggattctatggctgccagtttcattctctcgttgtttgtccccctagcaagacttatgaggttccttgaggacaagactccctcctgccacctggtctgtttcctgaacattcactgcactagcacggccccgggacgcagcccttgggaatcaggccgtcggccatggtagagcggctggcactgctcggcaccgtgacggacgttggccgctgtgcttcactttggggacatgtttaagtacaaaactaattttaaaatttcaccattatttcaagacagctgagagcatattagcacagaatccctggtctaaatgaaatcgaagagttcttattaattattcataatgccatgaatatgttaccttattttttataattgccagtctgtataattaacctttcatttggttaaagtacttaacattaagtagagctataattacaactgtttttaaaagtatatggaagaatgtttaaatgtttaattagaaccactttttttagcttcataaagaattttttttacttgtcaacaaggatctttaattatttaaaccaaaagagcagaacagaccagaaaagaaaaacaactagtcaagctgggaactgcaatggtggcgtcgttccgtgagtctcgggttttgcttcttgggtttgtggtcagagtccttacctttgatttcctaacacaggttgttagagttggaagtgagtgtggagatgagttaatccgactttattctttcacggatgagaaagcgaattatcttcagcaaggtgggtgcaggtgtggcccccgggggacactgtggggaataggccgccctcgtggggagccaagttcgtcgtctccgggacagagcccaggacacttccacggctggctggcctcttcctagaaccccacacattgcaaaggatggagtccagatctatactgtaaagaaatgagggcagttacagaaagcaccacattctcggctgagtggctctgggcaccccaacgttgggacacctcagcatcatgtatggcgatcctcaggctgtgcccagcagtgaggctgggcctgatcaaggctgcggtctccaccctgagagcgagggcttccttcccccagcgcgggttaaagcagtgaggccgggcctgattgaagctgcggtctccaccctgacagcttgagcttccttcccccagtacgggttaaagcagtgaggctgggcctgctggaggctgtggtctccactctgagagtgagggcttccttcccccagtgtgggttaaagcaccatgtgtccacctatgcagtggctggtcccagtgtgccctgaggggcagaaaccctgggtcctgccgctggtctggggtatctacttcccattcctgcagttcctgggagtgtctgtgtgtccagggggctccgatccctgcctcaggaccacgggtgaggggtcaagatcgcccgctttggagttggcccggatcttggttctgtgtggctctggagcagttttgtcctcaggagagggatcctcacagccgcctcttgggaccatgaggagaattaataggatgacccccaggtagctaccgtagccctgtgcagggccaaccgtgtgtctccaccgccagttccttccgtctgtgctcccaccaactgtcacatcaccagcctttattttctttttcttagacccagacagcgagtgccccactggcctcggcagccccttctctaacttgtcctcaaatcagttcctcacggacagccctgaccagccattggcatgaccaaaaccccaccaaatagaacccaactttcctattaagctgtgcagagcagtcccagccccacttcccacaggctgacctcattcgccatgggatccgtggttctcacctggggctgggggtgcccctggcatctggtggggagtgtcagggatgcccttccaggtccaggatagtcccccagctggtggccgacagacagcagcacacagcctgatgtccctgtggcttccggttccccgaggccagctgtgctttgctgcctcttcatcttctcagacgggtgccctctctccaccttcgctggttagcaatgttcatccattagagctcaaagcactgcctgctggcagcacagccccttctcctggccctccgtccgcctgtgccccacggtctgtgccgtgtccccgccttccgcctgtgccgcatggtctgtgccatgtccccgcaggcccatcagagcgaggctcccagggacagagcgtttcctgtttgtgtctctgtcccaccctctctggacctggcatgatgcccgttgccaacagaggtcttgggttgattgtcaccaaagcagataatctatatggctgtaaatggctgtaaacatgcttgattggggtattttttaagtaattggatatgtaaacatttgaatgtgacacaggtggatttttgggccaatggtctcgttcttcagggaataaccacaggcccatccacaaggaccatttctggctgatttatggaacactgttctacctggttaattttggacgttatctcagcctgagaggtaggtcagcaatgtgacgaagagcactggtttgaatcctaatctgctacttagaagctgcatattttcctgccacgttctgtgcctcagtttcttgcttggttaggtaggaaaggtatgagctacctcagagtggtgagtgaggcctgcatcgagtgtccgcattaaagtgccgaaaactggacccagagtgttgatatttaaagacctttaaacattccgatgctgcattttagtaccccggtaaaacagcaaagtcgttacagatgcagacacagaccctgggtgaggtgggggactgatggtgggaggtgggtcaccaaccccgtaatgagggcgtggtctgttcgaggctgaatgaagtgcacgtcttcacgtgtaccacggtggtgcctctcgtgaagtcctgtaagcgtccacgtggctgagccgtgcggtctgtttgtgacgtctggcaggagcagagcttttgggcgcagcctcgctcttgcgtgcacggccctcaacgatctcaaaagtctgaggcttaaagcaggcttggggtttcccttacacctcccggacatctaatttgcctggcaaacatgttattcttgggtgtaaaggtgaaggagtgggtgactctggtgaaagtgtactaattactgcacttctgggtcagtggcgctcggttgaagacactgtctgccctgggtggacatctctggtgtggtgagaaccggcggctggatgtcgcgaggttgccaagaagatgcccgctttttcctttttcctcagtaacaaaaccctactttgtttagggaagcagcgaacccagctgaaaatccagttctcttgtacggcagagcggctggtgacacaggtccagatgctgggatgctgatggggggttttggagagggaggtgtcgggagggtttcccgacccacagcagccctgggcccttgtccggccttcttgcccggggcatgacgcctggagggaaagcagcttcgggggcctgagggccacaaggcagagtcctggtgtgtggggcaggcctgggccaggctccttggaggatgttacagagccactgcgtgtgcggggaccacccatctctgagccccacgcggattttcctccatagccgagcgaaatcctggtacggcgagcgaggcagtcagaggcaccttttgtggaaggaggacaaagctggagggaaggaggttttcctaaaaggcacaaggcactgatactgcgttaggagtaattcctaggagcgtggtagctggtgggtggaaaactgtagccaaagaataaatgggaatggcccttcttggtatttaactgattcgttcacgaatggtccaaacagttgtagtgaaaaaaacattttggacaccgatgttttcatcctgcctgacgatcggcgtgaccgtggggtgttccatccttcctgggcaacagtgagagggcctgacaatcggcgtgaccgtggggtgttccatccttcctgggcaacagtgagaggggctcaggcccttctggccccatgcaggcatttccccagggtgtgtcccccgtcctgaataggccggaatgcctctgggtgcagctgagcctcttgaaaagggaagagtcatgtgacatgctctcggtgaacaggaaaatgagggaggacaaggagaggggcctggaggtgaggaggatggtgaccaacaccagggatgggatggagggtaaccccggggacgggggacggagggtaactccggggacggggggacggagggtaacaccgaggatgggggatggagggtaacaccacttctccaggtgcctttgggggatgctgccgcccctcccaccccagagtgaagtcaacaggattctgtccccaggagccccagagcctggcagctgggattggcccagtatgaaccactgttcactggctctgcaccctgggacaggctccctggtgtttccgccccagtttcccatctggacagtgagaccctgactgtccccgtcacaggtgcacatggaggcctggactctagcatgtcatcggcactcgttagtgtcagccctcgttagcgtttcttttgtcgtggtccatggacgaagtggatcttgctttgtgtgttcacagacctcctgctcactttaccttctgggaacactttgtaaatagcttcgtatgtggggaggactcaagtgattaattgaatatttcatcaggtgcagttctctgtgtcccagcttgcaaaacgctcttttgacacaacatttggtgaaatttccagggactcctgtggtcagcctcatggtttcactctgtcactttctaatgcagtgttctttgggagtcttttaaattaggtgccctcatttaaaagtaagttttataatatgcagtttcaggttacttctttacctttgtgtcttaggcagtggctccccacctgtgagtagtcagaaaggttcacgcagttttccagggcggcctttgcatttactggaactattaagagctcgttcctgcttcagccgtgattgaagcgcagtgtgcgtgaggccgtgcatggcttagcatcttctgcaggctagaggtcactttctgtccttccccgagcctgctctgctgtgctgagtgttccctgtgggcgacggtcacgctgtctggcacaggccaccgaggccacagggcaggctccccgtaggggagcctgcagaaaggcagagcccggcctcttcgcggcctttcacagggagcagaaagcgtaagcctgttattagagctgtgctagcccagaaagcctccgaacagtgtttaatttaggaatcggctcctaccaactgcccatttttaggatgtatttgagtttttgtgattttttttctgcactgaagctactgtgctggctctgagtcactgtcatgggacttcacgttgccctgacgggaagcggcgggggaggagggctgcgcagaggcttgcggccgtgataatgaagggcttgttgcctcttgggacagtgagttcaagctgtttgtaattgtcagcgtaaacagtgacccgctgaggacacggctgtaattcagggtggcatggttgattgtcatcgttaatatcaggcacctgcgtctaaaatgacggtgcccatagtgcggctccaggagggctgggcagctcctgcccaacacacatgctcctgggccctggcagccaaggttgcgccgccggccaggcctgcagctgtgggtgcagcggggccttcagggcaccgagcgcctccctcgtttgctcgtggggcccacccctctgtccccagtgcggctccccccccgggttctcccggccacatgcacacctccgtcttcacagcttccgtagttttctcgtgggtgccccaggtgagctcctggggagggttcatgtgtcagtcaggttctctccaagcgtccctggctcgtggctcagcaggtccctttcagatgagtcagccagctgtgtgcctgcatattcagcatacttgtcagggggctgcctcaggtcagagcaagaccgacgctcgcctcctccgtgggactttggagcccgccctggagagactccagccacatccagaggggctgcccgggcccccgtgggctggtgggagtgacttccaagccactcaaggccccactttgtgttcgtacaccctagaaaggcacttaaagagccgtgttctggtgctgtgtgcctcttgagtgaggcacaaaagcctggatgtggagctgagcgggcgctgccttcctcaggctgtgcttgtgttttggggcccctggagcacttgtggctgtgatttttgatgctgtctgtgggctcccctagacggtcccacctgcagcgtgagggccccatctgcagccaccgaggagctggcaggtccggctttggtcccactcagtccttctcaactttggtgacagaggtgacagcaaagcttcagctgggagccccaggccttccccgcttgggaccctgggaccgagataacagatccctccatccatgtgctgggggcctcgccgtgcggctcccttctctggtcaggggctgcgcccttgggctgggcagttcccgagtcctcgcactcaggggctcagggcgggtcccgggtgcagagagaaggagcagggtggcggttcgagcccaactgtgttggcttcatctttgacctcttgtctctaaatatatttgcaaagttttccagatgaaaactcagaaggaatttttaatgactgtataatctgtgaaggctgtggaagccaagtctgtccgcctctttcatccacctcacttctcactgttggggctgattttggcagcattcataggggcatggatgcaaggggcagtggccagccctcggccctacatccctcccctgctcccctcagccctgcatccctcccctcttccccttggccctgcgtccgtccctcccctcctcccctcctcccctcagccctcggccctgcgtccctcccctcctcccttcagccttgcatccctcccctcttcccctcgcccctgcgtccttccttcccctcctcccctcagccctcggccctgcgtccctcccctcctcccctcagccctgcatccctcccctcctcccctcagccctgcatccctcccctcttccccttggccttgtgtccatccctcccctcctcccctcagccctcagccctgcatccctcccctcctcccctcagccccacagcatttcggtttcatccccttctctgcacccgtcctcatgaaaacctaagtgcggctggagggagacgcctgtgcccattcccgtgacctccctcgccagcacggctgcagcgtccccttggcaggcatccgtctggtgctgcctctgtgccccctcctgtcaagtgcggctggagggagatgcctgcgcccgttcctgtgacctccctcgccagcccggctgcagcatcccctcggcacacatccatctggtgctgcctccgtgccccctcctgtcacctgatgctcgtgctcctgaatcttcacacgcgtgctccgtgcagccacctcactggctccctgggaagggtgacaatgtctcacgcctgtcagaatgcacctctctgtgcactgaatattccaacacagaatcattcctctgtgatgatttatgctttgcgctgtagaattggaataaagaaaaagtgaatttagacattacagccatcaggctgaagctgggtaattgcattagggaattaaatgagagcatttgagcttctcgagctctaattccacatctttgtatccccatcaccccatacccagtgtctaacacagctcttgatctagtagtttcttgataaatgcttattgaattgaactggactgagcttaacattcccacctggagttagaagccagtccctgagcaagttacatttagaacgtgaagaacgtgagtttgacgttactgtggtaaggggtatcctacacgtcataattccaagtcaatatcgggtatttagtcaaatggactcaagcatagagaggcattggcccatcggcgaaagggcaaggcatggtgctttaggtccaggtccctgatatcaactatgaaaataaaatgttgtcaactccaattacagccctgtcctcagctggtcactgtttatgctaacagttataaacagcttgaactcgctgttctgagaggcaacacgccttccattctcactgcaatgcagctgctttggtggatggaacatgcctctcttccctccctccctccccctcctccctccctcccccttcttctctccccctccctccctcccccttcctcctttccccctccccctccccctccctcccttccctctcccccctcctccctccctccccctcctccctccccctcctccctccccctaccatctctcctgggcgaggggtggaggagaagagacttctggaatcttccgcttcatccaagcagcttgggggcagcatcaacagctgcgacttggcagccccagcaggtgcctcagggcagcctttctaatgggaatcctggaatcatgtctttccttaatgtgtcctaaaggctggaggacacaaagggaaacaatgctcaatgctcagtcctgtgattttgtgtatttattggacttactttgaaattaaactaagacacacggtagagcattaaaaaaaagaaaaaacaggctatggtgtttgaaaaacaaacaaaaccatttggtttgttggtttgttcttagaccttcacagtagattctaggtcacatgtttcagtttatcagcgaatgacatcctctccggaagccatgtcaacctcttgtttgatgatgtcagccgcagcagaaagaagcactccgtaggccccgtgctcagcaccttggcatgagctcctgccgtcttttgttcatgctcatcacagctctgtgcagtgggcgtcctcctgatccacgtgggaggatggaggatggaggcggaagggtgagtgatggcaggatcacacgaggggtctcccccgagatagggaggggagccggcccaagacctcagtgcccatcgcatccttcctcctcctcctcttcctctctgtgactgtttgactcaggctgcagggacagatgtatgtgcagagtgtgtgtgcacccctggggggtgtgtgctcatattggcatagactcgtgagcgcatacagagcgtgtgtgcacacctggggttgtgtgctcatattggcagactcgtgagcacatagtgtgtgcaccccgggggtggtgtgtgctcatattggcacagactcgtgagcatgtacagagcatgtgtgcacaccttgggggtgtgtgtgggtgttggcagggacagatgtgtacagagcgtgtgcacacctgggggtgtgtgctcatattggcacagatgagcatgtacagaaggtgtgtgcacacctgggggtgtgtgcttatgttgtttggtaagtggcgaatacgtggcccgttgcgtcgggcggccctgtgcctgtgttgagtccgtcagtggccccttgggtcggggtctccctctctgaagactgcactcaagtgtcttgaggtttcagattcttcctctccaggtacttgggcctcctcaggaccaaacgtcagaaccagccaactgaaaactacaagaacgttcaaatgcatcttcagtgggaaaaacaaaaacaactggaataatcttcccacatgaccccgtggttaagccgttagatactccagccgacagatttagttactataaaattcacaccaattaaaatggttttgagagttgcagagctttaccactaaacgttgaaataattgaagcgttctgctccacttgcttacaaagcagggttggggataactttcagtccaaagtagcaaccttctaaatccagcttagatgcgaggctcccactgacacaggaggagacagtggcccttgtttattctcccgtgttcagatactttgtcatttttttgtatcctgatcatcacttctgcttttccaattcaaactaaaggtagtttagttctgttttggagaagctgtggttagtggtttcttttcatggtttgcttaatttcttgtctggtgcttaaatttacccaaatggacttttctttagtacgacggtgccatagcccagggcttctccctccgtatctgcccctcaggaggccccctaggaatgggtgctggagatccagcccctctccgtgtgccgttttctttgagtccaatgtaggtttggctcagagaagaaaacaggcctgtggtttaggtgcctctgactgcttgcttgtgaaacgtttaatgataaggcgccttccaaactaattttacacattgatagttgtagcttgaagtatcactgcagttgtaagaacaagaaacactcccataaaatagataggcagaaaaaagccataaaaattgaataaagcacaaataaaatggccttgtaagactatacaaggggaaatgctctccgtccagccagatcggctgtggcgtcctccgtaaatacattcagccacatgtgaccctgatcgcaatcactactgtgaattgtgatccagaatgttcttgggggccgacacctgggctgtgccagcagctgcatctgattgggtgtcttgccggtgatgtgcttagtgcagccagctgggctgaaggggtggccaccccgtgcacttgccacgtgcagctgttattctagtgatggagccgtgagtggtgtagcttgtccacctggtctacttaaagtacagggaacccatccacgggcgggtgcctcccaacacgggagctgccatttttatccaggactctctggcgctgcagagcccagcctgccggtccctgggcccatggggaggcaccagagggctctgctgggccatggaggtccccgaccaggtggtcactcattgcttgtggagtggtccatggcccatgagtttattcctggggtctgtgtgggtgagggtaaccaggttcacagctgggcacttaccccttgcacaggtgacactagttaaagtggaatctatattagctcgcacgggagtgcgtgaggagctgggtgggagggcgggcgggcgggcttggtcctggccctggcataaagcctgtgctcccgatattctgcgtcttcctgttgaggagccgccagggctgccgtgggctctgaagatggtgggtgccataaggaccaggggatgcggaagcctctagaggctgagggaggcaaggagacggtcgcttccccggagccagccctgctgacatctcgacgttagctggtgggacctgttttggattccagtttccagaaatgtgagaaaataagttcgtgttgtttggggcactaagtttggggtgatttaatagagaagtagtaaaactagcccacgaaggtgcacgtattgaaatgtgacttgtccaggtgttcacagtggcgttagggggacggcatcagtgttctgggaactgcagttttactgaaggaagggggctcaccgtgcctttcctcacataactgaaggtatgtccgcctgccacacagctcaggagacagcgactagaattctgattttatttcttatgggaagcaggccacagtcagaacacagtgagggctgaaatgagcttcctgcagcctcagctggaaagaagaattggaagtatttttgatgtttttctacacagacctgtcctttcaggttttgttaagttctggaaaaagggagaagccaggcataccttggcgagggacagtgtttctggcgatcgtgcggcttcagcctgaacgtggccgtgtggctgagcagtgcgggagggctctggtctgcacgtgtctgtgtggaccgaggtcacggggtattgtcccaagcacttatcctgatctggcagaggctctgttcccaaataattattccacggtttcagaggctgtagctgagtgatagtcttttaactttgttgcataaaagcaaacaaagtctgtcatgagagtctaaaaatcattatttagtagtcatgactaaattcatacatggagctttgggatggagtgaaagccaccgtcacctggcgtggacgctgtgtggtatttttagcatggtgggcgcctgctcgtgccttgagctctgtctgcagtgcgagcgacagctgtgcatttgagaaatgtgggcaggtcagcttgctcctccaggggcctgcgggcgtccggctcaggggcctgggacgaggccatgtcagtgggaaggagcttggttgtgtttcagcagatatgtctgcctctccaggcctgcaagccagccagaacccagttttcctttggtcatctaatgccagaaaaaaacctgtttcttagagattcttgtaatttatattaatgaaccatttgaccatacataagaaaatattatcagaaaaatgcatgaggctttacaacttggcagatgtgtaactcacatgattgaatcaaactgttgaagatacttgtttcacttgagggtttttagcattttatgtgcagaccaaatgccaatagcattctgaaagagtattttggaattttaaacacacaatcacagagtgggacagtactgggtcctgggatgctggtgaggtggacgtgacctcaagctcttggagctcacaagcaagcaggattcctaaattgtcacacctgcagtgcagggaagtcaaagtggatttctgtaaacgaggtattagtgcaataaggaacagatgagtgcccttggagggcagtttttgagcctcccagacacctggggctgggggggcggttacccaccagagcctggatggtggagctgggtttgctggttgccctgtgtggcaggtcattacgtgcaacaaggagcaggtgagcgcccttgagggtggtttctcagcctccttcggaaccgcaagtggaagacgccccaagcaggggtgggggtgggggggtggtatccacaggagcctggacagtggggctgggtttgctggtggccgctacgtggcaggtcactgcgtggagcaatgggaggtgggtggagtgggaatagaggacacaccctccacagctactgttgggagttggccctggtggcagagggtgcatagaaggattcccatcaagggcaacacggctagggtcccacgtgtgctggatgccgtgatatggccatgtgtggtctcagtctccacagccaccctgggaagtgggttcagttaccattcccatctcacatttgagaaatctcaggggctcacatcacagctgagtggggtggaactagtgtctcagccaggacgttggccctagagcccagctcttaccccgctgctatttgcagtcccccaagtttgtagagaggcatgtgcggtagtggggggcggaggtcgtgtatttcagggggcggctgagataccaacacagtaggggcggggggcaggaaataagtcaggcgggaggcacagaggcagtgcctgggaggtctgcatggggtctgggtgtgggggcacctctgggcctgtgaaccccgttgtgtgctcctggcttgcctaaccttggcccttagccatgtgctacgcattttatgtgaaatctcagtccctccctggctttctttccttaaatcacggagtctcagtggggatggggggtggttggtggtccatggaatttgccctccacctccccatccttgtcctgtctggcctgttatctgaatctgtcttttcagagcctgcaaatgagtagaggccacggcggcctctcgctgatgggcgtggctctcaaatattttcatcagaattgtgttaaatgctgattcctaggcaccccattagactctctatgcttgcctggcctgggtactttgaggaaggtacacagggttgctgggctattccaggagggaatttgcatttgtagaatgtccactgtggtccttcccgcactctgctctccacgcacacgtggcattaaacctggcagacctctgggtgctgtgctggtgaggaagccctggctgggcgaggggctgttggggctcagacttgattcctggtctgggggctgcctgcttattctgttcagtgggcccgctgatgggatgccctgggaagtcccgctgtgcagagacaggcttgggaaatgcagaccatggatttaaaaattcctaaaataagaaaatcttttatgaacaaagcaaattaatttgcgtctgactgaagacaatccttgcttgaataattggtttgtttacaaaatgggtcctatggacaataaacacagattaaagttttcattcatgcttgtctgtaacgtaaataggagctattactgccacctaaattagctttaaattttgtatcggattgcggtccagattacaaacggctgcttgataatctaattgataaaatcgaggaatttagtacttggaacccagagtgaagagaacagaattgcttttgtttctcaagtgtgtgtgactgagggatgacctgggtgaagagaagtgcctggagtcattacactcaaggaggagatctgccccagcctttctcagcgtcttcaggataaaacaaaagggtgataaatgtggaaaaatgcagcactgagtttgtctatggtctgagcttctcatgtggtcattaatgtgagcgggctgtatctgtggagcctccctacaggcacaaaggaatcaggctagagtaagacggccggcaaactctggcatctgggctgcgtgtcgtttcctaaagcccttttgggtgaagtgacacaggcgcaatgtctgtttggaggagtgtaatctcacgcatgagacgcagattttaaacactaaagtcaagaagcttggtgggagtggctgtcttccaagtgggtttctgtgttgccatggatgaggcatggatgtgtcatctgtcggtgaaatgcgctggtgaagaggctaagcaaaccctgtgtgtgtgtgtggggcgggtgtgtgtgtgtatatgaacctacatctcttctggcatccgaagtaaatagacgttttgtaaaactggtgaatttgatgactctgaccctaaccctgagagttgaagtctggtgcagtgtcttgagccctcttctgcattgagggtgagtgactgtaaatgactgattcctcagtggcgaaagttcaaatttagcgtccctgaggaagccagacctcatagtcacctgtgtctccattgtaaacaccgtggcccctatgcgggtggctgcgagtttccaggccctccttgcagaagcagccatgcagtgcttggtgatttgataacatcagccaccttctgtcttctgtctaatcacggtacaaatgattttcctacagggaaacagatctcatttcttccccgatcgttgggagaagcagcccgcctagggaccgcaccgtcctctgcactttcacagtgaagcctgtgtctctctccgagaagtgtcacgtgtgtcgtgggaatcacgggaattgcttccttaattctcctttcttaatgagggcttgggacagcgctgcctgtttcacatgggacgagcagctggtggtttctggctggcgtgggaccagcgcttcggctgtgtcatcacatctggtggcctgtccagctgggtgtcattgtctcttgtctcttggctgaggcaactgtgatgccatgggggtcacgcttgtgtcagggccaacccagttcttcccatgcacacctctcctgctggagtgcttttccttatgatgacgtgttggatcagtgtggagaatgcagagaggctctgggcctctccttcccatacctactccctggagccgcgatacccggcaagggagcccgtagccagaggctcctttaaatttcattagaataaagatttgattacacagctaaacacacttgaaaggaactttatggatcacattcaagactcagcccttcaggcccagtggccatgtttcggggctcagcagctgtaggtggctgttgtctttgtgtcggccgagcagattgggacgtttccagttcagcaggcagttctcttgcacggctgtgcctgtggtgagggcaccttggctggagagcctcgtggggggatcccttaggcctctggctgcagccaggctgcatggttcctgtgccccgggtcctctgcaggccgagacggatcccaccacagagccggcactgttagacttgggtactgtgtgcagacaaagaggtgcatgtccaggcctggcgggggctggggtgactctggcctccttggccaggctcccgtctccgagtctccaggggaaatgcacccatcatccacaccatacactggaggaaaactgcaggcttctctgtgtggatggtgaattgagatcaccaagtgtgactcggcttgggctcctagccaccgtggaacccagtgataccttttaggtggaacctgacatgcctccatgtgtgcatggcaaagagaatgcagcgttgtcagcttgaatccagatgtgtgcctgttttgaggtggaaggttctgggagcgttggctgttggtgactgtcctgccatggaggacgttgaatgcaggcactggtttaggataatgcctggtttcctggtcctgtatgtgggtatccctgaatatcctgggctggaggaaggcagggcagatgggagggtgacaagaggtcaggtgtttccagctgtggggagtgatgccatcagatggccgagatcaggagggtggccggggaaccaaagcaggggtgtgtggaaacgccatgtttcccggggcacagggaagacctgttgagatcaggagggtggctgggggaccaaagcaggtgtgcgaaatgccatgtttaccagggtgtggagaggatctgttgaactccattcctgggcaacagttcttccattctcaggaatctgccattgtaattcagtagcaaattctgcaattgctctaattacctgctgttaagtccccatcccaattaccatgaattagaaacagtgacaattattgagaggtaaggaatcgcatatttccagggtggagacgaatgcagttgtttgcctggtcaagccttgccaagaaaaaccagtggaaccagttttaggtgccttgagttccctccaaatcggattccttagtgggcttgtgtccacagctgctgcagttcctcccgggcctggcaggcacgttccagacattcacatctcagctcagatgcaggcgtgcacattatttatagaaaatcgcactgcactgtgatcggctctagctgacgttttctaggtgggaggcggaggccgaggacctgtaagggactgtccgagcgtcctctcactggcttggagcaggtgcacatctgttcttcaaaagttctaatgggatgaaattagaaatctgaattttaaaaattcacatgttatgaactctggtaatttcccctgaaatgagtgactgttttttgcagacgaggcagtcagcctgtagctctccttagaacggtcctagaccttgggccatgctgtcctgtgacctcttcctgggtgtgggatgctctgcttgaagcaaaactgcaggaaagaacgtggtcagcgttcatcactgctgcagccagctcaacgtgcacacccactgggaggggggccggatcccttaaaattttacatgcatttaacagtaaaccagcaagtcagccagtgctttccgtaaccaagctgcttggctcatgggaacctgacacttcttgactttccggaagagaatacttgcttctgtggagcgtcaatatttgtctcatttcttgagactctgttcaaagcaatgaacatgtgtgtaaattaggacctttttgtgtaaattgggccacagagctctctagacacagtcggcggagtaaacggctgtgaaagatgccacctgatgtgagctgtggccgggccctttggaacctgggatcccatctccagcctttcaaaggacgtagaggaatataagatgcagatgggagggttcatattttgggcatctctgttcttttgaaatcaaagtgcaaagaaaaattttgccttgaggtcttaccccacacttgtttttctcctgaggttttaaaatttccttaactgtgctttttctccttccatccttggggaacttctttccatcttcatatcttcttaaaagatagttaaattcaacattgaaatgtaaacacatgctttcatattatttttcttttagctgatatatttgacatcggtgaagaattaagtgggtgtattggtttattttttttttttgagacggagtcttgctgtgttgcccaggctggagcgcagtggtgtgaccttggctcactgcaacctcgcctcctgggttcacgccattctcctgcctcagcctcctgagtagctgggattataagtgcccgtcaccatggctggctcatttttcgtattagtagagacgaggtttcaacatgttggccaggctgtctcgaactcctgacctcaggtgatgcgctcaccttggcctcccaaagtgctgggatgacaggcgtgagccaccgcacccgtcctgggttattcttgattttaactataatagatcccttaaaaaaaagctgtctgaaaatcttgaaattaaagagcttacttggacagggattcggacaccagttgaatggcccagcacaaaccatagttacatgggtcactgggcctgttagatcctagggtatttgaagtcgtggggatatttgcatttctgcctctgaatatcatgttagtacgaattcagctggtgtttgagggccaggctcagatctgggagaacaagagcccctgctctcatggcactgctttcctacgtgtgtgccttaggaaaatagcatcggatgatttttcagtgagtggggaagatggaaaaaaaggaagcttaagatgtttaattgttcagagcaagggaagtgcaaggaatgctcagcttttctgctgctaaagaggccctggtgggaggctgtttcagaggtggggtttctctgagaaaggtggtaagagacaaataggatgccccatctggtttgccagagatggggaaagttagtttcccaaaaacagtctgtgctctggcaaaggcttcggaaaaccagctagagtgcgggaccttgatggccgctgggtagaaggaaaacattgctggtcctgcggcctgcgctattcttccactgctataaagaactacctgaggctgggtaattgataaggaaaaaaggtttaatcggcatactgttctgtgggctgtacaggcttctacatctggggaaacttacaatcagggtggaaggtgaaggggaggcaggcacgtctttacatggccggaaagagagagtgaaggggaaggtgccatgcactttcaaacaaccagatctcatgagaactatcatgagacagcacttgggattgtgctaaaccattagaaacctccctcatgagtcagtcacctcccaccagggcccacctccaacactgggtgttagaaagcacccccgtgagtcagtcacctcccaccagggcccacctccaacactggggggttagaaagcacccccgtgagtcagtcacctcccaccagggcccacctccaacacgggggggttagaaaccacccccatgagtcagtcacctcccaccagggcccacctccaacactggggggttagaaaccacccccatgagtcagtcacctcccaccagggcccacctccaacactggggcgttagaaaccacccccatgagtcagtcacctcccaccagggcccacctccaacactggggggttagaaaccacccccatgagtcagtcaccgcccaccagggcccacctccaacactgggggttacagttcagcatgagatttgggtggggacacacagccacaccatgtctggctccccgttcttacctgcacttgcttcgcaaacgattctgtcattggtttatttttgtttttgttgatacataatatatgtacatattttcagggtgcatgtgataccttgatacgtccctatattgatcaaatctgggtaattgggatgtctttcactttaaacattttcttttccttgtgctagtaacattcaagttattctctcctagctgttttgaaatacacagtaggtgacccactgacattcccctgctggtttatcaatagtagatcttgtgctcctgtcaggctgtgtgtttgtgccccttaccagcctctccccatgctgcttatgagtgggccctgctgaccacctacttttggcctccatgacatctgctgtcagctcctgctcatgagtgagaacatgcaccatttctttctgtgcttggctcgtttgcttaatgtaatgtcctccagctccatgctgttgtggatgacagggctctctcctctgtgtggtggagtactgctcctgtgtatgctcaggccacattcccttcatcccctgttgaccggcactcaggtgattccggatcttggctgctgtggacggtgctgcattgaagctgggagcagtcactggctttatatttgggggacgtgagccactttgatgttctcaagcagcctgtccccaaagccctcggtggaatgccgcattcctttgtgcccctcgcttccactaggaagaaccgctgggaaggggctttgagtgaacgcttgggtttctgtctctaattggtacccggctgcactgaccaagcaggggtcccagtgaccctggacattgcctcacataagatccaaagatgcagttaggttctttttaacttcttaaaaaatgcttttgacctggttaacctatagcattatcagttagtgtttttgatattggaaaggtgatgtattttattttctaagaaggaaagaaacacaagttatcctgttaaatactctaaccacagactaaatcacatcaaggaaagaggaactattttggggggaaattagcccttcatgtcaaagataaaggagatgacttacattgttttttaattgagttaattatgaaatcttaagtgggtttgagaagatgagctgtggatgctgaaaggagagactgatgctgattgaatgttagtcagccctgataggatgtggctagtatttcaagcttgctccagtattgtttgatagattgtaagtgaatgtaaagatctatttgatgcttttattttacaaaatactattgagaaaaagtttctgacagccagggaacagccttcaaccaatttcttcctaatttccatcaccagaaaaaacttgtcctgttaattccagaatttacttttggaaagttcctgtaaggagagcagaggtattggtggttgaatggtgacttgaatttaggtgaagatcattaaatatttttgtagtcatgtttgtcttggtggttttagcaatttcatattaaatttagaactgcgagtcataaaaaccaaacgtggtcttaccctttgcttttgtgatactccttttgtttatatgactatactggtaaagtgatgacaaaatcatgcttatagggttttcttctgtgtagatattaggatttttaggggaacaaattcttctaatagacattgtgccatgtgttggggtcctttgtatattagtcaaatcactgtaatgagaaccacttgcaagtatatttctatacaagatcttttatatgctgactcgtggtatgtaaaatccttcatcctctaagaagactaagcaatgggttggaggagaggtttatcccccattaggtctattccgaatgcccagaattgaatgcaagtacgaattgtttttgaagtggtgtgtgtgtggggggatgtgtgtgtgtgggggggatgtgtgtgtgtggggggggatgtgtgtgtgtggggggggatgtgtgtgtgtggggggggatgtgtgtgtgtggggggggatgtgtgtgtgtggggggggatgtgtgtgtggggggggggatgtgtgtgtggggggggggggggggtgtgtgtgggggggtgtgtgtgggggggtgtgtgggggggtgtgtgtgtggggggggtgggggggtgtgtgggtgtgtgtgtgggtgtggggggatgggtgtggggggggtgtgtgtggggggggctgggggtgtgtgtggggggctgtgggggtgtgtgtgtggggggctgtgtgtggggggggctgtgggggggtgtgtgggggggctgtgtgtgtgtaggggctgtgtgtgtgtgtgtgtgtgtaggggctgtgtgtgtgtgtgtgtgtaggggctgtgtgtggggggctgtgggggtgtgtgtggggggggctgtgggggtgtgtgtgggggggctgtgtgtgtgttggggctgtgtgtgtggggtgtgtgtggggggggctgtgggggtgtgtgtgggggggctgtgtgtgtgttggggctgtgtgtgtggtgtgtgtgttcctttttaggttatgagagggaggtagatcaaagaccagatttgctgatgaacatttgtgcatattctagtggagaagtcatatgacttgaccgcacctgcggactccgattttggtttcattacggtgtctgtagccgcaagcctcagccacctctgggacccacactgaggggctgtggtgtgggttattacagagtcgtacgtcttagcgaatgacacaaatggccttgtgggcctactttggctttgtttgaacctgtagattgttaaactaattttagtttaacattttgaagattataaattgtgattcttgtctaagaagaggtttccattgtctctgaagacagaagccgcaatacagatggtctctggctcacaatgtttacacttgtgatttttcaaccttatggcgtgaactagtcacactcattgcatcgtttgggccgagatgggctgcctctggatgaacccgttgtaagtcgaaactattatgtcaaatgcactttctatttaggatattttcagcttatgctgggtttatcagaacagtttagccacgtggtaagtcagggagcatacgtgctcataaaggtagagacgatctcatagataccatttaagatataacgtctctgatgttatagagggatacaatgaaaaaaatcaagtgggacttggaagtcttggagggactcatgtaggcggctcctggaatgcagacgtgagcaccactggcttctggataatgaagtctgtgccttcttagcccagtgggttatcagctgctctcgagggcagaggtccagcagctcagctgaggaccgttcctgtgtttaggtgtttgagctgccttaaaagaggcaggtcagttctcactggtgtcttcgaggctttaggccttctgaataagcaggaggaaggacgactttgtagagctttggaaatctcagcggacttcagggccatcctccttggcaggagagccccaccgaggtgagcagggtgccgtgcaggccgtgctgggcccaggcatgtacggacgttaagggccacgggacacagatcggtcttggttcctaagtgatgttgatggccacgcagcatttctgccacgtacatgagtgcagggacttgggtttggggtgtgcgtcctggctgcctagttgcttggaaggcccctattcagaccccagcctgagtcaccatgacaggcctccagcttcacacgccacacggaagctgtggcgtccgtcactgacgcccaccagatgtcagatgtcagatgtgcgtgtgtagcttccctggtctcgggttgggtcttgttttgaggttatagaaacgttctttaagaggggttttggattttttgttgtttgcaaggaggcagcagagtgcttaagcagtgagatccctttcctaatgagaattcagatcacagcacgtaattacagcagtggggccatgagatcccctcccaaccaatgagaattcggatcacagcaggtaattacggcagcggggcgagagatccccttcccaaccaatgagaattcggatcacagcaggtaattacggcagcggggccgtgagatcccctcccaaccaatgagaattcagatcacagcaggtaattaccgcagcggggcgagagatccccttcccaaccaatgagaattcggatcacagcaggtaattacggcagcggggccgtgagatcccctcccaaccaatgagaattcagatcacagcaggtaattacggcagcggggcgagtggccgtgccctgagctgtgtggctgtgactggtgtcttccccctcggacagagcgtgctggggcctcagtggtcctctgggggggtgggtggagcccatgagccaggtgctgctgggccgtggctggcaccccagcccagggtttatgcaggactcgttctgaggacaacttagaacccagaaagcagcgcgaggagaaacgggttcgtgggtttctgtatctttggtgcttcccggtctccacgctgcgcaggctccgggggttctcgccaggaagacttgcacagtcggaccccggcgtggagtggggctgcagagagtcttacaggagccggaagtgggggggaacgtctcgcaagtgggacctttcagatgggcccagcaggatgcatatgtggaaatggcacggcctgaaaggctgcagtgggctccgtttctgctctcctgagagtctctgcccggttttctttggtttttgtctgtttggaggacgcttcctcctttcttgggcttacccagccttctgagcttccttgttgagtatcatagccctgagaaggcatttttattgcataattatgttatcctggtggctggttaagtgacctgcaaatgtgggtgattgagtagttctgagggagatcaatatctaagacagaggtggcaatgaaatgttcaggcaggcgtcaggaatctgttctctgcttcatattggggccctggtttgctgacagtcttcacactccatctaaaatggggaaaataaagtttcacagattcggcttaagctgagagctttctccagcacagtcttgtgtgagtaacagtttatgtggtgcgaagggcgggcatcagttgatcttatttgttgtggtgcttatggtagtttttctgtaaggaattttattagcttgggcaagggaatcatgagtgataaattgaaagaatgtttcaggaaattctggaacctgtagtgaatctggaatctgtatgaaattgagatttggagtctcacgatttcctaacgtgtccctgaaacccagtagttgagatagtcgtagagcttcagttctgctgcccccgttccccattttaaaaggaacacgttgctttcatctagaaggttctgagctctgagtgcagccggcggagtgaccagctctctgcatcagaggggaagccagggctgcgctcacggcatcgcggcagctgggagccgaccctggacctcaggcacgcatgatgctgaccattttctgtaaactccaaggttgcagtggtctccttggtgctttatagtcttctgaagcttttgatgtgtctgcacttcatagatctttcggaagtagatggccttttccccgcacccttgggctgagttttatcagaggctggtgtgtgggaagcaccatagccacttctgacagaaactcgggtgcccagccgaggtcagagtggaaatttgtgcttttccttcgctccagtatggtctggcttctccctgcttggccagaagaaaatcatgcttatccaagtcataggcaaaccccctaaattaaacatttgtcttttttctttaatatacccatttagtttatatgggacaatagattgacaaatgtcttttaggggaaaattaatttaattagagaactttttggataaaaactataatcaagagaagctgttttgtaataagatctagttaaatactaaagttgaaagctccttatatttgatcttaaacttgggcccagggtgcgtgtccgcacgcttgcgctcatgacgccaggctcagctgtgaactacaggcacactgtacttactttctggttgcttttttgaaagtcttattgcttggcctctccgactcagatgttgagttacattgattctgttccgaatgtgttcatccctccatctagggtccactcgtctttcagggagcaactgccttcctcatctttgtctcctatggtattgtatatttaatagtcaaatatttataggttgcatgggtgactgatgtgttcattaggaggaaaacaatgccaatttttacgtcattataatggacttgttaaatgcttgttagtgtaatgaagtttacatggcaaaagaggctttggagatgtgactgcgtaacagacagtgagatgggggaggaccctggattgtccaggtgggtccagtgtcctcacacacatgccttgatgagagggagtacgagggtctgcctcagaggagacctgaggatgaggtagaggccagagggggtgtggggctgagggcagggctggggggtggggtggtgttgtggggctgatgagggagctggggccggaggggcttggggccaagggtggggcagtggttggaggggtgccgggccggaggggtgtggggctgaggctggggcagtggtcggaggggtgtggggctgtgagccaagctgcatggtggcctctgatttgggagactccaggcaggaatgcagcctactgaccccttgacttcagccctgggactcctgactttcagggctgtgagaggaggtctgcgtgtgtggtaatttgttgcagcagcaataggaagttaatgcattgtatctattcacctccagacctttgaaaagtaaccctgttgtatcagccttttgtgtgccctaaattataatgagatggtttgtgggaaatagacacaaacgatggcagaacagatagttggacagaaacagtgtcttctgtggttctatgatttgggtctttaaagttagatttcgatcacagtatggtcttgttccaggtatacctgatatacttgttcagagctcctgggggagtggtctttaacacatgacgtgttaggattaaaacttcaagcacatcagagacagaggtcctgagtcagtgttaggcgacctttgaataagggttggggtatagaatctgcccacattactagtatgaagcagcaaaatctcatggttggtttttttttttttttttttttttttttttttttttgagatggagtctcattctgtcacccagattggagtacagtggcgcagcctcggctcactgcaacccccgcccccctgtgctcaagtgattctcctgcctcagcctccaaattgcatgatttattttcctgttttatatacttagtatatgaaaactctgcagactttattaacacaaatgacatgccagaacttacatatgataatccagcattttcccgtgcaaattagtggtgatgtggaattcctgggctggtttggttttataagacgtagggtggattctttgcctaatttctatggagctaacaattgttaatcacccagcactcttgcctcccccaacggctccggtgaggggtgttatcaccactgttgtgttgagaggcgggagactgaagcttagacgagcaggtgacatgttgctgtccggcctcacccaccctgtagtttcctgccatggcccagctatctttctgcgaaaaaggatcgacaccctggttctgggtagaattccttgtgaaccccgtttccattctccagggagttcttgctttatggtggtggctcacgggaggcctctggcccactgagaaagtggctaatgttgtaacatgactgtctgggctgctgtagattgggtgatctgtagctcacagctctggaggctgggaagtccgaggtcaaggtgcctgcagatctggtgccccaggacctgttgctcacagacggcaacatctcactgggcctcacgtggcggaggagcaggagggctccttcaggccttccaacaaggacaccaaccccggtcctgagagcgaggcctcccaaaggccacaccttttaacgtatcccatcggagattgcttcagtgtgcgtgaggttttggggacagacattcaggccagagccattgctctgctgtggtgttagggctgcgatggtatcattactgccacagagccacagccttctcagctgcatttgctgcaagaggaagacacaggtgcctgtgcaagttggggttcggtgcaagaagcggagaccctctgggaatcagaatcagcaggaggaacttaagggctttgagaactgacactttaggactgcaggagttttcttcagactgtaaaaaccttggtgtgtgacaatactgaacgttgcctgagtcctgaaatcctgtaaacagtgatggttaagacattccccgcccccaccccgaccttatttactgcaaaaagccccttcccatgtggcttaggctgacttgcaggtgaccctttaccaaggacaaggccagagtcaggacttcaaacacccattctctgcctcataagtgattagctaaactgccggttcccactgatcaatcagaacaaaacgcgtgttagccaaatcttggttcctcccgttctctccttacccgagcctgaggcccctctggagaacaggcagcctctgaggaaacctctgatccccgatcagccaccccatcgcctgcgtccccagccgcttcctcctggccttgttcccccttccctgtgaaggagagaacagtttcggctggccctgagatgctggcaggcctgcagtcagggcagtgggcgcctcccaccttgaaatggtccttcgtggtgcagttctgcttacggggtagactttgttgccttccacagaggacagttagggtgggcaggaaggaagtctctgccacaagtctgcattccaggctgtttccagaagtgggaattctctcgtgccctggagtctgggaatgcatttttagtttcccagcttcaggtagaattgaaattgagtgagccaacccaccacatccatctggagccaggaactagtgccgttttaaagcggcagtttctccgtaagattacaaaaaatgcacttagcacgtttcttactttgacatatgcatttggacatctaaaatgggaatggtggtttttgaagcatggatgtagttttaaattttgagtgttgtaaaccttaatgtagcttcctaaaatttttgcctgattatctagagatttactgaacctttggagtggtaatgagtttatctgtatgactttgctttctatgatgcaatgaaagtactataattaaaacctctacagttgggtgcagcaggcgattggccaaaacaaattctgccttttggtttttcttaaccaaacaagggagtaaagagtgtaggctgaagtggcaaattcatttcagagtacgccagagccctcaacgattgactgagcagccttctcaggtgaacatgtaacgtgccatgagtcttggcaaggctggctacccatgtgtgcacgtgacaccacagagccacacctgggaagatgtggtttctgtaacaagctttggaaaacctaagttcaacttaattatccaactttgttacagaaaaagctttgaccagatggccaaagacctgattctcttatggttgagacgtggttataaaattgcccttacttggtgccaatcagtgtttgtccacaacgatactcctccaacctcactgaatagtttggagaatgaaatgagactgtgaaaatctccttaaggtgaaaagcgctctggggcacccaggaatatccacacaccctgggccatcctctttaaggtggaaagggctgtcgggtcattgaggagcatccggaaaccctctttaaggtggagagggctgctgtggggtcgcacgggagcatccgcacaccctgggccgtcctctttaaggtggacagggcttgtggggtcgctccggagcatccgaacaccctgggccgtcgtctttaaggtggaaagggctgtcgggtggctccggagcatctgcacaccctgggctgtcgtggccgtcccacttgctgctcagtcacctccatgttcccacattcaggctttgggacactcttattagcagctcatcccctgggctggctgaggaaggagtgggaggttgtgctgaggctgtgtcaccatctgccctgacatgagctgggcaaggcagcggcagtgactccagaggaacctggtcactgagggttccagtaggaagtgcagaggcttggggtggctctgccggtcgtaaccaaatgtcttccctcttatttccacgattccttctagttctgtgccttgtactacagggtctctgtgtgcccataaatacatgttagttatgatacaggttcctctttcccctctgcctggagctgggcccggggaatgaagtgcagacctccttgccgctggatgcccgctggcatgaggcactgcctgccctgctaaggcctagagagagtcctggaagccccctcctgcacacccggcctcttgaggtgtacacaggagatggatgagctccccctgtcccacactgagcagagactggggaggcggcggcagcactgtcccccacagtgcatcctcagtgcatggaggaaagtctgttcatgcttaaaacacagctcgtcccctctcctcaaaagcaggatgacaaccgcatttacatccggaatcttaaaaaagggcccgttgggacatgagggttgcagttgagtacttgctccgaatgcactggagctctgggctctgtggccccagggggtcctctgtccactgagggtgctgggttacctggaaggtccctccagcctctgcgattttgcccttttcaggttaacatgtcgtcattttcctgaacagcactgcctttcgttcactgacccacgagtgaacagctggtcagatgaccactgctgcttccttcgactgggaagtggtgacatgattatacttccatggaacttggtttgttcttggtctagtaagggttcagttgtatcttgatgtttaatctgcaactctgaattggtcttttgattgcaaagagattgcttgctggatttgtttctaaatatttcatggataataggagaaactcacttacctgtgtgttcctgtaacgtgtttttgccgggtatttaaatgggtgtcttagtaagcccttagcccactttctgtgtgtggtggattcattctaaccattctgttgagaccagaggatgtggggtgctgtctccctaaactagggggaaatggcattattctgccctcctccctgggaacgctggggtttctgggtctctaacttggctcccacgctgggagagtggctgtggcttctggagcctgttttgtgagggactgactccttcacttactttattccacacggtcttcgccgctttatgatgcaaggatgagggaggtgggcccgggggccgtgcctgtgcctcaaaggctcgatgcagaaagtcgttgttggaaggatgttccttgaggcagtcttttctacttttaacagaaaagtaactattcacatggctctattctgctagtgatgtttcaaaataattgatgcagagttacaaagatgtcggagacacccatgacccactccgggctggggccaggccttctgctcagatgccttcagaccacattcagatgccaaagattcttgcttggttattctcaaacttaagagaatctaaaacacaagccacggtgtggattttctcttgagctctcatgcctttaattgctttgtatttggggaatgaatgacttcatcaaggggaaagaatttgaggaagcagcctctgaagctaggagggggtggggaggggtggcgtgaggagcagagggaagaggagctgtggggggaggagccaggctggggcctctccccatgatgctcccctacccctgtcgcgaggcctcggactgagactgactttcccacaggaaatgcatgtgatgattgcatgtcggttttgtgggctggccatatggattgagggaatgtccatgttgtgattcttcattgatttgaaggttggaaaggtttgtgctcaatgcaggggtctcttggtgcgatgggaaatgtgatcgcagctgccctcggggtgggaagagaggcccttggtggccggtgccggctttcaccttcctgggtgagctgcccttggggtggggagggaggccctcgtggcccttggtggtggccggtgccggccttggcctcccccagtgagtgctgctccatccctggtgtctccgactctttgcctggcactttcctcgtgggaggccgtgatccatcagccttgtccacgcgtgtcctgcagacttgtgctgactctgcaggtccagcggtggttagaggaggccctcctaaacgtttaatgatggcgctgctgagtgcatgaagccacgtcagccccagagtccaggtagggaaccgtggggtagagggaagagtggacagatgggtgctttccttggcccctgggggcatggccaggtccacgttcagacctcctggtttctcccgtatttccataaatagccaggaaaggactcaggacccctaggacctcatgggtgtaagctgtgtcctcgtgtggccccagctgtggccagtgacgttattctctttaacctcaagcttattttgtataaaaacatgaagggacagaagtagttcaggagcctctgaagacttacgtaattgttagtaggcctacttttatgatttcttacgtattaagagcaaatcatgaaacaaactcatttctgtttgaaggaatctttactgttctcatttttgtggcaagtgacattgattctttgcatagtgacagcgttagtgcactcctgcccagccctgctgcccagcgtgtcctcggcacacacctctgtccattggtctccattcaccaggtctccattcacctttccacctagaattgtaggggggcactgggatattggggctagaaggaaactctgaagaccacttctaggggcagcttagtcagggctctccagagagacagagccagcccggtgtgtgtgtgtccagggggaggcttgctgcaggggctacggaggccaagaagccccaggacccactgcctgcaacctggaggcctgggagggtgtggctcaaaggcttgagaagcggagggtgcagatcccacccaggtctgaggagctgagacccaggagcaccgggggcagaagacggatgccactggcctgcagccagacaggtggagcgagcccagccttccccgccttgctgttttactcgagccctggagccctgggtggacagggtggtgccccctacactggcgaggatgggtctccacttagtctccactcagtccagaggcaaacacacatctcacacagaaataatgcagaaccagccacctgggcaccccggggcccactcaggtcgatacacaaaaccaatgccacgtgtggccctcatgtctgcatgttcgcgtcactatgcgcattgctcagtcatcgccttggtgagcttgaaagctcattgtgtggttctgggtgtctttgtcctgggcagtggtggtgatgacaggctccccaccaccccagctcaggcacaggtgatgccaccaatggctccttatttctcagacgcttgagccgggtgctctgtgaagccagttccacttcccgcagcatctgttccctatgccgattccattcacagtatgtgccttccttccttggggtgcagccttctgtcagggaggaactgtgtcctattcacctacgtctcctgtgatgtatctcatggctgaataagtacctataggatacctcggtggcagaatgataggttcattggaaggaaaacttaatacttttttttttttttttttttttttttttttgagatggagtttcgcactggtcgcccaggctgaagtgcaatggcatgatctcggctcactgcaacctctccctcccaggttcaagtgattctcctcctttagcctcccaagtagctgggattacaggcacctgcgcccggctaattttcgttagagatggggtttcaccatgttggccaggctggtcttaaagtcctgatctcaggtgatgcacccaccttggccacccaacgtgctgggattacaggcgtgagccaccgcacccagcaacttaatatcattttttatcatttataatgggcttgttcaatacttaggttacttttattttttaaaacgttatctgtgacctttcagcttttcatagcacttctcgcgtgaatctttaaaaaaggtcctttagccgtggggaaggagttatccgtttgagcagagggaggcggaggaacaggccttagtgggtctgagcacaggcagtcaccccagccttggtgcttatttacgtctgttttccattcaccatagcagtgtccactctttgtcggcttaaaaataagctttttcctccgctttctaatcagaacagttagtttgttaaccatccctttatcaagaacgatggctgtcaggcctcagattatgacacaagtagtaagtgcggctgaccctgaacaacatgggcttgagcttcgaaggatcatttacgttaattttttttcccaaccaaacccttattgaaaaaacctgactttgtggagggccgacatttcctacatgcagctccacagggtgggcgcgggtcctgcggacgcgtggatttcggtaaacccggggtgtcctggaaccgatgtccctgtgtagatggagggacaactggagctttttaaaagtttgtgtcctgccttgttctaaaaaggcttcaaggtagatgcaaaatcatttcattctttcagttctcttggtgggatattgatgtttgttcttcagtgtctcaaatcctgagtgagaagagttagtgcttcagggacaaagccacagtctggaaacacatattgagatactcactttttcttcatggtttcacaaaaggttgtggtcatattttattcagttgaaccataggaaactgccaatatttggctgtttttggcctacaaaatggcaagtttgtatattaaaaccaaaggcttcctggatggggaaaataggaactaataagaacctgaagttttctgtcatggcccacgagtcacaggtgagtaaacctgcgtgaggggacgttggctgtacagtattttctttgttttgagactgtcagaaaaaggtcagtttgattccgtgtgggccctgcgcctcgcctttgctgcagaggggatttgccattttacctcttgtcccgagtgcccaggaggctgatgccatgtagaagacctgcgggtcggtggatgtgaacgggcatcggacacactgcaccttgggacacatctgagaagtgcgtgctttgcaccaggtctgcggtgagggcgtgttctgtctcctctcccttctctggctttgcaggccttggaagttggtcctgggaagtgaaattagctaatgctaattagctcaaggtcaaagcccgaatcaggctcatcatttcctgcagtgtccacagcagcaggtcgtaaattcgacatgatctgaacccggagagtcgagattccgccctggtttgcggctcggttgtgtgtggtcttgagaaagtgaacatgggttttcttgactctgagggggccgacgagacctgcccttcactaggggtgttgaagcattgggccttcctgtcaggaagcagccagggactcgagaaagcaccacgtgccctccagttcccttacgttgaaatggtttatactcagccacgttcccttatgttaaaatgatttgtactcagccatgttctcttacgttgaaatggtctgtactcggccatgttcccttacgttgaaatggtttgtactcggccatgttcccttacgttgaaatggtttgtactcggccatgttcccttatgttgaaatggtttgtactcggccatgttcccttatgttgaaatggtttgtacttggccatgttcccttatgttgaaatggtttgtactcggccgtgccaggtcattttgggaggtaagtggggagtttcatgtggggttgtgcagtattcttaggtgtcaggtgtgagagttgaatttgtagaagctgtgcagataggaaagggcctggcaggagtgctatttacatggagctgacttaaccgaggtctgtgctctccctgggtccatgtctggccgttctctcccagtctgcaacgggaccttcacgtgactcagcaccgtcggcccctctgtcatcccactgcgtaaacgtctgaggatctgtgcacggctgctctgttagtgagttgtgataatgaactgagaaacggtgaacacaccctgaattggttggcactggttccacggccagttccgccgtggttggagtcattcatgataaagtgtgctggactcctacacagagctctgaaattcagaggccctttaactcggcagctaaccagctgctgctttcagaagacattcgagtcccctttacctgccagggtgaccctgggaatttgaaggtgagtgagacaagctctccctttcttgtggactttactgtccagaggggagacggatgtggatggtaaaggaggccctatcggaggtcagtgcatgtcggttttatttcttcagcacttgctgtgttcaggtggtgccccaggccgtgtgcagagcatctggggaccccgcccgtgacatcccaggcacagctaggatatgtgccgtctccatgcttggcccagcttttggggggaagtaccgaggagggcccctgcctctgctggagagggttggaagtcagggcagccttccacgaggagatgatcgccagctgatttctccagaaagggtgggggggggggggtcccgcgtgggcagagcagggcggcatgcacagacccgggtgtggggtctgctgggagacagcgggggtgaggtgtgaaggcagttggaatttacaggataaattatcactaaggtgatgttgggaaaacatataaaattgggactctctggggtaaacgtggacttagggttacactgggcgtgggtgtttgcaggctctgaagtcagatttaggaaagtggggcagagctgagccccagatgacgatgagaccaccccggggggatgttgaatgaggcagggatggaaacccagtgagtgtcctggggttggtcctgcaggaaggcggcagaggagaccagtgccctcaaaggtgtggggactgcctctcagtgctgggattgcaggcatgagccaccgttcccggccactactggcataatttgtaagctactctctcatacccactcccatatatatatttttaaaaccagttttatggctgtatttcttccaagagaaccaaactgttacctgtttgaagtacaaataacagtgacctcgtgtttaaaaaccaaaaatgccattttgcacagaagtttccaaatacccagttggtttgagccttgcagtgtcatacctgctctcagatttctacacgagcagggacggctcgtacatcttcaggtttccattctactaacttaactggagctgtattctcatggtatttattttgaagcttgtcaaaggaacagttgggaaaaatttcacatttttagaattttcatagtaatagttataatttacaaagaattaaaaatagtgttgtcattattttgcttttttctagatgtgcctccaaacagggttgctaattagtttctgaatcccaggaattcagaaccataccctttctaagcagacacctgtaatcgaggaattccacctagtcagttcactttaagcattttaaaaatattttctttatgctagttggtacctgtggctatagtttattttcactgctgaggaatattccatggtgggaacaaaccgtcattcatctgttttcgtatcgatggacatttggattattttgggagggtatgtatgtctattcagccttcatttttttcaggattttttgtagaagataatgtggtgatataacatccgctgctacggaggcaacatgagccctcattacagccacacaaactgtcacgccttgttaccaatacacagaaccattttcttcagttgaaacacagcagaacctgaagtcatctgaatgggtcctccgattattacacttggaattcactttatattaatatgcttcctaattagcagaaatatcaattatacagaaatgtgagaatgtctaattatacgtttataacagaaaaaaacctcttgttgaataccccagaacacatggctatgaatgtgtctccctcatgccctaccactgttttcttcgcttgaaatgtgaaatgacacttgaatatggttttctggcgacttagactcgcatcgttcttcagagacaagatgtaaagcacatggagactttctgctgtttgtggaatgtgatttcctggtcgcctcattcaggccgccgctgtcttcccctctggctgcctgcactgtgggacgtctgaggagaggtccctgtttcatcctgtggaagttctgaaaaggaaggagaggagggtgtggggtgtggtacctttgtgttggtcccttgagcttttatttggagtctcggttaccttggtggttcctgccttcatgtccctagctggtggcttcgtccttgtgtctaactcaccggcaggcagatgaaaagggaagttgtatttagccaacagcttgatcttattctcaaggctcaaatcgactgggtatttgtaaacttctgtgcaaattggcatttttggtttttaaacatgatgttttatttgtacttcaaatgggtaactggttctcttggaaaaaatatagccatataactggtttttaacaaaataggggagtgggtgtgagagagtggcttagaaattacaccagtaatggcagggcatggtggctcacacctgtaatcccggcactttgagaggccgaggcaggtggatcacctgaggtcaggagtttgagaccagcctggccaacatggtgaaaccctgtctctactgaaaatatgaatattagccaggcgtggtggcgggcacctgtaatcccagctactcgggaggctgaggcaggagaaacacttgtaccgggaaggtgcagaggttgcagtgagccgagatcacgccactccactccaccctgggtgacagagcagagactccatctaaaaaaaacaaaacaaaaaaaaccagtaatggaaacctgactgttatctgtgatggaggtggcggcttctttcattttttagtgacaggatgaattggatgtgtgtttgcagtgttgatcttgacaagggaaatggtcagaaccaatgtgccacccagcttgggccttgccaccggcagaagaacctggtgggggacagactggaggctcggagaccgaggggggaattctcacgccatgaagctggtgcagtcactgctcctggactcctgctggagggaggcggccccttcacctcgcaggctctggtgcggtggagaccttaggacgacctgcctaggtcatcagaatggtggctgtaagatatttgagtttcaatagcgtttctgggttccttctatttttaatctgctttctagcactaggtaagtgaagatatgtaaagtaaaaacccgtctaacttgtagagatatagtgttgtgtaggagcagactatggcctctggctctgtttaaagattgtagtaaactctcatctggcatggtcagggtgcaaattatcttgttgaatcgaaatgtgaatgagtcaaagctggcacctgcatcgttgatgaaacacctgattttaaaggaacatgtcgatatgccgtaagataccagcaagttcctcactgaggttcggcgtgggttcgcaggaactgggccttgtgtcaccagggtcacctctgggagaagatgctcagtgtgggcgttagtcatttagcctttccagagccaaggaacagcttgctgtggtttttttagaagctgtattttgagtcagtttgtcccacttgactcgaaggtgctgtgctatttcagacctttgccttgcaccatgtactcattttcttgtcccctgataactaccttggttgcccctggcctgacattcgagcctcgtcgttcatggacgcagaggctcagtggtggggctcaggccgtgactccggttttcacagttccgtgcctctcactgtggtttatcacgtcactcccgggacctcccgtttagaggaagagtgtccatttcccacaggccctgtgtgatgtggaaaccactcctacctttctcctgtttgaactatactgtgaaaggtatttctcttctagtcaaccgtcagaatcttgatacggtgatttatgtaacttatcacacgcttctcagcagttcttatgaatttcattctgttgtgaaattattgcagttttaatggctacattggtctcatgttgtggcccttggtaactaccttgaaatgaattgccttcccccttgtgtgttaaggtttcacctgggagcctttgaggcctcacctctgcatagggcagtgcctctactctcctgacaagaggaagaatctcattagagtatttctagtgtggtttttgcttccagacagaattacttttttcacaaagagacatccactgaagtcgtaaattatgctcaggagggacacacgggttagctgacagagtggagtccagaagacccaaagatgcaaaagcaggtcagtggaatttgagtcttttcaacaaatggtgctggaattatcggacagccatatgcaaaagagtgaaaacaaggagaaattcctgtatgaaaattaaggtggaccataaccctgaatgtaaaatgccaaactagaaaacctgtagaagaaatggaaatcgtcgagaccttgggtcttgacctagggttagagctcttagccatgataaccaatgatccatagggaagaaaacaaggagacaagacttcatcaaaattaaacttttaatataaaagacacccctagggaattgaagagacacattttctgcagacagggagaagatgtctacaaatcatgcagctggcaaaggacttgtgtccagaatgcatacaggactcccaaagctcatgactgagagaacaaaccacctgacttaaaagcgggcagagacctgaacaggtgctccatcgagaaggacggggagggtggcctgaaagcatctgaaatgaccttcagtgcgactggtttcagcgagatgtgcattgcagctgcggtgaatttttttacacccctgctggagcggctgatggaaggtcttcagcaccaggtggtggtgaggacagaggcagccgggactcctgtgtgatgctgcggttcagcatggtgcagacggctcagcagtttcttacaaaactgaactcacacaaacgtggggcccggtgaccccactcctgggtatttaccccagagaaacagaagctgatgttcaagaaaaactgtgtccagatgttgaacatgggggctcttgtcagtggctggggtgagagtaccagcctggcaggctggggtagcctgtggggcagttcaggcaccaccctccccgcctgcgggacggcagctggaggagctcgaaggctgcctgcctcacgactgtcagcacagcagcccctcttggccctggagcaagctttgggtccacgagcctctgcgcttggacttgcctcctgggacctctgccgggacctctgttactgtcctgatagggccctggtgtcactttcccggcagggacccaagccgcaggcagctgcgacctcagattcggttgaactttccctgacctctcattccagcatgagtgctcacctcacccagtgcggagcctcaggttcccttgagacccccggagatggaatctcccaatttaacaagacagttgatgacaagatttgagcagcactgatttgactcagcttccagagtttaagttcccaggacacagtcctggtccttccctgccctcctgtggctggtgtggatgtggggtttccggagggtcagggctgaagcagtggctggtgtggatgtggggtttccgcagggtcagggctgaggcagtggctggtgtggatgtggggtttccgcagggtcagggctgaggcagtgcctggtgtggatgtggggtttccgcagggtcagggctgaggcagtggctggtgtggatgtggggtttcaggagggtgagggctgaggcagtgcctggtgtggatgtggggtttccgcagggtcagggctgaggcagtggctggtgtggatgtggggtttccgcagggtcagggctgaggcagtgcctggtgtggatgtggggtttccgcagggtcagggctgaggcagtggctggtgtggatgtggggtttcaggagggtgagggctgaggcagtgcctggtgtggatgtggggtttccgcagggtcagggctgaggcagtggctggtgtggatgtggggtttcaggagggtgagggctgaggcagcgcctggtgtggatgtggggtttccgcagggtcagggctgaggcagtggctggtgtggatgtggggtttcaggagggtcagggctgaggcagtgcctggtgtggatgtggggtttccgcagggtcagggctgaggcagtggctggtgtggatgtggggtttcaggagggtcagggctgaggcagtgcctggtgtggatgtggggtttcaggagggtcagggctgaagcgacttgttattgatcaatgtcttgaggatagctgggattaatgacctttataggactgtaggtttggggtatttttatttcattttattaaatgacctggatttcacatggggtgacctatggcagtgtggcctcccacgtgcccagcaatccgtgtgctgacgctgttcctgtgtgtgatcccgtcatcccacgaggtggccacggttatcaccgcgttttactgacgcggaacttggagagcagagggtttaggaaactcctgaagtcatggtatcagcgggaccctgggtggtccagccttagaccctgcactgtttgcccctcgccacgctgtcagcagggacccgggtagtctggccttagaccctgcactgtttgcccctcgccacactgtcagcagggacccgggtggtccggccttagaccctgcactgtttgcccctcgccacgctatcagcagggatccgggtggtccggccttagaccctgcactgtttgcccctcgccacgctgtcagcagggacccaggtggtccggccttagaccctgcactgtttgcacctcgccatgctgtcagtggggacccgggtagtctggccttagacactgcactgtttgcccctccccatgctgtcagtggggacccacgtggtctggccttagaactcatgctggtcgcccctccccaccttgttgtggggttttccccacaaaatgtggggggcagcatttgatagcttgtgaaacaagaccaaggcttaccatgagtggataagccattatctatctgagatccagaacgttccctggacctggccttgcagatgtcacctaaagggaggtaaaaacattttcattgtggtcattggggctcttgagatggtgtttttcccagtgaaagtttcctcacaaaaatctgttaactcaatactatgtgaacaggaagagatgtgttgggctctagttaaatgtctcagagccacagaagtaaatgagggcaccttccgagcacagcctcccggaggaggccgagaaagtttgcctggagggtttaccatgaagcgggacttagggctggtctgcctggggtggcctctggcgtgacgtaggttagtgaagtagtgaggggtggtggcgtgaggttggtggtccctgaggaagcccctagcaaggccgcttgtggtggggtggaaaactgctgttcagtggctgtaatcctggtttcatgtgtccgatatgcattcctgcacttggatcccagccaggtcagatggccctgaaaggacattcaggctgtgatggctgcgtccattctcagcatctgcagggccttcccatgtgtgtttccattttctttcagaggctcagcacaatttaattctctctcccagagaagttgtgagaaatagaaggaaacgtggaatgaagacgtggttgagggaagtgtggtgtggtcttggaccttactttgccttggttggtgctcaggaactccacctgcccttagagttgagccgtttctgcccaggagtcctgcctttaatcctgtgtctccttgaggcccgttgagacactgcaagaagcgtcattaccaaattgccttttccttttacagcagttggatatatttgctgcaaaacaaaggaataaccccccttaaccctctaatatggtgattaaatgcatttaagtatagataaaattcagtcttgaatggcctggtgttttaatcatctttgggtcatgtaactagtgttgttggtgattaaaatctgacagctttgttctgccacaatcctcagttttgaatgatgatcttcctggttgtaccttgcagcggcgtttgtggcagtagagagcagagtggtggttcccagaggctgggaaaggacagaggtgaggcccctgcaggacgccggtgttcctggtttaggggatttgggctcagccaccttcctgtgtccatgtaaattatacccaggatcatttcactcgccccgcttcagttgagtgttggagcttcaggatgtgtgtgcccacatcacctgggccgtgatcctggagccaggtgagacggatttcccggttttatagaattactctgggattattaaaagcgcttgaggcattcaaatgcgatttactgaatgtaatactatgtggaatactcagggctgtgtgtgtttgggaacacccgtcttctgagcgaattcagtagggaatggagagaggcctcctgtcagcttggtcctctgtttccagcttgtgagggcgatgcccgctggtgtcccagggagagaaaaacagggtggcgtgggatggggaacgcttgctctgacgaagtcagtgggaaagtgtctacacaaacgtcggtgttctccgggctcatagaggtcaagcttgttttgtgttgagggaaaagtacccttgttccttaccatttgaatggtgtccaaggctctttctgctggagaggtgatgcccgtgagtgggggccaggtcgtgggccctgagattgagaggtgatgtgcgtgagtgggggccaggttgcgggccccgagattatctgagaggtgatgcgcgtgagtgggggtcaggtcgcgggccccgagattgagaggtgatgcgcgtgagtgggggtcaggtcgcgggccctgagattgagaggtgatgcgcatgagtgggggtcaggttgtgggccccgagattatctgagaggtgatgcgcgtgagtgggggtcaggtcgcgggccccgagattatctgagaggtgatacgcgtgagtgggggccaggttgtgggccccgagattatctgagaggtgatgcgcgtgagtgggggtcaggtcgcgggccccgagattgagaggtgatgcgcgtgagtgggggtcaggttgcgggccccgagattgagaggtgatgcgcgtgagtgggggtcaggtcgcgggccccgagattgagaggtgatgcgcgtgagtgggggtcaggtcgcgggccccgagactagagaggtggtgcccgtgagtgggggccaggtcgcgggccccgagattatctgagaggtgatgcgcgtgagtgggggccaggttgcgggccccgagattgagaggtgatgcgcgtgagtgggggtcaggttgtgggccccgagattgagaggtgatgcgcgtgagtgggtgtcaggtcgtgggctccgagatttggaatctgtcaactgatttcctaaaaacacagatgcttggtaaagatgttcctgattagctaaaacatttcaacaggacatgatggctggtggttgtttaaagagtatcacaattttcctgttactttttaaatgcctgttgaataggggagtattggtgtatatttttcttttcctgtctgcatagttgatgttttgtttttagttatgtgggggtgcagttagcaggatttagaagtagtctcagccctggggagacttcagggcagcctcagagtcagtgctgaagggatgcagggatttgggggccacctcctccataggacagacaccaagggacagaggtcagtgaggtcacaaagacggacccacccagcaccctggcccccgcgcctctctctttcacatttgtggctgctcaaagctgctctccttctgcgtcattacaggcgatctctaggcacgtgcttggttcttggagaagtggcgtctggctgtggtcagtgtgggccctcaggtcttccatgtttttggctcacatcagtattgggcagtggtgtgtttttgttttggagcgatcgggtggatttcggctttgataactcatttaatacctgtttctgcatcgggtgttctttattttattacaaggaggatgaccgtggcagaactgcttccggctgttgagcgctggctgagagctgcttggcgtgcacagatcggtttcagcacagtctcgggagcagccccgggcagtgcagaaagcgaggcccaggtgaggctgtgggacacaagagggccctgacctgtgtgctttcagcctctgagccgcccctctcctgactgcttacaaagttatatcgatactgaaatctgaacattgaaagttcactaggagaatgccatttccagggatgttactgtgaaccttccgtaaaggaccttatgtaggataatgaattgccttttaatgcaggtaccaaacaggctccctgggataattcattccatataaactttttaaaaaaatgttcccaactagctatcctataattctctttctgctaagagaggtgctccgttctcctttgcgctttagtgatatgccgtgtttgctttgcatgccccttggcttttcagaagaaaactgcgtttgcagatgcacttggagtacaacgttctttttcctatgagtgtatttatggtgaaggctccattggaggagatatgctcatgcatttctctgtgtgttgtgggggataaaagtagtcactgattcttgcaaacctagaagatgcccaaaaggtaatacatgtgaaaatatgtggcaactgccataaatcgccatgtattatgtgtggcaaagtgctgtgtgttttgtttatggagaaaattagtcttccccattttcccaagaggtaacacttgaatatacatcagaaattttatttgaaaatggtaccttccttctattgttttgagactatatcataggaacttaggtatataattttctcaattagaacctccaggttttgtcatagcccctttgtgtcattacagtgtctgattccactatatttaaaccaggaagaggccggccacgtggccacgctggtgcttcccaagcacagggtctcacaagggcgtgaacacttggtttggagacacgcttttcttcctgatagaaacgctatcacaccattctctagtcttctgcggtgtttcctccacctaaacgcatccagtttctgttggtttttagtttatttatattttctgagacagggtcttgctctgtcacccaggctggcatgcagtggtgtgatcccagctcactgcagcctggacctccctggctcaggcgatcctcccacctcagtcccccaagtagctgggacctcaggcgcgcaccagcatgcctggctaactttcttttctttgttgcagggatggggtcttgttatgttgccccggtgtgactctgttttatgttaagtgtacggtgggtttttacggagaacctctgtatttgggttgggtgcatggcatcctggtcagggagctgccctcaggcttcctttctgcccagcagggtcacgagtggtgtctccacctgggctggtgtgggtgctggccggtagggcttagccctgggctgcagactggtgccagtccacggtctgttaggaaccgggtttttgtagcagggggtgggtggccggtgagtgagcatgactgcctgagctccgcctcctcttggatcagtggcagcattagattctcatagacactggaatcctattgtaaactgtgttctcatagacgttggaaccctattgtaaactgtgcgtgagggatctcggaggtgctccttatgaggatccaatgcctgacctgaggtggaacggtttcattccaaaaccaccccccagaaaaattgtcgtccacgtaaacccatcgctggtgccaaaaaggctggggacagctggcctaacatgtgctaagatgtcagtagatttttggactcggacctcagttggagaggattagattttgaaaggtgggggattgaaggcttctcaaggacaagttttcatctccagtagggcctgggcagaaccgggtagaactgacccagaacctgacaaccagccagccccggctcactgcctgcatcctgtgtgtgcagccttgctgtttgattctctcgtggtggtgggttccatccatggcctcagagggtaatggaacccattacttcaaggctgaccttatttaactttaccaaaaatacattaaaatcatttagtataaatcttccagatacttgtatcttttctttttctagaggcttttaagtattgcaacttaaaaatcttcaaatataactttaaaaaaaacctctaagtacatttttgattagcacctttgacagcttaacatgttaagtaaattcccttgacttttgtattcctagaaactcatatttgcagaagactgcctgtattttgtcaacagtggccactgtttgaccatcatacttgccatctctcatttagaaagttgggtgtggatgtattaactttttagacatacaaacacatgggctgtttttgttgttttttccccagctgaattcaagaaagggaaacaagtagactagagtaagtatcagaaagcgtctaagtggccaggtgggggatgtccactttgtggtggggaatcctactttggtgttggattgcattctgccagacatcgctcctagaaaagctgaccctgaagggcttggtgttgccctcaccctgggacattggtctctctcaccagaaaatgaataatctgccagaatactgtgagtcaaattgtcagaactcgattaaataagaggctttgtctcaaacgccaaaacatgaggacacacttctaattttttaaggagtgcttcatcgtgagtcagtcctgacgtgtactatgttaggaaacctctgaactccacagtcaagccagagctctgacagaaagtggttgcgcccttctcactgtgtttttgtcactagctttattcatgaaaattatttccttaaaaccctctttgtatgacttctattacagtttggaaaaaaaaattatgtggaactggaagcctttctgcagcgttaatattcatggcctgttctgggtctcggtatatgtgtactatacaaatgtgtacttgtatgtggtgtatgcgtactatgtattgccattgtacatgtatttacaatgtataggtatgtacactacatgtgtcctacatgtgtgcatgctatgggcatgcatgtacatgtgtacatatgtgcataactatgggcactattatatccacactatttggacatgtatctgtactgcatatgtgtacatacatgcatgtatttaacgccatatatgtacctgtgtacatacaccatatgggtatttgcacatttgtgtacttatatatatacatgtgtgcacactgtaagcatgcatgtacactacgcacactgaataaacttgtggatatgtgcacactaatgtacgcatgctgcatatgtacatacactatgtactgcatatgtacatactttacacatgtatatgttagtgtactgacatatatacattatatatatgtgcatatgtatacactacgcatgtgtaggcatgctgtagtgcactgtacatcggatatgtgtacactatatgcatgtatatagatgttatacctatgtacatacaaatgtgcatgtgtatgctatatgcatgtacatacaggttatagtatacctgtgtacactggatagagatgcgtgtacatgctattcatgtacatacatgttatagtgtacctgtatatgtacattggctatggctgtgctttattcatgtacatacatgttatagtgtacctatatgtacattgtatgcatatagattgtgtgctagatgcatgtacatgtgttatagtgtacatatgcatgtacactgtacagatgtgtgtacatgctatgcatgtacacattatagtgtacctatgtacatatgctatatggatatggatgtgtatgctctgcatgtacatacattatagtgtacctatgtatgctgtattgatatggatgtgtgtacactatgtgtacatacatgttatactgcacttacgtacatacactatggatctggatgtttgctctatgcatgtacatgttacagtgcacatgtttgtacactatttggatgtgtatgctctatgcatgtacgcatgtgttatagtgtacctatgtatgtacactttatggatctggatgtgtgtatgctctctgcatgtacacacatagtgcacttatgtttgtacactggatctgtatgtgtgtacgctctatgcatgtacacatgtgttatagtgtacctatgtacatacgctatatggatctggatgtgtgtacactgtacacacatagtgaacttgtttgtacactacatttgggtgtgtgtacactatgcatgtacacacgtattatagtgtacctatgtgtgtacactacatgaatctggatgtgtgtatgctgtatgcatgtacacatgttagtgtacctatgtacgtacactaaatggatctggatgtgtgtatgctctatgcatgtacatgttatagtgcacttaggtttgtacactgtatctgggtgtatgctctacgcatgtacacatgttagtgtacctatgtacctacactacatggatctgcatgtgtgtatgctctatgcacatacacatgttgtgcacttatgtttgtacactgggtctggatgtatgtacgctctaccacatacacgttatagtgtacctacatatgtacactacatggatctggatgtgtgaatgctctatgcacgtacacatgttacagtgtgcctatgtgcacacactgtggatctggatgtgtgtatgctctatgcacgtacatgtgtgttagtgtacctatgtacgtacactatatggatctggatgtgtgtgctctctatgcatgcacacatgttatagtgcacttatgcttgtacactatatgtagttggatgtgtgtacactatgcatgtacacatgttacactgtacctatgtacatatagtatgtggatctagatgtgtgtgtgctctatggcaacaggaatagggcccctgcagggatcccggaacacaccatctcgttagcaccggagagtataggatgaaaacagttgttcattacaagctagtgaaatttggcaggttagtagatgctttgcaatgatttaggaaccaatcacttccttgatgtgtgtgttcctgacatcataaacagctctgtgaggtgtgtttcatccccagatgagagaaacgaaacaacagggacttggtgatttcagtgaggtagaactaatatagcagctgtctagctttccatatcacaactttgtcagccctcagctcaataaatgagaagtcgccactcatcaggaaacgtgttcattttctactgttctttattcgtggagtatttactgccttgtgttcttcatgatgtagcaaaatccctcctagtgttgtgaatataaacagttcatgacaaatgcagtatcttctttgttaacgttgaaaatgatatgtaagttcatcttcaggtactgtttggaaggatgagaaagaagatatttaggataaaagaagaatagagagctttcgagtaaacagggaaaataaggactttgtgcaaaacatttccaaatgtggaatttgagaataatctcaaatctaagattgtagttatttggatttttaaaattagtacttagttttccacacctttgggaatttcacccttgatggaggattgcaagaataatctgatttttcagaacagaaggacagtctgtctcaaaggtaaattccaggttctaccatggagaaatagaaattgctcccaactttccaaaaggttcttaagttctttcttcttttgtggttaaaaaaaaaaaaacacaaaaaaacaaaagaaacaaaacaaaacatctctgggtttagtctcagccaagttcctcttactaggttgccttacatttctcccaggtgttcagagtcttcatcattactagttatttagcttgttaaaagcaaaaccttgtattagttagatctgagcaccttgaaggcagggctttgttttatactttaaataagcagcaggctgatggcagggctggggcccttcatcccatcatgcgttcctctgagcattcagagttctcactgcgtgctgagtgtggtgttggctcttgaaggtttaaataggaatacgaggctctgcgactcgcgaagctcttaccaccttcatagagagcttggtgacggcttagcatgagaaagtacacacaacaggtgtgcaaactgttacggccacatagaaagggtactgacttaaacgtgactaatttctcatgcttatttttgcctttatttctagttacagtaccgatacttcttcttcctctaaatttttgctaatcgctagtgaattagtgataaactgtatttacatgttctctaaatccagtgacttaactggaggtcattcttcttgtaccatgtgtcagtgctatgtcaggatggctcagttttaccttgtcaaaggattaattgcagtaggatgcagccatactggaacttactcatttatggaatatctgcgctttattttttgttgttagtcacacttgaggtgtgttcaaatgtaaacatgctgagcagtgttagaaagatatacaagattgtaacgaagtaagaaaaaactggatcaactaccagctaatgaattttatattttaagtaaatggaatgtggaccttggcaattagttttcatcttgccctcttatttttttttttattagacagaatcttgctctgtcacccaggctggaagggtggagcacaacagtacgatcttggttcactacaacctcctccacctcccaggttcaagagattcttatgcttcagcttcccaagtagctggggttacaggcgcgtgccaccatgcctggctaattttttatttttagtcgagatggggttttgccatgttggccaggctggtctccaactcctgatctcaagtgatcacccacctcaccttcctaaagtgctgggattataggtctgagccaccatccctggcctgatcttctgttttaatattggttattcagtctcaatgatagcacctggttgtattaaattggagtagaaagcacaattgaaatgaatgtggttgtgtatgtacatgctaatttagcgctcatggcagcactgtgaggtgggcattgtttctgaaggaatgccggatgggcaagtcagggcttagatacgggacttgtgggcagttactgctgtcccatggctgagaccaggcctgtctgactcctgtaccctgaacgcttcttaacattgcctttcaacacacgtatgagtaattgtcaagagtcagtgagtgctcgagtgtgatgtggtctgtggcgtttgcctcgcagtgttgctttggcttgggataactgggcgacagctcccttccttctgcagctgcctgggagtcccaggagaaccccactgataccatttataaatgctggacatgtgacattctgcttggtgccagcacatctggaatccgacagcgtagttagattcttggtcagcaaacccgtacaggagcgtgtgaactctgcatttgcttctcccggacaaaggtgagttcctggtcactgtgctggatggcaacaggtgtggcctcaggagcaggacagagactggcacccacgtgcaggagtagcatctgcaaggaggtgggggatgtgacagacacaaaaccactgaaatcctgaaagtgcgagctcagctgttaccatggaggagaggcgcaggtaagaccagattgtttctcattgttgcacgtttctgaaaatgaccctaaattgactcttctttggctccttgcgcttcctagttgggtgggaggaaactgtgcccctggctctggccctgcttgcggcgagatggaggctgctgtagcttgccctgccctccctatgacttcctctgtgctgttctcctccaggaacagttctgctgagcaagcttggactctgctcccttctgctcttggatgtcatgtctggaaggcttgtgttcttttctgggttttgatgatgctgagctatgtttttgcaaggatcacacgtgcccatagcagggagaagcccctttgcgacttcaacatcttgacactctcagcagagctcgctgtcgaagttgagagacttttgcgtttgttttggcagaagctgagtttcagtcctaggacggcctcagcacacttgatcccagctcctttctctcactgctcccctcgtgtatggcagaaatcatatgccctgaagtttaccagtcccttcatttgaaaacttcagttaatgtatatgatcctcaaatgagaattttactttttataaaagcaatcacaaagactggattttgcgataccagtgttttatgtgtagattaattgtactcacaataaactttgtcttctaagtattaataattccatgtttcagattagcatggaatcatgccctggagtagttttgcttttccgctgtttttggcgaaggtaaagttgagaacgttgtgatattagctgtagtgagcctttagttccttctgtctattttccttgaagccaagaccagcagactgattgataccagtttgtgagcgcctggcatctcctaggcctttcgtgggtcttccctctgctgtctcgtgggcagagcagtcactcgtggaaggtgaacctgagaatctgtggaattacataaacttcatagctctcttctgtgacaaaccgaatcacattaaacccagtaaattgtaacagcaggctttgcacatacaaagcattgaacaccagaacaggaaaccgcgttgcgatgcttctggtcctgcacaagacctctagtatcatagcacattgaagatagtggcagcattgagtgtttggaaatattatgtaccatggccttgattttcgagggcctggataaacacctctgtggttatggcaaactttatcaatgggagctgaaggttagtgctggggcagattgtgtttcaaagaatcagggtctcttgagtatgtttcggttttcccatgaagaagaaagatgttacctgttctttcctggactgtggctatcagggtgccccaccacgatcactaatacatgtaccctgtttccatttagctgggcttgggccagagtccttccgttgtcacacgtcatatgaggctgtctgctgaggaattgtcttctgcttcatcgttagcatgttgaaatattgctttccaaagcatattctactttatcatttgtatttatgtaaaataatggaatggttattctaaccgtgcagtttcctatccttggttatttaattgcggaaagataacagtgggttttattttgctaaaatctgctaggaattgtgcaaaatctttgtgaaatgcccaatttcctagcttaagttatagatgtttgtatataagagaaaaagcctattgctaaaagcagcaatgtctttatcgatgcaaaaagctttaaacttactggccgtgtagtcagtaaaatgcatcagaacgtggcaaaaattgagaaaagcattgaagttttaaaatctgctatgcagttttcttcaactcccttgcaagatacttaatttgagtagaagacagaataaagtgttcccgttgaggaaagtgacagggaggaccgttcagaacgtgtttggaatctgagcagtcctgtcacgctctagtctgtgatgtggtggtgtgtccatggtaccactttatagaacttgaagaatgctgcttctgtgaataaaatacattttattcttggcatttcatttgtgagttttgagatgtgtaaaacgtgttaatggtttctttctcttacacaattacttgttctttttttttaagtacctacaagactctgaagcacataatcacttaaaaagaaaagaggaaaaaaaaagccggcgtgatggctcatgcctgtaatcccagcactttgggaggccgaggcgggcggattgcttgagcctgggagcttgagaccagcctgggcaacctggtgaaaccccatctctactgagaacacaaaaattagctgggtgtgagggttgcacacctgtagtcccagctactctagaggctgaagtaagagaatcgcttgagcctgggaggcggagcttgcagtgagtggagatggcgcccctgccgtcaagccttgttgacagagggcgaccctgtccgaaaaacagcaacgataataacatgtgggtgaactgcccggctgcgctctgtgtaaactagagtagaataaatccagttatgtttgtcttttattagcattgaaattttcttaatcatccctgttttttcattacattgtagcaatatattgctgcttagagtctggaacaagtaggcttctcttgatcatcaggttgttactggattgctaaaacttggcatgattttcccttccttggatgtgagttatagaactttgccttttgaggtgacatgctgcattatgacagcagacacaggaactcccaaataattcacttacatgctaaaatgtacgtgctttgtagcatttccctccgagaatgaaaatggtacctctcattcgtgggtggatgatgctatttgctgaaaacatgtttatttactgcctcagtccgcagttgggtagccctgtcctttgtaggatattcagggagcggggacatcttgagtcttgaaagtctctctctgcgagatggcaatcttccggctgcctgtttagcgagtcccgccggctgtcatttactggagagtgcagtttcctggctgccctggtctttgaggggagggagactgaggggtcattttctcacctgcaccaacgtgtttattaaagctggcttgtggatcatttggaggaaaacccgcatctgtgactttcagatgaatggaagtcattttaaaaaacttttttttgtctattatggagaagttttgtccttgtgatctgtgaatacagtcactggagagcagaatgttgaccgtgtgagtgcttacagtgtacatacaaagtcacatcttcacaagtattacattaaaaagtgacaaataatagaaaactatttttctcattacaacctcggtaagaagctggcagtactcttttgtttttggaggggtgtgatgggaatattgagagagtgtcatcaacattagactcacccactctgcaaatcctgtgctggctggaatggggaccccgtgatggaaagatgcaaccctctgcctggacggagttgaatttttgtggcgctcaggatgcacagttaactgcaatataaaggcagagtgtgaaacgctgtggaggctgagagaagagatgtggttagcaagtatgagtgagatgtttggggcgtgttagcaaagcttgctgcacacatgccaggtgctgtctgcacacgtgtgatccttagaacactggcgtgtggagccatgaggctgtcgagggccccagctcccggcaggctgagggagtctcctgttaccactaggataaccgtgatcgaaggctgtcactcaatcccgagaagggtctcctttcagagaggaaaacacccctagagcctcgggcagaattcagtgattttttattataatgttgcttagatttcgcaaacatgaaaccaagaacatatttcggaatgcttatggttcttttgtaaccatggatacaaaataattcgcagttgatggacagtttttggaagctgaactgcttacattatgagcacggtgctctccctactgccctgggccttgctctggtttgctggggaagctttgcagggcctcttggctgggatacctctcccatgtcccatgttgctacccctggtcacagccatactgctgggcaccagcgccgtgaggacactgagtggacacggagcccacggggcagcagctggtcatgaggtggcatccagatggtccaaaacacgtttctgttcattaagaataatcattgcaataaaaacagagtgaaagaaaaccctctactgacctgactgagaatgtgtcagctgagttggatggggaagtgcagtgaggaaggtgagggctgaaaggagatgagggagggagaggaaaggaaagaagggaagtgaaagggggagggagaatgggagtgaaggaggggggatgcaggaggagaggaagagagagggcagtgggcaggagcctgggaaatgagccccggagccggttcccgaccctcgcgggtgcgtcacagctgattttccaggagaggcggcctggcagggctgacccttaggaagtgtgatggccggggggagctgattggccctcagtggggctgttgctgacctgagatgtggtcgacgttatcccgaagaggtcgtccgcacagccactgtttgctgtcaggttggagagagaagtgcttctccctgtgggttctttctgttttgtggatttttcccggtttagctgagcggcctgtcattggaaatgtcagggattcctcacatgtctccattctacagagcagtcggccagcttcagatcctgtaattgtgggggcaccactctcgtgtcgttaggccagtgccggtccagcgtggaagccgcagcccagggcgctgggaagcctgcggggctcttgctgccggggctccggtgggagtcgtgcgctggaagaataacgtctgttgagcagagcctggcgaggagggggatgctgctgttgcagcagtacatggaatttcaaatgatgaatgaaacacgcttttaattattaccagagctccatgctctgcgtttcttcaaatggaaatgttgtgctgaaatgaatttgctgttaatcggttgcctcatgcaaggtagtgtgctgggagcaaagtaggttgtggacttatctacaaagcttcctcctctcaacagactttaatcagttggatggtgctacacaggaatacgtgagaatttgtgtgagaaaggcgataggtgcagacctgtgtgactggcaggtcgggtggtaggggaggtttgagagaagcttttggctgaagtagtgttgggtgcaggtactgaagtgtgatgtctggctggatggaagagcgcaggcctctgggctgcgggaaactggtaaaggaggaggtggagagatgtgggtcatgtcttaggaatggtagcaattcatgcagacccaggatcagtctcccacaggggaggagtggacgtcaggacctagggagtgtggggttgggggtcatgcccaggcctttgtggggcttgctcctgtgtcagcagggccctgtgcttggcctctttaaaactgtttcctgatccataaaatgggcacgacaaaatccaccttgtgacactgtgaagtttaaatgagatgatctacatagtgtcttccttcccttcctgacacgtcatagactcacagctatggtggcaatgacaggctggatggaatgctggagctgctttgtgcctgatgaagccacatggatttgtgcagtgctatgactatctctgaaagcctttggtcgtggcagtggcagccttgagtggctcttggcatacttcagtctgtggagtgcaaggttggctggagctctgaggccattgatactatccaggggtgagctgataggaccctaaaacatgggggaaggctgagaggacttggctgccagaagcactgtagatttctggcttccagaacttgctgacttatggacataggaaggtaaacccagatggcttcaaaattttaagtcaggaggaaaggtgtgcgagggtagaattgctgactaggtcatggttgccatgtccttgtggccatcctctctcctccctacccctgcctttgtgggtaggagggcctgagcctgcacagccgtctatttcatggtgacgatggctgattattaccctgcagtaagaagtctctccattttattttgcagcagtagttaaataaatttaaggagtgatggtgtagtggtatttgttttgtttttgcttttttttaaaaaagaatataaaacaaatgagtatcatttaaccgaatgttattcccaatttcactgatcactttaagaggccacacatgctttggtttgttattttgcgtttgagtttgagctagttcattttctcacgggaatgccaattcgttattctgttgtcacacatcattatgtatctcaaattgtattactataatacttagctgaattgcctcccttgttttggcttttacaaaactcaaatctgtgttaaacacaggatggtgcatctccattgagggttgttcaaaagtgtgacttttcctggcatgcttgagaatcaatgacattattttatagaaacactttgtagctgacagcaaagctagaagcttctgtaaagggcagggtaggcaatgtgttatgccttgtgggccacggaagtctctgcatattctttttcttttgttaaaactttgaagtgtaaaaatcacttctggttccctggccaaggctcggggattgtggtttgcagacccttgaccgcaccttacctgaaagctgatctcccatgcagtgagcaggagcccacttcattggttcagccaggaagccgctgccctcatgctggaatttacttcaaacaaactttgaaagctctggcacagctgttcatttcctccttgttgcaggccatctaaaatacggagcgtgccttggcatttttgattttgttactcttgaacggctctgagatggctcattgcaggtagacatttgcagaaacgatcaggcagagccacagccatcttgcagatcaagtgaaggtttttttttttttttttttttttttttttttttgagacggagtttccctctgtcgcccaggctggagcgcagtggcgcgatctcgactcactgcaagctccgcctcccgggttcacgccattctcctgcctcagcctcccgagtagctgggactacaggcgcgtgccaccatgcctggctaatttttgtatttttagtagagacggggtttcaccgtgtcagccaggatggtctcgatctcctgacctcatgatccgcccgtctcggcctcccaaagtgctgggattacaggcgtgagccaccgcgcccggcctcaagtgaagttttttccgaaagcttgttacaggcttaaatttctgatccctttccttctactgatcttggatgattcgtttctttttgctctcatttgggtctatgaaacttgttgaacagcgtctcaccccacggtagaactctagctctgatttcacgcatgagtcggtatcttcactcctcatttgcaaggagaaagcactgcaggtcctgtgtggcttccatcccctccctgcacggggattgatgtgagaggtgtttgaggtgtgtgaactcgctacccctggagcctcctggttcagtccctgggccgcactcctcccttttgggggcttggtggtttctgctgtgcttgtgccaacacaacaaggctgagtggagctccagggctgtgacagctcacgcagctgtggcattagtgcagagaactgcggggatgcagctgcccttgctgtgatgcttcgagtgttgtagtcggtgtgggaagctcggtgggacgtggatgtcctgggatgggatgggagcctcccctcagcctctatcaaacacttctcggccaggcgcgattgctcacacctataatcccagtgctttggggagctggggtgggtggatcaccggaggtcaggagttcgagaccagcttggccaaaatggtgagaccctgtctcaactaaaaatcagcagggtgaggtggtgtacacctatagtcccagctactctggaggctgaggcaggaggatcccttgatcctgggaggcggaggctgcagtgagcagagatcacaccactgcattccagcctggacaacagcgagactgtcacagaaaaacaaaaccaaacttttctatgtcatgctgactggtgctcacggcttgtaagcagaggagagaatgtttgtttggcagaaatattcagatgatttaggaagtcttttctgattaagagaatcaacagcccagttaattatctgctaactttcagttgtgttgtggctgggagcaggggtggctgttaaaacagatgcctgtctttgggaggctgaggtgggtggatcacgaggtcaggagttcgagaccagcctgaccaacatggtaaaaccccatctctactaagaataaaaaaattagctgggtgtggtggcatgcacctgttgtaatcccagctattcaggaggctgaagcaggagaattgcttgaatctgggaggtagaggttgcagtgagctgagattgcaccactgcactctggtctgggcgacagagtgatattgtgtcttaaaaaaaacaaaacaaaacaaaaaaccccccaaaaccggtgcctgtcctccttccgccggagttggatttgatttggcagctctgagatgggccctggatacgtgtaattccagattctcagatgatgctgatctgggttttgtgcaaccaagttgagtcttaacgtttagcttctttccaattacaaagaattatttttccctttctgaataggtcagttcatctcaaagagatttgagccaccggaacatcagttctgagatggctccctcagcatttgatggtgtatggaatgggatttctctcatccaagccttggttcagaggcagtacgtgctgtggatgagatgtctctgtggcacgctagctgtgcatcacagcagccatagacgctgctccgcatggtgcctgtgagccaggctgtctgtccgatgggcctgactttgagcagtcgtgggccacggctgtaccctgcttgggaccctcagaggcaccgttgttgtctttgagaacaccgcctccatggcgagagacccaagaaatcttggccaggggttgctatgaagaaagcctgggcttctgtgtgctggggctcatgggccctcgcctctggagagggcaggaaaaggtgctgacacctgtctcctcagcagcagcatctgtgttgctatctgaacgtgtaagtgtcaaagtctaactgaactgtaaaaatatcagtgtgcggtgtgtctgtgctgtttgtggtgtgctactcgagaggaaaggcaactgtaacactccagggtttggtggcgcctctggtgggtcagcggctcatgcaccaggtgaaccggcagcagcaacactgcttctgaggaaggcctggtgcggttaccccgcgagggtcacgtgaaaaagtatgttggtaagattcctggccaggcttttaataaatggtaactacgattacagtttaaaaaggggcaaaaaattgtttcttcagacactcttaatggtaactacgattacagtttaaaaaggggcaaaaaattgtttcttcagacactctaaaatgtaaactactaaagtcctaaaataaggcattgattttagaagtttctattcttagagcatgtcccagtgttgagatacgtggtttttttgttttgttttttctggtgagtttggaatccgcccctctctgtcagggttctgacagtgtctgaatgccggcctttgcaggagtccaaggtgctgcctccagcaggagagtgggtgacgtggatctgaaacagcaaatcaaagccgggagcccacatggccctgcctgcttcccaacgtgtgaagtgctggtcagtggtttccttccacccttggactcagttattaggctgttacatacctcggagaagggcgccagcctgagagggtaactcctgctttagtctccttgctgcgctcgactccgttacgcgactgtaagcacatatttttatgcttgggttttgggcaactgcaggagtttgaaatttaagtgcatttgatgatatacctttaaaaatgaagcttacatgtagcaaacgggaaacacaccattttacatccttattcctttagcatgtgtgaattccatggttttaaattctaggtgaagttgggttagtagtctgtggaaaatgcctctcttacgattggaaaaactgattgttcatcatatgccttgtttaaaaagagctaagatggaaaaagggatcttctgggctgactgtagttgctgacagtttcactgcatgtgagatgtgtggttttgaaagtttgactctgcattatggggttgtgtgtgtttgtctaggtctttttttttttttttttagaatgcaggtactgtttcatatttttaggagtcacatggtttcctcagctgaatttaaacttgtggaagggcggtactcttaaggttcttaaatgctgtgtatgtacaaatgccagcatgatgctttgtacagagaggacattcacgcttagtctattgatggaatggacgtgttctcttgcctgtgctcactcgaggccctgatactgactaggggtggtccaggctccatggaaagcttcctaaccaattaggggagtgatggaaccgccctctcctacagcacctggtttgccattgaatagaggaagggaaattgctggtagcaaaggggaccagaaaagtgtttactcttcatcttcaccaggtttccagtagatgttaaactcactgagttctaatgtggttttgcttggatttattgtaaaggtgattgacaaacacagagaagaaagatttctactgtgtgtgtgagtcttctaggaagtcaggttgggaacatatttgttgttttccagtttctgctcacgtgttatgtgtttttttctgagatgggaagagcactgggtggaggtggctggtgtgttcggccgagtaggctgagttctgtgcagtgcctggtgtctgctggacgctatgctgaatgcttcgggcatattggctcattgagtcctcacagaaatccgctaaggagggaacttcttttacctcatgttagagatgaggaaacagaggtcaaaaggagacaggcaaaatgccacagagtccagcggcagacctgggatcagaacacagtgctcagcttctgtgtggacacccttagctctgctgcgcttggccctcagctactggccaagatggaataacaggtactagacttgcccctgtccctggagaaaatatgtggaacaatggttcttaaggctttggacgtcaggcagtgaaggcctgtgggtgagaaggggagtgagtgaggctgccccaaggtgacgtccaggctggggtgtggggagggtgatctgtggttgaggagatggagctgtgggctggagagatcaaggagatgaggatggttatgtccaagagagccagtgacgttcacccagacgctgctgcctcaaccacgtgcgggggtggggggaacgttctcccccgagggcctgctagtgagtaatgagaggaccaccatggactcagacactttatattctcacagggtctgagaatttgctcccctaagtctttttctgttccatattttttacctgattagttatgacacatcttagcagattccacttcaggttctgtagaattagtgttttctcagctttgaaatcttctctcaaataattgatccattcagattattcacagactttaattcttcagtttcttcaaattcagcatcgattccctgaatgagcgacctcagcagtgttgggatttttgacacattaagaactaaggaaaatgactcacactcatttgccttgcttcttaattgactattggtatagcccagtagtctgaacttgttcttgactattggtatagcccagtagtctgaacttgttaagcaaccattctcaccgaaagactaataatctttaaaagtctctcttcctctggacgcatctttggctgctgtaatcaaatgcaatgtaatcagcactggttaatggctttccttgctttgctaacaaatgctcctcagaaactttggtttctttttcattttcattgttgtgaaattctgctataattatattttaagccttctgatttttctagctttcctgcgagttggaaatactgtgatgggtgcttagtttgggatgttgacgtacactgtatgcctagctactatgccattgcatgaatactgatttgtcactttctcatgaagactcatttcacctagtttggtaaattctactaattttaaggaagggggtggaatacaactgctgttaggaggttttttaaaggatcggggaaatattgccattattattaccaccattacggaaggaacataaaaatacgtgctgctttcagtcattatgaatatgtaagtctgcatctgtgactgcagaaaatggcagccccaagccttaaaatcgtatggatgcaccaagcccgcctgcagggcactgtggaacagtctgcattagtcgaagttggcccactagccctgagggggatggtgtctgatttatgataaggccctgacttcagattacaggcctccagatactgtgatattctaaacaaagacacaatactgcccagagagcacttgtaggcagtgtaggtgagaaaagccttcaaggaagattactgctgctcagctaggaggattctgcaaggcagtagactttataaggttgcacacgtcaatgttcacagaagagtatttagctatattcattccttttaagcagccaggcttgtgtgtatttttaggggcactcacatggcagctcttccactgtcactgctggttgtgcactgttgtttgatgttatggatttctgtgttgagtgtgtcctctccaaatgtatctgtctctagaatattttagagtagaccatttattggttaaatatatgaaaagctctctgagggaacagaacacttgttttcagtgaggaagaaatctttaaaactggccatgcagaccctgttataaatgtttagcaatggaatgtttaatgtttaacacgtaatgtttaaagtagaaattttaatttagaaatcctgttggaatgccaacttaaattacgaccatccgtgtgcatatggaaaagaatgagagtgaatgtacagaattggaatttcgtctatttcgtagagattctgtaatgtatcaggtacaagtctcacttcatgattcaaatgaaggagactgaaattataaaaactgacaaaaacatgcctttgaatagtgagccattatcctccttgaaatagtgattcattcactagaaggtccacctgtaactttgtcaaacacatttgttgcattagtgctcaagtgagctcaattttccagacagggaaattattgctgcttaaagtttgtcctgatgatgttggtgaacagggaaaatcctttgacgtggatcctctgtgtgtgttaaacatcagatgcggcctgcccaaccctctgcctgtaactgggaaccttaactgtcaggatcattgtggagaaccttgagaaggcaaaacaaaaagcctttggagtagcaaaagatgtagctgatttcatgcagtaaagcttacacatttttctttaaaatgcatccttcggaacgtccgcttgctgattattttagaatcactatagtctggtgacagcagttgtaggaacaggtgcacggcccggctggtgcaggagggtctcagcggagccgcactgctgacaccgaaggtggggctagagctgtcacgcgtgactcgtgcagatggccttggctgacctccagaagaggaattgtcagtatctaaggaggaaaaagtgtattaatttcatgagtatttgccttcacaatggcgaaaacactgagttttgtggcacctgctctctctggaatgaggagtcttcccttcctggcagacaagctctagacgggaccaggagttgtgttgctggattgaagaggtttccttcctggggaggtggccttcaagcctgacttgaaggaagctgtgactggcgggaaagggccttggagacagtgcgttaccaggagggtcagtggctgagaaccatcctgttccgactgttcccattgtggttttagaggagtaaacttggggagaagcaacagccaaaagccttgaggaacattctgtgatgttgatcacgtttggttgcgttgttgctgagactctcaaatgagaggccctggaggtgcaggtctctcaggccttgggacatgggagagctgctgcttcaggggttggagtccccatgccagtggctctcagtctgcagagacttctcgtacagtgggcaattgctgcctccaatccattgtgagtcccctttaacctgccccaaaataaatacacatgaaaggtaccatgtcagcaaagagaatcaaactctgtaaggtatttaaagagatttattgtgagccaaatgagttaccatggcccacgatacagccctcaggagatactaagaacctattcccaaggtggtcagagcacagcctggttttgtaccttttagggagacatgagacatcaatcaaataaatgtaagatgtacattggtttgatctggaaacgcggggacaactggaagcaggggtgtccaggtcataggtagattcaaaaatttcctgattgacagttggttgagagagttgtacgattaaggggttgtgtggagaccaaggctttgtcatgtggagggatgcctccaggtagctttgaagagaatagattgtgaatgtttcccgtcaggctaagagtctaagttctgtctaattccagaagggaggcggggtgataaggcaagtcccaccccccaccgatcatggcctggactagtttttcaggttagctttggaatgcccttgccaagagtaggggctgttgagatggccaggggggcctagaattttaatgcttttacaaccagaaagtgattacgttgtttctgtggatgatagcccgtgtggtaattaatattttattagcagattaatttgaaagtcaatgtgttttcaagtatgttaattattaagttatcagcaaacagaaagcttactttgaaaccagcctgagaatcaagaggcctatcaaaacaatggacttgggagaactgattcacgtgttcactgccgcgagtttcaggcattatgagaagtctgtgtgctgatacattaagtgactcgagaacttaaatcctgatggactcctacttaacagtgacacttttttctttttttttttaaatggttgtgtttagcttgtctcttgtgttgtgcagcttttgtcttccagccgctgagcactttagctttgtgttcacatggcctcattctccgaacctcccctctttgtgactcctccatcctgtccaccttgatcgcgtgtcttctccacccctgtgggttttatcccgaggactgctctctgctgtgcgtggagggatgatcagtggacactggctttattgactcattttacacctagctcccagtttctaaaatcatgattgtcttggtttccctgtgaaactgggagtcaggccttgggcgcagtgctgggtgtctgtgacagggcaggagggagaggtgagaaccggagggggtggggagagaggtgagaactggatcggggggagaggagaacaggagtgggggggagaggtgagaaccggagcaatgagttcatcaaggggaaggaacacctccctgaattcctgtgtctgttttaggttaaagacgaatggccaggtgggtggatgtctcacccggtgtggctggaccgtgctgtgctgaaccctgagcaggggccccagcagtggcctcctgccaggccggggccatggggctccggggctgggcttcctcctctggggtgggttgtgagggcttgtgcatggtgcaagagtctgcacagctgctgtgtgaccctgaggggcatgtgggtagctggtctgtactccttacctggaagaacctgagctcatctgggccagagcctttggggaggtaggaaggcagagacctggaattcctgctttctccagacaccaagaaagcccagtgttgcatctgctctgaggtgctgtcagcagccatatatagttgttgattttaacatgagggaaggtgccgattaacccaggtctgtggggagctttgaggagtccaggccctgggcttttaaatatgttccttcctcaacaaaaacaacaaaagacccctgtggctgatgccgactgtgtgtggggtaggacacaccgagcttgtgtggggcttcccccggcgttcccccggcgttccccaccgcccccatggacaccagctgttccaggccgaggcttgtcctggttagaccctcgtcgtggggtctgtggtcccggatcgagggcccaagcacttctctcattattaaagtgattcacctgagatgtacagctgcctccaaagggtctcatgagcatatgagatacagccagtgctgctgccccaagctcataattctagtggaaaggagaaattttacttttaatgtgcttgtgtgactcagatgcaaatattcaactcccgttaaacttgcaagaccttgaaaacctctgagattccttggaaaccactccttggccccacgacctaactcacctgtggagggggtggggtggtctgccgggggaggggttgggctgtcggtgggggaggggtcgggtggtccgtggtgtctggggtcctgctgtgttctccaagtctccttctatttcatcattagccccagctcttcagtgggagagcagattcactgacattgccattattttgttcctgtgttgcctctgttaacttaaaataatcaatatttaccagaaataattgatggcgagatgggaattattggtgattccctgacataggcggcctgtatagataagcatgttacagtgtctgatttccgagatgttggtccacaccttctcagaaacacactttcaggcttagattcctgtgcaggagaagctgcctttccccgagacgcgatggtgggcccccgcactggcatggcagggtggttgtgtgactgggctgggctggacgtgctcctgtccccctgcgctgggcgcccgcctccaccccccgtatctacatcgagggtgcctgcctttgttcccccagctcgtggtgatacaactgcaccttcctttacgcatttctgaatagagatgattaggtctgggggtcgaatctcaatccgtgagatgcatccaggtaaattattcacacacatgactcgagtcctcccatcctggttcagggtcaggaagcgggaggtgggtttggagacagctgtgtggcctcaggaaggttctctcagaacctgtttctttctctagcaaagtaaggattcctacctcactgggcttgacgcatgctcagtactcagatgctgtctagtctttatcatagttagtatttggggaacagcgtggctggtaagacaatgcgttatctttccaatttatagaatgtcatatgaggcaagcgtgaaaccaggacactaccctaatctgaagatgctgttgcttactcttcttaagcattttattataattctgtcatgtgtccgccctgtcatgtgacggcaccctgtgaggttgccagggagcatccctcctgcctccagccctccagggtttcgccctctggggtttcccccttccccgcccccttccccgcctgcccctgccccctccccctgcctgcctgcctgcccctgccccctcccccttcctgcctgcctgcctgccttcctgccccctccccctgcctgcctgcctgcccctgcccccgccccctccccgcccatcctccccctcccccttcccacccatcctctcccccttcccctcccctgccctgcccatcccctcccccgcccccacccccacccccacccccacccccacatgtgtatgtgcctgtgcactcaccaccctgtattgggtcatatgttgcattttacagattgttgtttttcacttggtattgtgagcttgtaacgactttgtgaagaaaagggggtcctggcagcctttggctttgagaaacgtgatgtcgtgggaacagatgagacagcccaggtgaggccagcagaggccatcatggcctgggagcctgtctgcatccactgtctgttgctgtgtgacaagtgactccaaaacctagtggcttaaggcaacacacacgtatgactgtacagcttctacaggttgcaaatttagggcagctctgctgagtggttctggccctgtccccctgagtcacggtgaagattctgtccagggctgtggctatctgtaggttcagctgggctggaggttctgctccaggatgctgtgctgacgtgtctgctggcggaggcctggtcctccacaccggtccctctgtggggctgccaggcacatccctgcccagggctgctcctttctgcagagacataggagtgctggtcttacgcccagtgtcaaggtggccggtctcctggccgtgtcccgtgggccacactgaccagctttgagctctgcaggagggagcacacagccgtgtgggaccatcgagggctggctcctgggccatctgagaagccctggctgttgtcttaaagctgaggaaaatggcagaatctggctgtgagctggagagagagaggagagagtgcatgtaggtttgatgggctgtgaaggtcaggacagggctacgaaggactcaggtgcacagatcccttccagggtcggggctcacagcatgttcctctctgtgactcaaggcacacacttgtttagggtggttttctgtctttcgcttgatgcatcaagaaaaaacgttgttttcaatgtggtaggtgttgggggtgagtctggggctgttgattccagcagaatatcctgaaatggaagtgtggacaggatgcagggccaggccccagtgggcagggtggcaacattgtggagggaaaggggtttgtttcatgtgtctatagcagatggtgacacgttggagtgactgggtctgtgagggaggagctgtgttcagtctaaggctgttgagtttgctgaggaacctccaaaatgtcctggtagagtcaggtggccgctgccagggcgtgtggatccccctcttgggaaggtgtgggtggctgcgtgatgacactctgaggtccgagtgtcagagatggtggtgtgcgcagcggggcccaggacaagcctgggatccggctgtgggaggggtgggtgggtgccgtcctgggatccggctgtgggagggggtgggtgggtgccgtcctgggatccggctgtgggaggggtgggtgccgtcctgggatccggctgtgggaggggtgggtgggtgccgtcctgggatccggctgtgggaggggtgggtgggtgctgtcctgggatccggctgtgggaggggtgggtgccgtcctcggatccggctgtggaagggggtgggtggttgctgtccggggatccggctatggaagggggggtgggtgggtgctgtcctgggatccgattgtgggagaggtgggtgctgtgagggagtctgctgcgactggactgtaacaggatttccttgagaatttgaggtgtgttgggggcagggtcaggagcaaaggcttgtttcccctactcagcggctgctgctgcagggccgggcaacagtggaggtcatgcaggaagggtgttcgctgaagaccgtgttctgtgacttgaagatgggtgttcctcccgtgggggtggaacggagactggacgccgtgtggcttgagagtggcatcctgcgtgaccttgcgtgtagtgggcttacagcagagctagtccttcctctatagattcttttcatagtttgcctgcctttagattctctgattaacgcatctgaggtgggtcccaggagtctgccacctgccaggccaggaggttcccctcacgtggctggtccccagataccctgagagacacggctcaacaggatcacctgagtttcctaaatatgagtcacctgccttctcttctgtttgctttcatgcctcccccagggtgggccagtcctgtcagccacagagatacccgcatgctggggttccaaggagattgggggtgtgcctggtcacccagggagattcggcgactgaggatgctctgtcatagtagccagcgtgtccttactctttcaccgttaatgaagttcggttattaggttttccgacgcacgatgttgtccttatgaaaaattggtgatgaaggaagcaaacgtgtgggaaaatgatcctgcccttaaaactgaaaaacaataaaacagcaaagagcccagaagagcccgtgaacctcctcatggggcagtgaggagagacctcagtaatggcttgggaaaaaaaaaaaataatactgaagaaaacataaactaaattttgggtctcatatgggtaaagagattgtggtttacattttataggcatgcatttttacacttatttttctttgttggaattagaattagttgtgataaacatgattttttttaaatgaaaaaattacttggggtcagtatatgaagtctaatccctttgtgatatttctgtactgtgagactccatatacaaaagtgaagcccagactctgtctctgacgaaccagagagaagtggtcatctcctgcaggccagtctggcctccaagtgtctgtctatcctctgtctcgggcacacctgcatcactggtgcttcctgccaggctgtgactctgtgcccaggtttcaggagcacctggaagttttcctgatgccttttgatgaaggactcactccccactgccaggcaactcggtgattgctccccaggctgtatttctcacatggggtgcagaatctgtgcgcggtgtcctggccctggagccagttctaggactccacggcagccttgcctctgcccctcatctgggaacagggcagtggggaggagaagggaaccggggtcttgccccttctgtgtctcaagaacacgggaacacatggtcccacttcctcgcaccattcacagcccaaggttttgtgaagtatttaagttattttataacttataaccacccttgacagtgatgtattttatataagcagcacatagaaagtggtaatttaataccttatcaagcaagatctaaacaataaggatcagatatcactgtagaaaaggttactttctccaggaaacatttatccactgcagatggaaatgaatcactgcttcctccttggctgcttctgatgagcctgtgaaattctgtcctgttcaccactcttacagttacaagcatatactttttctcctatgatgtatatttcctgcctgttcgccactgttagttacaagctataccttttctcctgtgatgtatatttcttgcttgttcaccactcttagttacaagctgtaccttttctcctaagatgtatatttcctgcctgttcgccactgttagttacaagctataccttttctcctatgatgtatatttcttgcctgttcgccactcttacagttacaagctgtacgttttttcctatgaggtatatttcttgcctgttcgccactcttacagttacaagcgtatacgttttttctatgaggtatcatttcttgcctgttcaccactgttacagttacaagcgtataccttttttctatgaggtatatttcttgcctgttcactgttagttacaagcgtatacgttttttcctatgaggtatatttcttgcctgttcgccactcttacagttacaagcggtataccttttctcctatgaggtatatttcttgcctgtttgccgctgttacagttacaagctataccttttctcctatgatgtatatttcttgcttgttcgccactcttaaagttacaagctatataccttttcttctatgatgtatgtttcttgaaggcatggactaaatcctaattccacagtattcaatgcacatactcaagagatacttgtttgaatgattgggttaatggaaaatagaagtggtgacttaactttcagttcattatgccaaacttcaagtgtttacacgcaaaattttatggtcctttggataaactgggcttctgtgcagggtggttagagattgtgggagtgcagcaaatggctctgtggctctaggctcacgaagggcttgagggacttagtggcggcacctgtgttgaaaactcaattctgcaaatccttcttgagtgaccaggcgccacacacgcagccctgcttcccagctgatttctgcagaggctttttctgaatgccccaggtgaacatgaattcagccagcactgctgggcttgcacagcaagccaggtgcagggacgagggagaagaggggcaggacccagctcttcctgggccccagtgcccatgtggggatgctgcctggcctggctcttcttagggaggtcaggaaaacagtggcatggagggtctgttggcacgagcctcttggtgaaacatggatcccaggtctgtgtgggaggcaaaatagaaatttatgtggatatcctcagtaaaataggaaatactggcttcttccctagggtggctgatcccctccctcatctgctgagcaaaggctcggccttctgggcctccacaatgagcttttcccaagctctgtccactccgtggagatggcgggagccagggcagacatggggtgttcgtcacttttttttgagatggagtcttgctctggcgcccaggctggagtgcagtgacatgattttggctcagtgcaagctccgcctccccggttcacactgttctcctgcctcagcctcccgagtagctggaattacaggtgccaccaccacacctggctaattttttgtatttttactagagacggggtttcaccgtgttagccaggatggtctagatctcctgacctcgtgatccgcccgcctcggcctcccaaagtgctgggattacaggcgtgaaccactgcacccggccaggtgtttgtcactttttgaaagctacatttgaggaatgaaatagactgaacagaattacttatttttgaatatttaatacttagtctatgagaacacttaaatatagttaatgtattcgaataataaggaagaaatttccctctctgtttccaaagcaaaagtataaacaaccttttacttggcagggacttcactctgtttctaaaaagccagcaagcaccgttcctgaaatagaccgatctgttcctctgcatagaccctattaacattttagctacatctctgctgtatcttgatatgatagattatagaaaatgtcttgctactggaacttcacgatgctttccttttaaacatcaggtagaaagtatggatagtaaatctcagattagttgccattcttggtcttggtagagctgccatcgacagcctccgtcagttacaacagagtgtgtctctccagcaacccagcttagattgcagactgagtctggctcacccaggattcagtgcaacgtcttccgaagctgtagccaccactctcagaagagacttgagaagccctccctttgatgcctgcatgtggctgttctcagatcacaacagctatagcagcgtctcagaggatgctggcaggggtgtcctgggtgtgacaccacggcaggggcctgcagcatctgaacgaaatgggccgtgacattgagcggcctaggggagtccacagccgcatttcaaaggtgcagtggcccgaggttgaaccccagagcctggctctgaggagcctggagttgacctgtcacaactccattgagagagctggctgaattctgtacctgtgtgggcaagatggctgtgtttgctcttggacccttcccaagccagggctagggagattgtctgcacagctagtgggagcttgactgttcacactcggggctgagtccctcacctttctctgagcccagggaagatggacatgctgctgtgacacagccagcctggcaggagggaaggcacttgtgggtttgtgcaccgaggcctccttcctcttgagccaggaagggcttttgggatcctgcttccagctgctttcccttgctaggttattggcctcgggggccaggagaagccgagtgcagacctgcagcctggaccccttccacagcctccgtggcacctgtggtaagcgggacgtggcctttggaactccaagccctaccctggcatgcctgccccttggggtgtctcaggcacctgctgtatgccaggctccatggcggggtgggcggcagccagggctgtggggaggagggggcatggtacgtggacgatgttgagaagcatcagggaggcgcttgaggcagtgtcagcagagccgagacctgcaaggaggggactggctgtgggtgttggagctcagaggctgcctctaccagagccacagtgtctagtgagggcagagggaggaccgaggcccggggaagccgtgtgcatggtttgcatcaggtatgtaccagagccacagtgtccagtgagggcagagggggaaatcgaggcccggggaagccgtgtgcacagttcgcatcaggtatgtaccagagccacagtgtccagtgagggcagaggggagaccgaggcccggggaagccatgtgcacggttcgcatcgggtgtgcaggcctgactggctgtgctgaccttctcagtcccggccaggcctggggtcccagagggaatggagcatccctcttcttgcttccctgttgcttcctggtcaagggatgcttgtttattgcaactctggcaattattctgaatattaagaggagtttcacaaaatcgtagggggagaggggctagggattcatttttttttctccacctgattttacaggaggcttctgccatcccttagtgtgaaggcagagtgcagacgctctgcggttatttgtccaggaggagaagagcttctgggaggtcacagatctgattgttgtaatagcactgacatttttaaatgggagaatgttgatatctatagtaaacagagtaaaacttcagtagcttcaatataaagatgccgagatgatcttagagccactttgtccatagatccttctgcggtgtggaactgcagcgtctctctaccagcctctgtggtcagtggccacctgtgggtaattgaatgcttgaagtgcaaatgagaaactgatacttctaattttatttaattttagacaaatttaaatagctacatgggccgggcactgtggctcatacctgtattcccagcagtttgggaggtcaaggcgggtggatcacgtgaggtcaggagttcgagaccagcctggccaacatggtgaaatcctgtctctactaaaagtacaaaaattagctgggcatggtgacaggcacctgtaatcccagctactcaggatgccaaggcaggagaattacttgaacccgagaggcagagattgcagcaagctgagattgtgatactgcactccagcctgggcgacagagggagactgtcttaagagaaaaaaaaaaaaaaaaaagctacacgtcccttgttgcttctgtaggacaccgcatggttccagaaggtagaccttgtgttggggactctgcattgtcaggctggagacacagtctcccttcctagcagtgtgggcccctgggctgcccttctaccagaagggatggtggtgtctctagaggtatctgtggactcagatctatgtgaattagtgactagtgttactcacagatacttaattttatgggtaaataaatacctggacttgctgcgagctttcagggcaagaatcgggagtagggagtgaaaagtgacgagggcacccatggcttgtcccgctgcctccagcacctggtcggggggggccctccgctctgaagcccccggcacctggtcgggggcacccctcccctctgaagccaccagaccctcctggcctgtggtgctgcttctccaaatgccgcccttggctgtttcccaggagtcactggcgcccaagcaggctgtatgggtcacttctgcgtggttttggggtgttggtgaagctcattggtctcgtcttccttctcatgtgccacatctcacctgttggcttgtggatgggcccgagtccgtgtgtggacgcgttgtatcttctcaggctgtacttggtgcttaggtgacaaggacgtcttagagcaatggactgtctgctccaaagggtgctgtgtgttaattgagacatagcttacttgtggggtttaaatttcctgggtgttggaggcaattggggaaaaaaggtctaaaaaggcccctggggatgagggaagcaataatgaaaaagtaactttatcgcacttagcagttgattgaatttgaacgtgaattttgcattttggggactcttaaagctactatttgtagggattccttgatgagctgcttgttttctgtcaagtagaaagtaaagtggatcggttttgcctttaattctgactaactagaatctacttggctttttcccccattcacgttagggtgggggattggactagaagagctgtaggatctttatttctgatcttaaatgaattttttctttactcactttttttttttttttttttttttttttgtgagctgctattttttcctgcaatgcactgttctttggtttgggaaatgtgctatatttgtaccgtgctttaaacatacacaatggttctaaataactacttttctttaaagttagatgtaacatcttaattaaaatgtcatccataaatcaggcacagtctgtgaggttgtgcgagcgtgaaagctccacagtctgaggcctggagacccctcttgtcgcttccctccagccatgtctcctcccccggccacatcacctctggccacatctcctccccccaccacaccatgtcacccccataacccttgccacgtcacctctggccacatcacctccctcccggccacatcacctctgtcctcgctgcctgcctgcctgcctgcctgcctccctccctccctcctggccacatcacctctggcctcactgcctgcctgcctgcctccctccctccctccctccctccatcccggtggcctccgcggctcctgctgactgccctcccgaggggctgttcgatgctcttttcccgtcttctgctcctgagtgggtctcggggctggatgtttcacaggatgcaagtttcttcccttccagccgtaggtctctgggcgacaactccagagagggcaccaagctctccttacccacctgggggccctgagccctgaccaccagggctttcctgtgggggggggggtggggcagactcgtgtgaattggactgaaaaggtgcttccaggaatccttgttttaggtgcactggggcagaggtggggacaggggaccaccacaccacctggtttgctcagaatttggtcctgatcacagccaatgaggcaacacaagcacctcctaaatgaagcattgcagactgcttttacatgtgacagttgtgatggctgaaaaaggcttcacacaatgagtgggtttgagctgcatttgaaggcagaacaggtccctgcaggtggaaatgagagataagggtgacccaagccatcagcagctgcgggtggggtggtgtgggctccccagggatggtgggcatggatgaaatgcaggagagggcaggggtgcgatggaacagcagggcagcgttaaaatccccctgcagagaggggacgtgactgagattttatcacatgtataaactgagagatgatttgaggatgatttctgggagcctgtgggaaaagcacgtggtcatcatcagttctctggatctctgaaaagtcatgcctctgcctatcttgtgagctattgtgaagatcaaatcggataatcttcagcaagccttgtaaatgctaaagctcatgacagagactgttccagcccctttttctccaccctcccttcctcctggataatgtgaaccctgctgggtacctcactgtctgcctgctttcctcctctgtaacatgaggcctgagtatttgctgggtacttcgctgtcaaccttccttccttctcagtgatgtgagccctgagtatttgctgggtacctcactgcctgcctcacagctggctgtggccctgttacacacacttggctggcacataagcagaagtgctcgctgggcctgggagggctttctgatgtgtgggtgcatgcttctccctgtaggctggagctgcaggagccctcctggatcagaggaccaaggctgtggcctcgcgatgggggctgggggagctccctgggtttattgtgtgggtgagagcaaacttcagtcccgctgcagcaccgggattccgggttccctctggaatgttctgaatgagaaacaggaagtatgcagaggtgcgtcttccgaggatttgatggttatcttagctcagaggcaccaagtgctctcccatgaacctgcagaaccgcttcttccactaatggccttctttatctaaagaatgacttacaaactctgccacttaagagataggtatttgcaggtgtggcctgaaaaatgaacaaattgattctttcatctcaaggaaaataccttacgttattcccaatgatagccattggagctttccagtgaatattaaaatatacaaatcttgtgtctgccactttctcatgtgatcagtggtgatattgatgtgatttttttttttgacataatgaaatgtggaagctgctcataactctgaaccagtgttttctaaccagttacaaaatcgtgtgctggtaaaagagccactcaagtgcaggacagaccagtccgcttaaaaggaattggggcagaaaggcccgtcgaccagggtccagactctgcgttgcagacagcctgcatggaagtgccgcttgtgacatttggcagcagagaatacctaaaactatgtgaaagcacagtgaaaaatacttcttcctaactgtatatagcatgggatcagacatttttcataaacttcaaccagagttctgcagcccactgaacgcagatggaggcatgagaaccctgctgtccgaggtgcagagaggcgttaggtgttctcacagcagcacaaactgttgccacactgctgcttattttggaaaatggttttttctttaagactgtgctgtttattaacatgtaatgactttattattttaaaataaatttgttactttttttttttttttttaagagtcttgctctgtcacccaggctggagtgtagtggcgtgacctcggctcacttcaacctctgcttcccgggttcaagtgattctcctgcctcagcctcccaggtagctgggactacaggcacccaccaccaagcccggataatttttattattttagtagagatggggtttcaccatgttggtcaggccggtctggaactcctgacttcaagtgacccatctgccttggcctcccaaagtgctgggtgggattacaggcataagcccaccatgcccggcctcatgagaaagctttttgtgatctttaataaactgtaaagggttcctgagacccaaaagtttgaaaaccaccggcttaaaccgacaacaaattgtccatgattcttcagtgtaccttctaatctgttgatggagaaaggttgtaaggggttgctttacttttttcctttcgcaacttagtggtgctgggacaactggatatccacatggaaaaggatggactgcaccctccctcaccctacacaaaaaaatagctcaaaatggatccagtgtaagagtcgatactgtgagacccattttgtcagtctgctgggtaccgtaacagacaccgcagactgtgaggcttaaacagcatcttatttcctttgttctggaggctggaagcctggggtcaaggtgcaggcagggttcgatcctccgggtcctcaccccattctgtgtagacggcgtcttctctgtgtcctcatgggtttctcttatgtgtgtgcagcactgaggactctgtgtgtctaaattctctattataagaacaccagtcatggctgggcgtggtggctcacacctgtaatcccagcattttgggaggccgaggtgggtggatcacctgaggtcaggagttacagatcagcagtgaaacctcatctctactaaaactacaaaaattacctgggcgttgtggcaggtgcctgtagtcccagctgcccaggaggctgaggcaggagaattgcttgaacctgggaggcggaggttgcagtgagctgaggtcatgccactacactccagcctggacagagagagtgaaactcaaaaaaaaaaaaaaaaaaaaaaagggaaaacaccagtcatgttggatcagggcctactcttaagatcttatgggacctaaattgtcacgttaaaggccctgtgacattttgagtttctaggggttgtggctttaacatgggaatcttgcggggacacagttcagctcattacacccttaggggagaatccaggtgaaactgttacgttgaattaagcaatggttccttagatgagatgtctaaagcataacaagcaactgaaggggaaaagacagtatcaaaattaaaaatgttcatttcagaggttactattaaagtaaaaagacacaacccacagaacaagacacattatcccaataagggcctgatatcaagaatatctttaaaaacttactcagcaatgaaaagaaaatccaatttaaaaatggacaaaggatttgaatagacattctccaaagaaagatacataaatgccttaaaaagcacatgagatatttaacagaattagtcatcttagaaatgaaaatgaaaaccaccgtgagataccacttcacaaccactgggatgggtaaaaccccagtactggacggtgacatgttggtgaagatgggaaaattggaatctgtatatattgctagtgggaggggaaggaaaatggtacagttgctttggaaaagtctggcagttcctcagaaaagttaagcataaaatcactgtacgacccagcaatttcactcccaggcatatgcccaagaaaactgaaaacgtttttacaaaaaaatcttatgcaagaatcttcatagcagcattattcgtaacagtgagtagaaacagcccagatgtctgtcaacagatgagtggataaagaaaatttgcacacaatggagtatcactcagccgtaaaaaggaacaaaagaacatgtgctccaatgagccttgaatgtgaaagatgccagcaccaaaggtcacaccaaaggtcaagcactgtgcaattccactcaccttgaacgggaaagatgccggcaccaaaggtcacaccaaaggtcacgcactgtgcgattccactcaccttgaatgtgaaagatggcagtaccaaaggtcatgctaaaggtcacgcactgtacgataccagtcaccttgaacgtgaaagatgctggcaccaaaggtcacgtcaaaggtcacgcactatgtgcccactcacgacaggcgtccagagtgggcaaatccagagaaacagaagtcggctggcgattgccaggggctggcggaaggaagcagcaggtgctgactcttaatggattcaaggtttcttttgcgggtggtgaaaaagtcccagaattaaatactagtggtgattgttgtgcagctttgagaatatgctaaaaagactgaattgtaccctttaatatgggggattttatggtttgtaaatgcttttcaatgtaaaaagaaactaaagaacttatttggtgttgatatttagaatgcgaaagagactgtatccaaaacatgttactatgtaactcatgtccccagagagttaaacttcattttctgaggatcttaaaggatgtgtttgagcctaggagacacaacgatccatactatatgttacagcctatcttactgatttctatctcacgtaacaaccgtattcagggaaaacggacatgtaaacgtgagctgaatgctctgcagaagcactttcctcttacccagatggtctttagtggtgcagtaagagatgtggtcacggcaacgtcagtttaatttccatggcaacaggaatttggcacatctgatgagttagatctccctgcacagctcctaacagggttacccatttctgtgtggtgtctgtgtacgttctcgctactgaaatcagtgatggcacctgcacagacacttgcccggaaatgcgcacaaagctggtgaaggcagaggacaggcgagtgggaagcatggttcagcccttgcaaaggagacggttattcctaacgcagaagattcaggaacacgatccttgcgaagactggtgatgtccatggatctcactgctgtccagttgtatctgtgcagcgagttaccaaagctgccagagccgcatgtgttggtatcggtgtcatcatcatcactcaatgtttctgacttttggtattggtgtcatcgtcatcactcaatgtttgacttttcctggtgctgaggatgactgcatgtggcagaagcaaagtgctgggcttagaaaagaactagaatctgatgatctgtggtatatagagaggcagggtcagaaccccccactccccaatcccgtaagaactgggatctgatgatctgtggtatagagaaggggggagggtcagaaccccccactccccaatctgataagaactgggatctggtgacctgtggtatagagagggacaaggtcagaaccccccactccccaatccgataagaactgggatctgatgacctgtggtatagagagggacagggtcagaaccccccacttcccaatctgataagaactgggatctgatgatctgtggtatagagaggggcagggttagaaccctccattccccaatccgattgttgaagaaatagttggcttgggagggtttttactctgaaggttgaagctgtgcatttctggagcctgggctgtcggccgtagtggctggggaatgctggggctgtggtcgtctggccgctggcagtcctgctggtgggtcctgcctctttgacaccgttcctttctgaagcttgttttccccagtgttggaagtagcagcactggaggaatggccttcttcctacagcaaagctctgccaggagaggaggagaagacatagagcatctgttgagggacatgacgttctgggcactgcaccatgctttctgcttctcagcagtgcctcctggttgatgttaccgtcacctggcatcgcccaggaggtaactcgcagaggcaggcagggagcagaaggagctcaggagggagtgagccgtcacagggtgggggaggttcaggagccagcaggcaagtgggatgtggcctcaaggtgttgctgggttggtgaggggtcttctgggacttttctgagagtgcagtcagttgtaggggtgggtgccggctcccgcagatagaagagccaagtgtgcaggagaccaacgtgtgcactgggagtccccaggggcgtgtcctggcacgcggcccagaggcccctgacaaggctcagtgcaccaggcacacagcggattgttggtgcttgacccgacgagaaggtgaggaagtgaggtgaggggggccgagagacaggtgcagggatgcactagacagggtgcagtcaggtggagggtcatgctgtggggtctaggagagacaggtgtggtcaggtgaagggtcacgctgtggggtccaggagagatgggtgtggtcagtgtggagggtcatgctgtgggatccaggagagatgggggtggtcaggtggagggtcactcttggggttccaggagagacgggtgtggtcgggtggagggtcacgctgtggggtccaggagagatgggtgtggtcatgtggagggtcacgctgtgggatccaggagagatgggggtgttcaggtggagggtcacactgtggggtcgaggagagatgggtgtggtcagtgtggagggtcatgctgtgggatccaggagagatatgggggtggagggtcactcgggggggtccaggagagacgggtgtggtcgggtggagggtcacgatgtggggtgcaggagagatgggtgtggtcaggtggaaggtcaagctgtggtgtctgggaaatgtgtttttgcttttggctgagcagctggacctgagcatgtctgtgctttgacatttaacctgtgcactgtcctcggcagggtgtgtgtgtctgtgacagaggacacctcagccagagtggatgtcggcggtggtggccggactcagggtccatgaatgttgcgtggtagaacgtgtttggtacattctcagctcctgcccaggtgcctcccaagcatcgggtgttgtggctccccagcatcgggtgttgtggctccccagcatcgggtgttgtggctccccagcatcgggtgttgtggctccccagcatcgggtgttgtggctccccagcatcgggtgttgtggctccccagcatcgggtgttgtggctccccacatccttccccatctgcgtgtagcacgaccaccaccttcctaccatgtgtttgtcctatcacggctgctgtgtctaatgcatgctttgctttccagctactttactataatcaaaacccttgaaagactttacctgtgtttcagagatgacagggtattagtctttcatgattgctctgaggatttccaaaagcaaatgcaccttacaggatgcaagaaatggcagacagtaattagagattacttttctcagttagtctttttattgtggtaaaattacatagcactgtgaccatttttaagtgtacgatttggtggcattaagtgcgttcacactgtcatgccacgatcaccgccatattcttggtctccccaagcttgaaacttggtctaccaaacactagctttcctcctaccccagctctggtaagcactacagattgcttatagaataggctttttcagtgagagaaggggcaaggagaagaggactcaagactgtcttgagatttgaggaagtgttttaggttttgctctctggttcccagtgtaaaggaactattgaagatgtgggaaggtggaagctctgtgtgatctcaggaagtgctgggccgggcagctttccccctgtgacgggggcacttgccctcaaacacacctgagataattgtgtgaggatggtgctgcgttgtgacagctctgaacttggtctccttgaaagtttccaagtacataagctttggcggttaccgtctagtgtctgcgggagacctagaatttgaacattgttgactttaaaacacgcacatcatttttataacactctacctgttctcataaataggaaatatgctgtgtcctttttattttgctttaatattctgtgttgcagtagcagtagttgcagtggatgctgcttctgattcatggttattgccaaacacaagtttctagaaaccatgtgaaaagtgaaggggaaagtggctttctgcaaatggcttttttgatcatcttgtttttttctggaatatctgtggtgtcaaacattttcatatttaggggtttgtaatgtgttttatactggttagcgttgaaatcccatgtttttgcatattgtaggtctgctttatcctgttattctatgatatagctgtttttgaaaactgttatttcactttaaaaaccaaagcagcttacagtatgagtgtgattcctttaagaatttaattgtaaaattgatttgtgttcaataaacttactggaatgactagttagatcagtggacaaaaagataagaacatgtcaagtctctggaccaggaacgacttccaaataatacacgtgacacacagtaatttcttaacaaaagattagatttagtacataactttttaaaacctctatattttctattatagccattccacagtgcccatgggggtgggttgcaggactgcctatggataccaaggtctgtgggcactcaggtccctggaataaaatggcatagtgtttgcatatgacatatgcacatcctcctgtagactttcagtcatgtcaagattgctcataacacctataccatgtacttgccatgtgaatagttgttaaactatattgtttaatgaataataaagtctgaatgcttagtacaaacacattaaaaaaatattcttgatctatagttggttgaatccacaggcctggaaccccaggatagagtacaaactctagaagcaaaataaatatttaagaatcgaatacagcaaagattaaaggattaatatgagcactctatgaaaggtttgcttaattgatgagaaatgccataggaattcagtaaacccacagaatgatgtgaacagacaactcgcaactgaggtcatatagcagattcacaaaacgcacggaatgacgtgaacagacaactgagctcgtagaacagattcacaaaactcatggaatgacgtgaacagacaactcgcaactgaggtcatacagcagattcacagaacacacggaatgacatgaacagacaactcacaactgaggttcatatagcagattcatgaacacagaaaaagttcttagtagtcatgtacatttaaattatgtgctgctttttgctagtgagcacatttttcaaagtcatattacccagtgcttacaatttttttgatataatttagaattgtgatagtattaataggtacagttatcttttgttaaaaagaaacgttttcaataagaaccttagaatgtttatatcccttcctgggtaatttgaggttcttagacttatttgtgaggttcttaagtttggctagagaacaacaacaaaaacccaaaacactgaaacccagaggctgacaacattgacttagatctgagagcacaggcaggccccatcatttccacgttgagaccctgaaccatccctctctcaccctagcccctgtacggtccggactggaagagtccaggattgtggcacctgtttatgatgaaaatcttcaggagactgggcacaatggctcatgcctcatgcctatagttctagggctttggaaggccaaggctgaaggataccttgaggccaggagtttgagaccaggctaggcaaccagatagcaagatcccatctctacaaaaaagaactagccgagtgtggtggtgcacacctgtagtcctagctacttgggagtgggaggtggaaggatctctgaagcccagagttttaggctggtgtgagctatcattgtgccactgcatgccagcctgggtgacagagcaagaccctgtcccaaagaaaactcctcgggaagcatttgttatccacagaggatacagagtctagaaacaaaaagcttaaaaatttaaaatacattcacagccaggcacggtggctcgtggctgttatcccagcacttttgggaggccgaggcagcagatcgcttgaggccaggagttcaagaccagattggccaacatggagaaaccctgtctctaccaaaaatacaaaaaatagccaggcatggtggcgcgtgcctgtaatccaggctgcttgggaggctgaggcaggagaatcgcctgaacttgggaggtggaggctgcagtgagccgagatcgccactgcactccagcctgcactacagagcgagactcggtctcgggggaaaaaaaaaaattcgcagacgaaagataactgctcgatatttagggagaccccaagagctttgcttattgccagagcaatgggtttgcaccacctagagttgacttaccagcctgtgtctcgtgtcttccctcatccctctcctgttgtcatgttaatgggggaaacacaagcctggctgaaacatgggtgatacccgtgtcctgggtgccctgggcacaagtgtgcgggggagggggacggggggcaggatgctgggtgccctggggacaaatgtgtggggggcagatgctggagccaggtcgtagttacttgtgttgtctgagcttccttgggcattagagggctacttgtgggaagaaaagaggcgaattgaaaggaaccggagtctgcgccagggtgatccttattagttaacgatgggtattttagaaacagttttaaataagaatcctttcagtggagagagtgcacttgctctgtttgagtcatttaccccgaaatcacagagattctggtccaggtcaggtctggggagctgtgcagggctctagatcccactgcctccttcatacggccttgcctctgtgtggtgaggttgtcacaggggccaagatcccacgccctccttcatacggccttgcctctgggtggtcaggttgtcaaactcactccaccctcacttcttcccccacagagggaatcagacttcacctgggacctgggtgagtcccttcaggctgcctgacagggtgcagtgaggagagcctggggtgagatgcaggacacagccagcctcatgactgatgcccaccttcttttgttcatcttctatgactacaaaatgggtggtggtgtcacggcagggatgataagttctgggaaaaacagaataaagaactggcgtgtgttaactttgagatactcaagtagaacacagaactggggggtcaagaagatggtttcagatgactgccttttccctttggatttcccacacactcttctgttcacgtggaagctgtttgctggaaagaaggtttaatcagttaaaaccgagtcatagcttaggcttccaaaaacagcactcactgtctttgtcttagcacctctcaggatggccccccctccacagagcactgggagtcagtcccatgaacgaattctgaatcacattcactgtctgtccggctcctggtattaaattgtgtcctcccaaacttatgtcccagtcctagcccccaggactgtggtgtccctgttgggagcaggtctttgcagatagatacaacgctggcccccctgggactgtgatgtccctatggggaacagggtctttgcagatagatacaactctagcccccgggactgtgacgtccctatggggaacagggtctttgcagatagatacaactctagcccccgggactgtgatgtccctatggggaacagggtctttgcagatagataccatgctctcaggagatatcctggatatagggtgggtcctacgtcccaatggctggtgtccttggagaggaaagggaaatttgagacacagagaaaagggctgtgtgaaggcagaggcagagatgggcgtgatgtggtttcaagctgagggacgcctgagcgcacatgctggaggaggtagcaaggatcccacttggagcctgcggtgggagctcggccctgcccacaccttgattgtggacttctggctcccagactgggagagaatcaatttatattgttgaagctgcccaatctgggacatttgttatggaaacccaggggagctgacgtaccatccatctgaaaatactctttgcacccgaagtgtgcctcaggatggaagcttacgggagcaatgggagagaaatgttgaaaatgtggcatttgcatacatataagtatgtgtatatgtttataataattattttgacctaattctcagagtacactgcaagagcaaatgtgacccaaggtgtcgtatttcctggagttaacaccaataattctttgaaccaaacctataggctccctttacatatttgacataaaagatttgagtgcaggtgtatgactgccatagcccacatacagtttttatgatcagactgtaacattgcatcttgagaaaagatggtaatataaatggacaaataaagaacttgaggtcagcagtgacgagtgtgggatcacactgaatctcgtgtgtttcgctgtgtcactgcagagtgtaaatgggaaccatttttagcttaaggtaaaataggtaacaggaaacactacagaatgggtacaaaggcatgcccctcattaccaaagattacagccaagtgtctgcctcctggggaaggatctgttctgtggggagtactagacgtggatgatttccagatgtgtgaagggaaatgccccccgagaagcgtggctttggccggagcatgtcagatgagagttagcacagcatggagtttccacagcgcccctctcgcctgctgcttgtctcctctccccacccctggccctgactcttaccaagggaggaaagttcagctccagctcagcccacgcctagggctgtgggtctctagggcaggtgccaccttctcctgaacaggctgcggtagaggagggtctggctgtacttgagatgtgagagatgctctgatccagcatcctgcaaacccgggtgctgaaggttccttctgtaccatcctgcagggagagaggggtcagttcctgcctcccctcaacccaggctgacttcttgtctgttgtgtacaccgagctcttaagagtacctattgttaaaaataatcatccaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaataataatcatccagcagacaaacactgtaagatgacagcctgggagggtagatggggctggaaggtagtttcctgaataacagggttcagtttcctgtgttggcgtcatttgacccaaggcccccagataattgaaatattgtcaatcagcaaaacaccgatgttgtatctttttttaaaggaatgtgcgctaacttctttctaacagggacctgacaaaaagagaaggatttcttcactataagatgaaggtcggggctggttggcatttgccatctgtgactagcagggacccaggctgcttccctcctgccgcccaactcctgaccatctggctcctgcctctgtccccaccagcaggaagaggagtgggaaggcgccttttcccctttaaggggatgaagtgagagttgcacctccccgtttcgcacgtccccggggtgattctccagcatgggtgggagttgtgtttggaggcctgagccctgtgaagctagggttgctgttacctgagcagcagaagcatggactctgggaagtggggtcagggggcggcctctgctgcatccgcaggaggggctcctcgtcccagttgaccatcgtcactgcagaagggggcgtgggcttcatggtccattgataaatagaacgttcctctttttttttttttaaagcatgtcaaaccctaattccttcagcctttactaaagtggcattttataattccatgtgatttcattattatacctgcaggagagaatgcttcctgtaaaccagaagtgtctctgagacagttctcagcccatttagaaagttcattttcccacggttcaagacggcctcaggagggttgaggacacatctgtgacacggcctcaggagggttgagtaggtgcccgtcactaagcagatacgcatttatctccgtgtgcagggggtgactttgagttctgttctctgtccatgagaaatttccctgtggactagttgtgagggaggtacgtggcttttttttttttttggtaggtatctctgttaggaagagcatggggaggcaggtttgcctaagctgttccctaccttttccctttagcttagtaattttggggtcctgagatgttttcccttcacactcctgaacacactggcactctaaactgttgtaggaggccatctaacctatttagaagaataaactatttggaaggatttgagcacctttgtccttgagagaaacaagcctttgtttagtttgccccgaggctgttatggtgcccgggctgtgcggccttgagaaagctgtgtccccctgagcacctgcctgtggaatctggtggctgtgaagttaatccggcagctagatgttctggaaagcagattgcctcgtaaagtgttggtggtgatgattctaacacgggaatttcaatgtgttttccacccttctttctttctctcctcataccggagatgctgctgcatttgaccttaggcttcgtcgagggagggtcagttctgacactttcttagatactgaccttgaatggacagaattgagattcaggaaaaccctcgagctgtgagagtgtgctgggatctatgtaagtggggtttatgtgggaaactcagtaatagtttaagaaatatcaattccaggctgggcatagtggctcacacctgtaatcccagcacctaaagaccctgatgctacaaaaaattaagtaggagtggtggtgtgcacgtgcggtcccagctactcgggaggctgaggctggaggatcacccaagcctgggaggttgaggctgcagttgaaccgtgatagcacctctgtacttgtggtgcactgtgcctgagcgacagaacaaggacccccgccaccacacacccatactctctcacacacccatactctctcacacacccatactctctctcacacccatactctctctcacacccatactctctctcacacccatactctctcacacccatactctctctcacacccatactctctctcacacccatactctctctcacacccatactctctctcacacccatactctctctcacacccatactctctctcacacccatactctctctctcacccatactctctcacacccatactctctcacacacccacacaaaataccaattctaaatggacagaaacgaggtcttctcagtggaaaaacatgctgttttggttgctctaaggtagatgttgactcatttgccagcaagaaaatgcagcggccagttttgctgggaccacctgttaaggctaccctgggcctcatggtttgagaagggtctgtccaggggagagagggagtggcttaagggccttagaagccagttctggttcagcatgactgcgggggtggaggtgggggcagggctttccgggacatgagtgggtaactggatgggcttccaggatgagcccctgtgactttggtgggtttacatccatgcaatacaaatccacaggctcttactctagaagcttctgccggggctgatggactggcctggggacagagggtgctttctggtttaggagggagcactcagtcacttctaggatttatggcactaaaggggactcgtcatacttggaacagcagccatctgcattctagacttggttctgggcgaagtattttggagccggttggtaccctgtgttctctgtttatctataaaacaaagttagagttataactagttaaaacttattttaaaaattttgccacagaatatggtagttgtgctggagctggaagctgccgcgtgctggagttgcaagcgttgcctgcattggctgctcctcccagcgtgtctgtgttcttgacacgggcacccgtcgaggcagctgtttgtccgtgttcctctgaggttccacagacttcatggtcccgcggcagagcgtatgatatctgcttgcatcctgatttccccacaccccaggacaggccaagaattccttacacacaactgtagagggccctatggtgtgggtttgccggtgacaccgcctttcccgagctcggcctttacctccagagttggctttagggcgatagacgcttccgtcagactggggggccctgaacctttggtgttaggaattcggtgaacggcacgtatgatacctcgattctttgcatttgtagcaatagttgttaacaacatgaccatgagatgtacagaggaaggaaaaaggttttattttcagagtaacagtctactttgggaaatgtggtctcgggggaactgtaagcacacgcccctcaggaggggaggagaccgcggcatttaaacacacgggagtttgttcgctgtgtgtgttcatcaggttcgtggaatgtctgaacgtttacagggaaagtggggtttgttcgctgtgtgtgctcatcgggattgtggaatgtctgaatgtttacggggaaagtcacagcacacacgcagtgagttaacctgtaacatctgtgttcaccttggggcgagcgtaacatttgaaatgaggtggactcagcgcgtcacgaccaaagatgagctgttgggcgcagacgtttatgtgcagcctctgtcaacagccgagactggctcagggtctgcagcttttggcgggaaaggatgctcacgacgcccttctgtccagtcggggctgcctgcagggtcccagggtggggtgtctggtcggccggcatcgggagtctgccaaggtcccgtgggcagcgttcctctaaaccaggctgctgtctgactgtggaggagacttcatgctggttaacaaactgtacaggagttagtgccgtggggctttggggccaaccttcctccctgtgatgccgcttgcatttctctctgggcctcattgtagccacagagagtccatctcgtctgacagcagggggtgccatgttgacatagtaatttattgtattaatcaaccttttcattactatgttagtaacagtctttttttttttttttttttttaagagatagggtcttgctgtattgcccaggctaatcttgaactcctggcctcaagcaaccctcccacctcagcctcccaaagtgctgggcttacaggcttgagccactgcaccagcctacagccatgtttttaaaagtcagcagtttaaaaaccctactcctctcaccccctcaagcaggctggttggccttgtacaaactggggtgtcacgaccttggccccccttttatttttccctttctttggcctcaagttctgataagaacagcagttacaaaatgggcattaggtgattcttccattaataaagccagaattctcatcagttagagatgtttgtccccaggagtccagaaagctgttttgaatcaagcccatagcaaataaggaacaaaacccttggtcctctgcttaatatctgggaaatgtgttagttgctgacaccctttgatctgtgctcacgtgctgcatctcctcacgggaagcaaagtcgccctgtggaataaagcccggctcacggtggcatgtccgggatgctccgggctgtcagtcacttagacggcggcaggcgtggagactcggcatcgtgtgcagagctcgggcaaccggagtgcatccaccttagagaccacacagccggtcggcaaggtggacgtccaggcagatggcctgatgggcccgccacgtggtggcgaattaggaatttgttagcaaagaaatgaaacttgcctgttggtcccagcttctttgggaggctgaggcaggaggattgcttgagccagaaagtcaaggccgcgatgagccatgatcgcaatactgcactccggcctgggtgacagagtgagactccacctaaaaaaataaaagcaagctaaacctttccatagcaggaggggagaatttatcaaagtaactgcaacaaaaatcttagatgatgtaatttcagtggctaagtgagctatccagcccatgtggctggctcacaaagatgcaacggagccaggtgctgctgcagctgccctcccaccctgatcgtttgtggatgttttctgttttacggtgtttaggatctgtctcctgtcttttctgttttcccatatctcccttttggatacatagctcactactttatggctaagcaacagtaaaataggttgtctattttgagaactaacttttgtgtcttttaaggacggaaaacgaagcaggtgacaggagcatggcaacgtggtgaatagatttagttgaatatttaaatacttggcaccactctgatcccttcttcctctctcaagcttaattacagccgctgccttctaggacagagcactttcagctctgtgagtaggaattaaacattttctaaatcagaagttttagttaagcagtattttacgtgaatacccagtccataagtgctcactgtactggtgtgtggtatagaggaagaccgggtctatggtgcagtgtcccagttcccatctatgagatgggggccatgagatggcctagaagaatgttcagattgtgggattgaacggatctgccccactcctgggagcctcgagtctaactcgacttgggcaggttctagggagatgccggcagcgccgtcctcacaggtcactgggaggggttctggcaccatccccgtcaggtgtctcatgatcagctcagcttgcccatctcagaagctgctggtagtgttctcgttcctgttgtttcttgcgtgttatttaggttctgttcatgtggggacctaggaagttccacagtgagaggagagctgctgagtcgccttcctgcctggacgccagccccacggaggatggtaactgcttgaggttggcttctgcccccggcctcacctgtggaagcactgatgcagtggtactttgcaagctcctggggcacactgcaccgttgtatggatccacaggatactgtggtatccaagcacgtgctcccggaggagaggaccctacaggtgctgatgctgggagtcggcagagagtccagcgagtgagactcactgtgacgtgcacagctgccatctgcacagcgcctcctgagtccaagatggttgtgtgataagtgcacaaagcgcatctccagcaaaaagccactaagtgtccacatccgggatatccaccactatggctttttggtgttaataagatgaatgtgagtagcaagtggtctgcgttctgggggagcagcgggcggtctgcgttctgggggagcagtgggcggtctgcgttctgggggagctgcgggcggtctgcgttctgggtgggcagcgggcggtctgctttctgggggagctgtgggcggtctgcattctgggtgggcagcaggcagtctatgttctgggtgtgcgtgacggtgccactgcgtttttgtttttatgtcttggtgaaaggcatgaatggctcctgactagggtaggtaaggatgctgtgaccagggactctgcagtattgtagcttgaggaaccaaggaggttttctctctcgcaaacccttcaggggggatgttccaggctggtgactgctccatgaggtattcagggatccaggttccttccagacacctgccctacattcccaaggacacgactgtccttgctgtggttggggctgggtgattgccatgctggcgggggaggcttagggtgagagtggccatcatttacctaatctacataattacgtggagctgggagtaaagtgtagccgtggcctggaggatggacgatggatgttggtgaacaactggctgcactcaccgcagctggcccagggacgggaaggatggctgattatgccattcagcggtacctggttctttcacatttgactttcttatggattttctgttgtacagaggagagagcctgtggttctaggccaaccatctcactcatctcataacatcttgtatcccttagccaacatttatgtcaagttttagaagtcctacaaactggcaagcatttctcaatctggtgtaaccactggattttatatctgtgtctgcatctgtatttacatctctggttatttgacactctgtagtacatttgtaatcggttccatttggtggaagttactttcaacaaactcttgctgctacttgaattttcaaggttgcaagtagaaatgagggaataaacaccacatctttttgctctaattttaaaatttgttgttccccaaatcacaccataagtacaaatattaaaaattacaaaagcagcggctgaagtcaaggttaaggcatttctgggtgattttagctaatcagcaatatttgctgaggtgtgtggagcagaacaacatgccaagaagcccagaagcggggagggtcgggaggccaggccatgacttcagaggtgctgttttgtgagggagaggagctagatgcagagatgataaacagctgcagatgcacccactgccgcacttcgcacggtacggggcctttgtgagctgagttatgaaccgggtgaaggctgtgcaggcgtcggagaatccaggccagatgcgatgggtggaggctgggtagaggtgaggagccagacagcctcactgaatgtgtggtggctcactgcagacagctgtcccccaggacggctgcccttaccctgtccgcctccacctactgaggcctataggtgtcgcaagtgtgtggtttctaaacagacttggatgagttgcttgctgcctgatgcacctggacaggcggagggctggttatccatgatggcaccagggactctgccggggactggcaggacagagcctcagagcacggcaccagttccctgggagaagatggtgctggcgggacggaggaaagaagaggcacacagtgctgaggcatgaatgccagtttgctcttagacatgacacaaatgccttccggaagtttccacataggcgcagttaaagccaccagtgtggacgagtccttagatcaggagacccagaacatatgtgtatttgagatccttcacgtgctgccatctcttcaaagaggaccacaaggtcgtctctagtaatgtaaaactaacataaaagaattttttattaaatgccacggatttttttttttttttttggtggggtagggctggtgtgtgacagaaaaacagcggatacggtgacacagctggtgggtgttggttctgggccccagctgtgcagctgtatgaatagaaattagtctctacagtggtatgaacctaaacacctggattacatgttttcatgtatttaacataaataaatgcacacatttatatgctaaacacacatttttctaaattttatgtaataaaattcacaccttcaagtatttagcatagaaacagctgtgcagcatctccctgcccacagccacttggacgttcagagtggaaaccacgcggctgtgggctttgtgagtggtgagccgtgcacaggtgtgctgcatttgctgtgtctgctgatgtgagccccggtcggtcctgtttcaggtggacgctttcctttgtaattcccttctctcattctaagttcagtaaacttgggaccgatggtgagtgtaggcacagaggagcgcagcatcggcaattaaggaaaatccacgccaggcgttgcagaaggaggtggtgtgcgggggttccactgcctgtgtgagccatgactggtgagggcctctgggcagcagctcacctgggctacttggaaatgcagattcctgggcacagacctgctgggacaaaacctgagaggccctgggttgactaccctccagggattccatccaggcttggccatcatgtctcttggcaggtcactcaggcccggctgtctcattgagatgcctggccatcgcagggttagctgagtcacctgcacagctggtgtgggtgtgctgatgggtgtacggggctggcctgtcttcctttctccacctacgaagcattcaaaggcctgttatcctaccctgttctctccctgtcctcagtgggcaagcaggaggttcattttcacttgcagatgaggaaaattctgaagtcttgtaaagcagccaagatcatattcagaatcttctttgttccaatcagctcgaatttttacagttagaaagacttttcctcaaacactttgtatttgttctgtatgagaagtgccgtagactttgctgttgttttactaattagtatctgtactgtgttctgctgtccatcacaaatgtatgtattttcattctgagatacgctgagtctcagcctttgcaatccagagggatttcatgtgtgttcataaaagcttctatcagaaaccacattccgaatagctgtggacatacaacctgcttgtgacttggaaattgctgaagtcaaattctatctcggtttgaggcgttaggagctttagaaattttgaaattataaaatgaaaatgtgataaaattaagtacatttaaacaaaagagatatgctgtgggttttaagggctgtgatgcatttaagaatgcttttctgtattttagatttggttgtctttaaggatgtcatgttccatccaaactacaaatacatgagataatttaaatgtaagttgaacccttcagaatatcctggatttggtcttgatcttctgaccttgaaaatgtgattcttttttttttttttttgaaattgtgattgtcttaaactgtgtgtctagaccatctcctctgaattgctttggaaacatctgcacgggcatcttcctgttcttgagtatagagaggtggacatcattacgctttaaaatagcgaaagtcctgtagagcagtttttcttaatcagtgatggtatttaaaaatgaactccctaatgcttaaactaatgagctattattgttggaagtattcaaggtagcaagttatagaatctctcagtgaaagtgatttgaaataagaaattgcgagagtgcaatgcattctttgtttttaaaataaaacgctaatacttagagaatgttttgtttgcaagaatgtaagatgttatgtctttgtatagaatttaaggatagtaatttgcttctgagatctttgagatttgaaatctcaactatggtttatcgtccatgttttatacatttgcacatatacacatatatatgtaaggtatataaaagtagaggaaaataagcatgtatatatttacatgtatatacacttctataatgtgtatacttccagtcacatataggtctgagtgactgattttacttgatgaccatgaaggtaattaaataattttcctgctgttagccttgctttttgcatctgagcagggaccctgtgaagtgtgcctcccgcgttccaggcctcacacagtctgtaccagggtttggaagcaggggtttttctgcagccacttcaagaagcaggtggttgccaggattgcctggagctccaggctgcctccagttccagcctccctggggtagaagctgccccactaggggccttgacatggacgttagggcctggagccagggactccttcctgaaggggtgctccagtcacggctgggcgtgagaactgagggcgggaggtggaaccagcctcgggccattgcacggcctcctgggagtgcttatgggaagccccagccaccctttgctgaccccacagccagcatcaaactctgagatccccttggcccacccctcaggttcctaaaatgctttgggtttcctgggctgcgaatttttaggtctaggctaaaaggtcctgggacagagtcacagggttctttatgtgtaaaagcgacaagtgtgctggtaactcagagcagtccctgcatcctcgctccagggtcctttgcgtcaggtggaaacgggcgtgttggtcacacagagtccctgcatcttcactccagggtcctttgcatccagtagaaacgagtgtgtgggtgacacagagtccctgcatcgtcactccagggtcctttgcatccggtagaaacgagtgtgcgggtcacacagagtccctgcatcctcactccagggtcctttgtgtcatgtggaaacgagcgtgtgggtcatgcagagtccctgcatcctcactccagggtcctttgctcaggtagaaacgagtgtgtgggtgacacagagtccctgcatcctcactccagggtcctttgcatccagtagaaacgagtgtgtgggtgacacagagcccctgcatcttcactccagggtcctttgcatccggtagaaacgagtgtgtgggtgacacagagtccctgcatcgtcactccagggtcctttgcatccggtagaaacgagtgtgtgggtcacacagagtccctgcatcctcactccagggtcctttgctcaggtggaaacgagtgtgtgggtcatacacagtccctgcatccttactccagggtcctttgcatcaggtggaaacgagcttgtgggtcagagtccctgcatcttcactccagggtcatttgtgtaaggtagaaacgagtgtgtgggtgacacagagtccctgcatcctcactccagggtcctttgcatcaggtggaaatgagcgcgtgggtcacgtagagtccctgcatcctcactcctcaggtagaaatgagtgtatgtgtcacacagagtccgtgcatcctcactccagcgtccttagtgtcaggtagaaatgaacgtgttggtcacacacagttccctcactccagggtcctttgctcaggtagaaacgagcgtgttggtcatgcagagtccctgtatcctcactccagggtcctttgcgtcaggtagaaacgagcttgtgggccacgcagacggggagaacgtatctacaaaaggctcatctgataaaggctgttatccaaaccatgcaaggaactctcaaaacccaataataagaaaatgaaccacctgatgaaaaaatggaccaaagaccttggacagataccccaacaaagaagagacacagatggcaaatccacatgtggaaagatggtccgtgtcttatgtcgtagggcgaggcgccactgcgcacccagcagcctggccaaaactggaactgcgacaccgccgcgtgctggtgggcgtgtggggcatcaggaccctcacttgtggctgggaaaagtggggcagctgctgtggaaggcggtttcccatggaactaagcactccgaccacaggagcaaccacagtcctggacatttactcaggagctgaagtttacttccatgcggaaatctgcacacagatgttgacagcagcttttataactgccaaaacttgaaagcaaccaagatgcccttcagtaggtgaatggataaactgtggtacatcagaaactgggatattattcaacactaaaaagaactggaccactaatccatgaaaagacatggaaggatcttaaatgcatgttgctaagtgagagtccaatctgggaaggctgcctgctgtctgagtccaacgacaggacagcctggaaaaggcacaactgcagagacagtaaaaccgtcagcagctgccaggggttggggaggggaggggtgaatgggaggagcataggggctgtttagggtggggaagcaactccgtgtggggctgtcatgggggatccatgctgttccacgtctgtgaaacccacagagtgagcagcagcaggctgagacctcgtgtgagctatggactctgggtggtggtgctgtgttgatgcgggtctgtcatttgtacagacatgctggtccggtgggggtgggggaatgatggaggctgtgcatgtgctggggaaggagatacgtgaggactctgtgctttcctcccgattttgctatgaaccgaaaaccgctttttaaaaagtctattgaaaaggcaaacaaaaaatagtgctggccagatagaatctgtgtgagggtgtctcctgtgttctacattcaggatttccccattagaatacacaaatctaaattattcaaaagttaaacctttgcattaagtaactcactacaaagttaattacagtatcagtgagcttgagcactgccaggatagccaggatcctatatctggaccggcttctccccttacaggtgcagtgatgctcatggtctcaccccagtgagcagcagggctgggaccacacgtcaggctttggggggcagagaggaagcgagacttgtaagcatgtgcctgggggcaggcagggatgagcatgtggccagggatgattttttgacgagttttccttatcattgaggccttctcttagacttggggagtcgggagtccccactcaggcacctcagaatccacaggctgctcgtaatcctcacattccagatgcctcaggggaggtgttcagttgttgggtgctgttcctttgtttgctgcttggtgggatttgcctgcagcatttctggttgtttttaagagctgatgcttgatctgcttaaaatcacatatggatattgatttacctgtaaaagttaaaaatggaatttgagttcaaagatttgtgaaaatgctcgtttgtttactaatgtatacattacatttgtggaaatatccaaaagtccaggatttatattaaatacttctcttgatttttgtaatacctacttgtcatatttccatttgattaatagatgtcagagggcttaaattttgagtgcctgaattcactgaatttaaaacttaacgtcaaatgtaattaaactgaatgtagccaacagtgtatgactttaaaagtattgattaaaacatatataaaaacacatatccatgaacatgcagatggaggcaacatattaaaccatggaagtagaattagtgttctttttctgagaagacaaattgttaaaaagcccaaggggtcttagaattttttggtttccaacttatttgccctaaagtgaaactttggcagcagatggttgacagcagcagaagacgagatcctgggccagtgcaggctctgggagcagcgggggagtgcggaaggagctgcaggcagagcagggagctgctcagacaggtcaggacggccccagggcacgtggctcagtgagtgagaaagggttcatgtttcctggagagccctgtctctgcccacggaaaacccaaactccttccaactgggatgtgcatctcatgtaaaagttgttactcccagaaagccagtggatatagaattttttttgtatgcagaaattactttaaatttatttctaactttatccttttcttcccccatcttaaattaatgtctagtaactttctgcaggtaacgcacacgtcttcggaaagtgctgtatttcagttgctgtcggctctgatgtgactttgtggcgtctgatgttctggttctgaggttctgcccagagcgcggccctccctgctgagcgctgcttgttgaaggcccgtgtggaaactttgcctgtaagcatgtcgaccccagccgccttggttctcggaaacctttgggcctgctgagacttcacacgaccttctaaacttccttgcatgacctgttcattttagtgttacccattaattcagatgttttccagaatgtaagtaaactgctgaatgcagggtgggggcctccgttggctctggggagaaccatcgctgttactccgagtggagcttcctgcccgccatggtgtgctccaagacggagaagggttctttgggagaagcagccatcaaaggcccacgtctcagtggctgggtggctgtgggtgtgcagccttgtggccatactggcccctccccctcaatggcaacaagtagaggagcaggggggaggcctgggatctgtctccacgtcacagctgtgcttcaagactgcgtcgtccgtttgtaactagacatgcagagaaagtgttagcgatgagcaggagacggtttctgtccctaatgagctcaggtgcgcccttgagagggtcaggtttctgtgcggttgatcctgactcagcctggctgtggcagtgtaggtgactgctgggccccttggcaaggctgcacccactgtgcatctgaaacggccctcttcccaggctcgtggtgccagctggggggacccaggcctgtgcacgtcctgatttcccaccaggatggaggtcccatgtatgtgtgggggaggggaggtgggggtcctgccttattgccatatccaataccacgcggggtcagcactcaggaaacgtgctgcgtgggtcagcgattgaatgagttcagaaacctcgaaaactcagcagtgcaggctttgggcatgacccatccagcccccgggggtctttctctgaatttccttccatggcatccacctcatcccaggggctcccctgtccccttacagctgttggcagcttcacagcttcctctgccttccctcctgggccctggtgtggccggggcagctagtggctgtgcagaccctgcagccaggagatcgttggtgccagcggcttaggcctgggttacctgagccaaggactccagtgcacagctgggctcacccctaatggctggatcggaagcccttgggctgcaggtgggggttggatgttgaaggacaatctgcaaagcagaaggggaaatgggtgtgctggatggacagctggaggagtctgtgcagagcctgggacccagtgcagatgcagagctggcatggggagtttgacacggccaccatggaagtgggcaaagttacaggcttcagactgacgtcgaggggctggtctaaaatgatcctccttttcctttaatcctagtaactgctggaggtgggatctgtggtggcggtgaggagagacagggattttaattaaacctctttctggaagaggggagtagccatctctgtaggacggtgagcattgtcgtctcaggcagctaaggctgctgtaacaaaacaccattgactggcctctaaacaacaggaatttgtttctcacagttctggagggtggaaggtggcatgagggtgcagcatgggtgggttctggtgtgggccccttcctggttggcacacgccttctctctggccctgacacagtgggagggcaagagagttgctgggcccctttctgaggcacaaaccccattcatggggctccagcttcgggaactcatcacctcccaaagacctcctgacactgtcacgttgggggtgaggatttcaacctgtgcgtttctgggggaaagcctgtgtggacactgagcaaggtcagagctgcaagtgcgtacacatcagggccaggggagctgccagcggtgcaagagcagggtttcagcatcaatcggagctgctttcctggcagttgtactcataagctatcctggcaacgccgcttttcacgaaggagtcagtcaggcagcaggggcagcaggtggtgttgccagaagcttggaactgacgggtcagcagagaagaggcagaggccatgaccttggggtggtcagcagcactgggtgtccgccctccaggcctcatgcctgtgactgtgcagagaccgagctgaccaggacttgctggccagtgtggctgtcaggctggtgatatcggggtgtgctttccatgtgatgttccctcaaccccacgcccaccccaccaaactgcctagcagaaatcatgctgcctttccttgatgaaacgttgagtttcctgtggaggtgtaggaatagcatgatttggctcaagtcaaaatactttgtggtgaaactgcacagaagaggatcctaggcttccatttgacgtttagacaatgcctgagggttacaggaccctcttgttaaaaagcaccagatgagaaaggctactggttgttaataaagagaccttttatattatcacagagagggtggcttgagataaattcagtgtaacatacttgtgtttgtaagccgtcaatcaaagggaccatctttctgctggtgacacgtttctggtattgattttgttctgaaaaaggatgaatggcattcggtagaatcattccaaaattcacttggaaggcgtccatatggtgccttcttttcttctgacattctgggtatcatgaggaattattcttgccttcaccgccagcaggaggcttttcccaaacacctgctcctcttcggcgttgtgggtgtgaaggggtcagagtgaccctgtcttcatggagctttcagacaccaggacagtgtggggcggagcgtcgggcttgggtgggccagaggctttccccagaaaacagctgctgactcaggactgccctcgactcccctcccttgttccttcacctaatgtctgaattagggctgtgttctaccatagtgggggtgtcatgttaactggaagtgtgcttttgttctgggcagtaagtaaattcatggtacatttgccaaggacagcaaggtttgatttgatgaatccagtggagaaatggagaagggaaaaggagaaggggcttggctggatggggatgtgtatgatgggagcggagaggggcggccatgcaggctggtgggatggaggggccaagtccgtgtttccatggagtctgtcaacgtttgactgtgccactagacctgaacctctgtgctctacttttaaaaacccccacagtgaggaagcccctgatgggcctgagttggtacttcctgtggccattgctgggaagtgccgcggatgcctctcctggctgatgatggccccgggcctggaaactgggttcatcctgagctctgcgaggggcttgggttccatgcacagcaggcacctgcgcatccccctcccccatccccctgtcccccctcccaccctaccccctgtcccccccccaccctaccccgtcccccccaaccccctgtccccccccaccctaccccctgtccccccccaccccctccccctttcccctcccttccccccctttcccctcccttccccccctttcccctcccttccccccctttcccctcccttcccccctttcccctcccttccccccctttcccctcccttccccccctttcccctcccttccccccctttcccctcccttccccccctttcccctcccttcccccctttcccctcccttccccccctttcccctcccttccccccctttcccctcccttcccccctttcccctcccttccccccctttcccctcccttccccccctttcccctcccttccccccctttcccctcccttcccccccatcccctcccttcccccccatcccctcccttcccccccatcccctccttcccctccccatcccccccctcctctcccccgcctcccatactgcccggttgtccctaatggaagagaatcaatgatgccacttcactgatctccagggaaagcaggtcaacaacaggttataaacgtgggaacattttggaaaagctgtcatctgcttgtcagctccatctttcctgcccggaagatgtagggagaacctgccttcagcccaccctcatcccataacaggatggaggacaaaggtacagagacccaagtcatgccagtggcttcaggaaaccccctcgtttcctctcgtcgtggaagtggaaaccatcccactggactagatcttcctggggaagccccttcaccccgaaagcaaggaatctggtttgagcacagacatattcttagtgccatcactttctgcagctaaactctccgtgtgtggcctgttaatcttgctagttcagtgttattgggtcccaggagtttctgtgggttgatggcaggtgtttaccatagtgtttagagacgagaatagaattttatctattgtgtgaaaatcaggtgataaccattgccgtgtgattgcttgggttgggtgggggcggtgctcatagctttttctgaaggctttcttatttttatttttatttttttgagagacagtctcactctgttgcccaggctggagtgcagtgatgcgatcttggctcaccgcaacctctgcctcccgggttcaggcagttcttcctgcctcagcctcttgagtagcgggattattagtgtatgccaccacgcttggctaattacaaaaatttttagtagagacagggttttgccatattggccaggctggtcttgaactccttacctcaagtgattggcccactttggcctcccaaagtgctgggattaaaggtgtgagccactgcacccggcccgatcctgacatcttttaaatctgccttcatgaaccaaaagccagtctatgtttgaaaatcagcttggaagagcctaggaggagagggatgtacttcagctaggtaaataactatgcatatgttaaaaatataggccacaatctacctcaaatgttaactcttctgctttgtattttatatccatttatggttattctttcagtattaagatttttaaagattcttttgacaattatggacaagttactattaaaactcagctgcatttgtaacactttaaagaaccaattggatgacatttttttccctgaggcattttggatagttatgtaattaacgtttataattcttaatagtgataacactaagtgttaaaattatggaacaatttgtttttctgaaaattactatctgcctgctcaccaggtgggagctgatgagaacgtggacgtaaaaattgtttttagcttgtataaaagaagttaaaaaaagcttgttttttgctactactgaagttgcttagctacagaaatgaggttattgcaggcacctagaattttacccccttcacttccacagtgggaataaatcctccaagcacaggaatccgacattctgatattgagactcctaggcataaagccccccatggaaggggggtggtgattacgtgaatgttggcgttgatacgggcatcctccaagccggacgcagggagcagggacgtgcagaaagaccaggtccctcaggagccatgaggaaatacggtgttggcagcagtggtgagggtcggtgtcaggggccaggaggaggtggcgaagggagcatgtgcctcaaggcagccctggaacccgcggtccttggagtgaggtctggtctgcagggggacacggacggccatgcggtgaggcccacagacagcctggacttggctgcctcagaaccctctggtgaacattgcgaacggccctgcagggttgcagtgtaaattcctcggacaaagaagacgcctggaactgttcccggcacgaagccagcaccctgtgaatggtggccgttgctgttgtgactgagtgccgtcgaactgggggcatttgttctgctcagttcacttaattgggccaggagtggggttgccatgccttcaacaagcttgacgtattgaacgagaactgagtcgataatgcactgtgtaaatacgctctcctggctagagtgagcaaagcccaaggaaggggggtggttcttcagtattagcaggtgtttgtggtggggccagctgtgcggctggcagggcgaatgcaccaggaagcctctgtccccccgaggtggccagcattcctgttacacatgctataggcagaaggtgggcactgctggggaacttgctcatgttcctgttctctgattggaaattcaaggtttctgagcatcctacatctgaatttgtacattgccaagactgtacacatttcagcactgttttttctgctttttggatctatacaacctggcatttggccgtggcttccaggacaggctggatggtgagtgaagtcctttcctcactgtcgatgtttgcagatgtctttttgtataaactttgtatttcttgagaggttcgattaggtttttacttaatgagacttttaaaattgccatgcacatgattctaccagttacaatcgtgagctaacgtgagtttttggttttactttgatgaatgtttaaacatgtgcaggctggacatggggtgggggtggaggtcatttatctacttttcatttccttcttggttatacttagtgactttcaggtaaggtgtggaaggcgtggtacagggtgaattgcaggctgcagtgtggcgcagtggaccgcggtgtggcacggtggacaagaagcatgggctgcggtgtgctgtggtggacgagagccacgggccgtggtgtggcgcggtggaggagaggcgcgggccgcagtgtgctgtggtggatgagaggtgcgggctgcagcatgcagtggatgagagtaaaggggagacttccgtccttgagggaaacacgcgacaaacaattttaaaaactgatcatctggcttacatggtccaacaaattcagtttgcaaagtttgacttctaagttattgtagtaacttttcccctaagtcattaatttagtagcttatgtttatttcttttgtctaaagcgagtcataaattctaacatgaacgactaaacatgtaataatttaggcatacagcacctgaagggaaaactgccagtatgctaaaatattggatacagatgcttaaaaaatataatgtagcactcttaaaatgcatgtgcttttagcatgaaacttggtgagtagttttgagctatatttgtaggaatgtgtatcttgaatactttagggccccactgcagatgtgtgcgtgagatgtataaatactgaatgttcttctcccttcccttaaatgaaaaacattagctcccttttttttttttttttttttttcctgaagtggggtctcgctgttgtcacccaggctggagtggagtacagtggcgcaatctcggctcactgcaacttccacctcccaggctgaagtgattctcctccctcagcctccctagtagctgggattacaggcacccaccatcatgcctggctaatttttgtgtttttattagagatggggttttgccatattggccaggctggtctcaaactcctgacctcaggtgatctgcccaccccgaccttccaaagtgctgggattccaggcgtgagccactgcccggccagctcctttctataatgatgtatacagttgtttttgctttttgttttttgagatggggtctcactctgtcgcccaggctggagtgcagcaacgcaaatcttggctgactgcagccttcacctcctgggtgatcacctctcaggtgatcctcccacctcagcaccctgagtagctgggactagatacatatcaccacgcccagctaattttttatttttatttttattttttatttttagtagagacagggttttgccatgtttcccaggctggtcttgagctcctgggctcaagcaatctgcctgcctcagcctcccaaactgctgggattacaggtgtgagcaccacatctggcccatttttttcccttccaggattagaagtcaactttaaaaaacgcttcaaccttgcaaatttaattttccataataatatgcctctaggataaaaacaagacagaaacaaagaagtataggtggactgcagttaaaaattgtcaacacgacattgcttaggaaggttgacatttacaaagagcaggaggcccgttcatgcctttgtaagaaggcactgggaacggccgtctgtgggcgaccctaacgtgtgcggtgtcctgagaggtgattgtggtgctcacgcttttaccgagggcctcccgggagtaccagaggctcttctcccgcagtcggccagccaggcagcagcagctggagaaggaacagacagtaaaggacagatatacacggtgttatcgtgtcacacaggttaaagccaggctcactttgttcttacagttttgaaaaactaataatgaagtccttaaatatgtattgcatttcaggatttttaagcggttgtgggtgtgtctgtgtctctctctagctcctgttcggtgctccctgtgaagagagctcggagccgccacccttcattgttgaggtgacagggcctggagaggtgtgaaccccgtggaggggtgactgacttgtggggggaggctgggtcagtgtcgggatccacctcccaccacgttcctctagggaagccacagttctaagtctttatgggtaaaatgaacctggaagacgtgttattttttaagaagtaaatgctatgttcttttttcctcatacttctccgtgtttaagcagcattgaaggataaggcactagtagcaccttggtttggaaacaatcttgttggttattttacgttgaatctgatattaaggttgcctggtaacagaagttttcctttaacgacatggaactctgttgaatctgttgccccattggctgagccgcctgaaatcagtgctgtggcagctgaagaggccgcttccccttggaggaagccgctggattggcaggacacaccgcccttgattgaggcgagtttgcaggaactccacgctggcacctgctgctctctcctgccccctgctggctggccaagcagcatcgcgacagtgtgttcagcgtgaatgttcactggggcaggccaaggcttttgttccagaaacaccgacttcagaaacggctgtgtgtattgagcatggcaagaaagacttacgtgtgtcttaaacctcttgaacaaagcacgtcgatgtttcaactgcatctcgaaggctaatagactttgctgtggtcaatattcaggagaaaataggttttaatgagataaagacatgagtggcaagtgacatgtttgtgcccccgtatgactaagtgatgtcctggctgtcccacaccaccagctctgagcagccagcatgcagatattgggtcaatttagatatccctgatctttacggaggtttgatcaggcagctcaagagcagataaacacaaatgctgactggaaaccccggcacacggaggcgctggaaacagcaggctgctgttaacgtcacagtgagatgcagtcagctgctctctcaggggtgtcagcttcttttgcttctagatttccgtctgtgctgcaatagagttttgttcagcttatccccattgctctgctgtcttcgctgttaaaatctcagccagcacttggctctgaccctgcagtaatttcactgtgcggctgcccaggcctgcctggcacggctgtaaagcaggcgagagctttccggaaggtggtcacgagaaccccaggcgggaaagagcgttgctggtccacatacggcagtgcacctgcagctgagcatgtacgtgcacgttcaggctaaatataggtgcaggagagaagaaaactgcctatgattagtcacttaaaatgccgaatacccagcccctgagaccctaggacacagagcaggggtcttggagacggcaaggtgtgttgaagtctggttttatcatttagtttctccaagcagcattttcctcatctctaaactggggctaacaactgccccacatagatttgtgaatggaaccaatgagtgtaaagtggggtagcccccaggacctagaagggactcagtcagtttcagtggtcatgcgtgttgtacgggtcccccaggaaggcgattgctacagataactccctccgttcgatgtcactgaatgttaaagtgggaccttggcttctgatgtgtctggtttgctgcaggccgcgctgcaccccgtggttcctgagccctgggctgaagtagccctgctgcattgcctgtgccacttttgctgtgaaaggagaactcctgccctgggaagcttcctcttgctgcttagcctgatgagcaccacaggctgcagcgagacccatctgaagcgtgggttgggaggagactgcggcggccctgtcctctccaagctgctctccatgccgaagcgtgggctgggaggagactgcggcgccccgtcctctccaagctgctctccaggatgggagcgactttgtggggtttgtcggcccttctctgaggtgtcctgtgtctcatggatctgcttatgagcccccttagatgcctctctctcgtctggacgagcaccctccaaaacactgcctaccacccggatctcctggcgcagagtgaggtcacacctgcagcccttaccgcacagagtccctgagatattcggcaagaatgggaatgggctgtgtgtgagtttccgctgcggaagccggctctgctccgtagtctgtctttggggtgtgggatgttccgacctgctgtgtccatctggagctgcctcggggtgggagggggagcagcgcggatggatccagggaaggacctggttgaatcccagctgctcacatacttgttgctggtcttggacaagctccttagtgtctctgagcttcagtttgtctgtaggaggaggatgctgcagaagtctgaagatatcggtgcgtgcgggaatacctggcgcggttaggacgggttttccttcagtctcctctatgcccctccccgggtgaatcagtatccacgcgtgccaccagggaattacagtcagtctaaaaaaccaatcgacccctagttgtatggtcaagcatcgtgagtgtccttgccaggaaatgccactagatatcttgggcctgctcgtctgtccacagcagtccctggaacaggccggttcaggacatgggaggtgggagtcagtgttctagcgaggacaggctgaagttaaaaggctcatttactctgtgaaggggtgcccaggatgagacatccaagaggtgccaggtggctgaccctggaggtggacggtcgggtcagagtggccgccttccagcactgctgttggaacagccgtgttttcgagtgatgccttttttgggtcatgcagccctgatcagtagtacacaacttcccatctccagccagtctcgtctcgccatctcctgtatgtgcggtacagttgcctttaagtggcttcttctggacgctgcggttagggtggcagcaagcaaacatgggaggcttttttcttacgttgaccaaaatacgtggggccagctttgcatgatcccattcagcatcacacttgtccatcagccactcacccatccatccatcccagagagtcctggaccagaccattgagtggtctttgctgcgaagagcttagcggctcacaggaaatccggaaccagcacaatggtaacagtgcagcaggacctgtcatttatcaaggcagtatgctgggccggatgcggtatgaaattatccagttaggtaagcactgttagaattaacccccttttgcctaccaggaaatcgaggatgggggcattaacgctggggagcaagggagtaagggcacacatggaggggctgagggcctgggcactctgagcctgtggatctgcgcccaggctgcacgggcaccggagatgctgctctggagtgggtgaggggctctggggaaaagatggagcctgacatgggtaagatttggatattttcagaagagattttcagcctggaatgagggtgtaagtgactgaatcgcggtggtgagccagaaagcctggctgcacgagctcctctgtggcgtgagggaggaaggcgttgggggaaggtggctgagcagaggtgctgggtcatcaggagctgctctgtgcttggaaagggagggaagggcagcaccctgcactggaagagcacagagacgtggttgcagctcttcctgaccaggacaggcacaaatggtgctgatgatacaacgcatggactctgtcttcagaaaaagattgtggaaaagtcttctcctgtcttttaaaacttgggcccctcatttaaacttggtggcctcaggtgaatggtcaggaacagtttctgaggatgatgcagagattgtctgcagcctctgattgtgctcaggttttcacagatggggtgggacatgggcactgggctggaatgctctaaccttcgatcttcaatcgtcagtactgaaaggaatgtgcgggaacaaactcacctgtgcgcatatgtatcgttttcaaagacggacgagcttttgggaaatatctaaagatttcaagttttgaaggaagctgagatgacactggaaacatcaggaatcttggctgatgaccaggtccgtcaccgcgcacacagtccctaacctcgcacgcctctgattggacacagcgggtgaccgggtccctaacctcacacacctctgatagtgcacagcgagtgaccaagtccgtaacctcacgcctctgtgcatagcgggtgaccaggtccctaacctcaaaagcttctgattgggcacagctggtgactaggtctgtaacctcgcacagctctggttggacacagcgggtgaccaggtccctaaccttgaaagcttctgattgtgtgcagctggtgactaggtctgtaacctcatacgtctctgattggacacagcgggtgaccaggtccgtaacctcacgcctctgtgcacagcgggtgaccaggtccctaacctcaaaagcttctgattgggcacagctggtgaccaggtctgtaacgtcgcatggctctgactgcacagtgggtgaccaggtccctaacctcgcatacctctcatcgtgcacagcgggtgaccgggtctgtgacctcacacctcttatcgtgcacaatgggtgaccgggtccgtgacctcacacctcttatcgtgcacagtgggtgaccaggtccttgaccacacgcctctcgtcttgcacagtggttgaccgggtccatgccctcacacctctgatcatgcacagtgggtgaccaggtctgtgacctcacacctctgtgcacagtgtgtgaccatgtccataacctcacacctctgatcatgcacagctggcgggtgcaggacccacttcagtgaggggctcgtttcctgggtgtgaggtgggaacgttgcgtggctcgctaagcccctcctccgtgctttgggggctccaggctgtggccggcaaatagaatgttgtcccgggaggccactgtgtgttgggggataggaggcagctgcagactgcaggagtgcccagccccttggtgcagggtggtgtaggcatgcgtgttgctgggagtgccttctgcatgtgagtactggggattctattctggtacgttggcgtatcattcagcgtccccatcacatttgagatgaactgtgctctgtgagtggccctgccctgggtcatgaccacacgctggacttgagctgtgggagccacatggacagttgaaagcctcagaccccagggctacacacactgagatttcccaactgcctctccccaggccttgggctgatcccccttgctgctgctgtcccaacccctgacatggcacagcttccctctcagaagatgtcatgcagcttgtctgctcttcataaatcttatgcacatttggatgccttagcttcatgcagaagtcctgcaagcaggagaaaatggagccttgactctgggctggtggtctccaggcatctctctccagctgcatcccagcaagtcaaggttatttaaatgtgtcttccgaagggtaacgagcatgggaagcatgtcaatgccatgcagtgtgaggtggttctgggaataacagtacctagcagcacataccagcactcccttgtgctgccaaatgtgacatcgtgtagatgtcacaacctccttttgtcacctgcgttcctaatcccctggatttctcagcttctttacttctccaggagaaaacctgccccattgtcctgttacctctgaaagggagtttttacagcaggagatgatgctgtagctgtcagtgtaggcacatgcagcatcctactgttgtcaggtgcgcccagaggaaatatggctgggcaggtggtccccatctcctgtggtgtcaggggcacccacaggaagcacagctgggcaggcagctctgtctccctggtgtcaggtgcacccagaggaaatatagctgggcaggtggtccccatctcctgtggcgtcaggggcacccacaggaagcacagctgggcaggtggctccatctccctggtgtcaggtgcccacagagggaatatagctgggcaggtggtccccatctcctgtggggtcaggggcacccacaggaagcaccgctgggcaggcagctccatctccctggtgtcaggtgcacacaggaatcacagctgggcaggttgtttattgccaggaagtacagctggggatcagtcgagagcctcaggcagggggttaatagattggaaaggttgagaaccttggcttgatcactaacacacaaattgtggcagtagaaggtggagatgcccctgtccgttcctcaaatgttttgctttctcctgtttcctgaagagcgtcttgttgcctcctaagatagctcctgcgtgtatatctgtatatccttgtagagggactagagacactgctgggaagttagtgactctgtgttgatgaggtgccggttattagtctgttgccttaaaacatcagcaattggaattgctcctcggaacatgactggacccgttgccgttttctgtacagttttcttttggggagatgcacacggttccgggaagggtgctgggctgcagtaatatgggtgtggacacaggtcccatcagaatagtatcccttggagggcagggtggggatcccgcgggttcacggcggttttgctgaatgaatgaatgaatgaatgaacgaacctagcactgagagtcacatgagctcatatggaaacagcttggagtgttgagaaatggagattgaagagctcacctcttctctgagtatgacggggtcagcaccgctggagctgagggtttgacatgcaatgaaagccgtgatgcagccatagtgcgatttggtttatatagctattgccttctgttatgaagctgaaaagaaccaggttagcggccacctgctactcaggccttatgctttcttaggaaacagtaagatgtactaaatttttagtgttaaagtgacagaacatgggaacacgggaagcgtctcatcttgtcacttgtgacttggacacggagcccgtgggtgcttctctccatggtcagacttggtcatggagccgtgggtgcttctctgcatggtcagacttggtcacggagccgtgggtgcttctctgcatggtcatcttgcagcttctgagtcccatcctcgctctcccggcctaaggtggctgtgctagggatcacacctgcaggtctgacggcaacattgtgtgctgggtttctctcccaggacttccaggtagttcgtgcctggaatagttccatggtagcagggtatcagcgggtggccagcctcggcacgcctgcatggatttgccgtctcgggggtgggagccccatggcagacggctgtttcccttgcgtgcctcttccagcgtggcctttattctccacagggcgttggaactgatttttgcacaacagtgatttgacagtgattgatacgctgtgggtctccagcccaaggagatggggataaatactctttattgctctttcatgctctggttaggaaggcagttaggttgaaggctgcagttaccacctgtgtgtgtcgtgagatgaagagagagtatttccatgaaatcctctcaggttacagaattagaccagttgtatctataacccagaagttgaaagcagttgactttaagtgtgatcaggaatctggaatttaatttctgagtaaaataattactgtggaaatgagtctttggacttggaattgaaatcaatggttgtaaatttagggtaagtcacagtaatgggtttagacaaaacgtctgatgtaggcggcagagattttcaggtgtatatagaaccgtgatgaaaaccataggggacaaaggaggattgtcctgtcctgaaagatgtaaaaatgcggttacaaatgcagacctcagtgtgcatatagaggccagcaaacgttaactcggtgtttggcacagcagaggggtaagagccgaaggaatattgctggatgttcttcaaatgactcttccctctcagggtggaagctgtggttagcacccactggttttgggtctgtcagtgacgactcctggatggtcaggtggtgctctcagagaaagaggctaggaacacttccatggttttccgccagctttaagatacatctttgtagcccttggttccatttgtttctcccttgtagttttattttgcttgttaaatttatgtatagtagcactgccactctcttttgtggtcagttcttttagtttccgagtgcttattatgtccatccacttcattgaagtgtctgttcgatctttgccagtttttaaattggaacgtttattgtcctgtttctttccctttcatgtaacttttagcttgtctgcatctacagaaagtcctggcaggatttatgttggaatcatgataagtccgcaggtcggtgtcctggcgggatttatgttggaatcgtggtaagtctgcaggtaggcatcctggcggaatttatgttggaattgtggtaagtccgcaggtcagtgtcctggcgggatttatgttggaatcgtggtaagtctgcaggtaggcgtcttggcggaatttatgttggaattgtggtaagtccgcaggttagtgttctggcggaatttatgctggaattgtaataagtctgcaggtcggtgtcctgccaggatttatgctggaattgtggtaagtccgcaggtcagtgtcctggcgggatttatgttggagttgtggtaagtctgttggtcaacgtggagagaattggtgtcttgactgtgttgccgcttctccttggactcgtggctcagttgaggtagctctttcctttctttcttcagtgttttgtggttttcttcatacacatcctctgtgtgctttgttaaatgtatacctaagtgttttttatacagctactgtaaatagtgttgtttttaacatttaggtcccaaatactaattgccaatacgtagagtacactttgactgtgtgctgtgacttggctgaactcaggtattggatctaggactgacttttgtagatcccttgggaatttttatacgtaggcttttggtgtgacttgagtttcctcctttctgttttcagtttctttgatttgtgctcattatgatgtctttttctggctttgagtttaacatagaagcttagattatggacctgagaccttacttttttcgaatatgagcctttcgtcctatgagcttacttcccatcattattttggctgcatttcatagattttaatttttgtttcagttcacttgaaaagtattttcctttgaacactcatggtggttttatttagttcacccaaatctcattttagcaaaagataaaaattcatgtaggtttagttcctgtgtgtgcctcataatatcttcacattctgtgcattgaccagtaaatgattgggcttatcagggagatggttgcatggtatattggtgttgtaaaaactatgatgtgggaatttgaatgtttttgagacagggtcactatcacccatgctggagtatagtggtggaatcatagctcagtgcaacctcgacctcccaggctcgagcaatcctcccacctcagcctactgagtaactgagactacaggtgcatgctgtcatacccaattaattaattttgttttttgtagaaatggagtttcactatgttacccaggctggtcttagactcctgggctcaagtgatcctcccacctcagcctcccaaagcactgggattacaggtgtgagccagcacacctggccaggaattgaagtgccacgaaggtgcagaggttttatgttttgtgttctgatattgccaaatacctggcacagtgcctggcctgtggtcggtgtgtaacgcatattcctgaatgaatggatattgcggtgcctatgtgttgaattcaatgtaatttcactcagttgtgtttctccgtgccagtccttttgcctgtctggactgctttgttctgcaagtcaccttgtaatacgatcatattcttcgatcggttttgcactttgattattgacctttttttcattttaaatgaagcctccccattctttctgatcagatattctcatcttccctctataattggggtaatatggtatcaacgcatgtgttttcataaacatattattataaaaatccttgaatacatatgtgcttacataaacaggtttgtttcataaaagttggtattgcaaagcagagatcttaacaagttctactcataatgtatcaatgagtataggactgcatacattctactttatttgccttctaaataaagtatattcttaattattgccacttaataaaggttgggcaagatcttctagaaaggatgtttccacaaactaaagtgtgtactatcaacattattatttaaatagctagtgaaaccatcaaaatcttaccacatttacatgttgcaccaggaatcatctctgctttcctccctgcaactcagtatttttgacacaatgtgaattagtgcacaggaagcctcagtgtttcctggagggttgcccgcagctcactggcctcagagaaagtcataatgtgtgtacaaacttctctggaataacttgagcttattacatataacttctggtaggtcatttgccccctccgctctccaaaagaaaacctcaggcctcttaaattaactacaagcctttttgggactgagccattattttacacagcaaggttgtcagaaaaaaaatagctttaaggatgatagaaagatcttagcattttctgaagcctgaaacctatggggggagacatcgcagtcattcctgtcctgatgggacctggcctgtcttgttttgttatccattgcttacccagatgaggtgatttgtttaagaaaatcattggagtcattgaattaagcatccctgtatttccagcttttaaaagattttaagttaaaatacaactttttaaatcttttatccagcgaacatttggtgatattgtgtctgtgtttcgtgtgcactttgttttgtgtaggatttctgttttatgtactctgtccattgcatggcacacaataggtattaaatatttgggggatgaatgaggaaataaagttcaggataatttctatggcatttggaaattctcgtgtaaaacctaggcacgtacagtgttcccaaacaagggccaagtgaaagctgcagtatttgtttgattaattactaaggagcagtcactttcccttcatgtatcctggacttgtggggtcacaggacctactgaaatagtactgtataacgtctgctggagcagccaagggctggtggctgcaggtctcaggaagagaacacagaagtagccatgggccctgctcctgagacaggccaggggttggctctgaacccacctttgccccagacgctgatgagcacagaggtggttgtcagggaagctggcacattgcctgcaggggtccctggcaggtacagatgtaggggagggcccagctgaacccacatctgctgtgaaggcttgcaggagtctgcgcttgctgagggggccctagttttattccctgggtctgaacttgctctcagtggccctgtctgccttcaaaatccacccgagcaagagctgggcttagggttggggccccttccccagtcccattgtggcagggtcaggttactggagataagtcctagtcagcacctaggctattaacaagttcgaggggctggcatatccatgcttgctctatgataaagtcaacaatttggcagatggtaactagacatttcagagttcctttaaaatggtgttagtaaagcccatgatacggtttggctctgtatccccacccaaatctcatctcgaattgtaatttccataacccccacatgccaagggcaaaacctggggaggtgattggatcctgggggtggattcccctatgctgtcctcgcgattgggagatctcacgagatctgtttttttggtaactgtgttcccttcctgcgacctgcagccaccagcccttggctgctctgtcagatattatatggtactatttcagtaggtcctgtcctccccctcgcacacctccctctcacctgccgccatgtaagataggcctttgcttccccttcgccttctgccatgatcataagtttcctgaggtctccccagccatgtgtaactgtgagtcaatcaaactgctttcctttataaattagagagtcttgggcagttctttatagcagcgtgaaaacagactgatgcagcccagcggtccacagagggggagcccagccgtccacacagggagaaggtgacagtgcaaatgctgctgtcagggctgcgctgccaacgagcagccagtcagcaccacatgtgggaaacctcagctgtgtagccattgaggggtcagggctgcaatgctgacaaggagtcagtcagcatcgcgtgtggtgaacctcagctgtgtgaccatcgtggggttcagccatactgttctcattgagcagcccattttcaaagtctgaaaaaggataacaaaataataggactgaagttttcatagtcagtgccttgcatgaaaactggtggttgagaattcctcaaggaaagcagaagttgttctccgagtcagcagtgctgtgcggtgcagagcagcgttggtgagaaatgccggcatgcagataagtaacaccatagaaaatccacattcacagctctcagaaagcttgttttatctataattagctggcaggactcaacaaatgcgcattgcctccttaattcgcccacacagcagtagcttttttcaggcctggggtgttactgggaaacggtgagtggggtcctggctcatcctgaggtgtgctggagctgagaggaggttttgtacttggggatggaggttggggcacgcttgagcccagagtcttgaggtgagctgacttcttcattgaaaaattatattctctgggaaggaatgggcagaaacttcaggtaaatgaaatggaagtcagtcatcccttgacagaggtgcatctctgacgagccccctaagagagagccccctgggcagcagggaggaagaagcatgactgcgctgtgttctacacgtcctggtggggtctgtcagcaggacccctgaggggaggcaagcatctccactggcgcctgcttctgtggcccggactgctgattgtgagtggaattagttcactcaggtgtggagattcaaggggctctgaggacttccttcagctgaggcatctcctgttagagcccagtcattccctgggtgtacagcgtgtccctgtcatctgcttccccaccctttgtgaagagacaaccaatgccaaacagcagcagcatcactgcagccggggaagccagctggatagcaagaggttgggaaaactcaagtactgtgtttatgaaacgcatgacagaggctggattcagtggctcatgcctgtaatcccagcactttgggaagtctaggtgggtggatcacttgaggagtttgaggccagcctgggcaacacagcaagaccccatctctacaaaaaatacactgttagccgggtgtggtggtgcctgcctgtggtcccagctacccagaaggctgaggtgggaggatcacttggccctggaaggtcaaggctgctgtgagctgtgactgcaccactgcactccagcacaggcaacagaggcagacctgtctcaagaaaaaatttttcatctcatgacatatgttttccctgtcccaacctattccaaaatagctaattttttttggcgcttgcattttgcatttcaactccaaatgtatgatgaatgttgcttcaagaaattcttcctctgcatcccatctgtatggcggaactagccaggtgccctaacattaccggacgcttctctgcatggtcttacgtgtgtcagaggagccctggctgcatgttcagcttctctggatccaagacattgctgtgtgtggcaggactgatcctcactacgtacggtttggattccttgtatgagcgtctggaagaagacaaggtcttgagctcgttgccgcagcaaacagttcgcaagtgaaggacgcctgcttctccctgtccagagctgccccattgctgatgaagacagactgtgaagttggtcaacagagaagcagccgacacagcagaatgaccaggaagtaatgaggggtgtgggaggggagagcctgtattccttcccctgcctgctgaatgttaaaaatttccaaggtgcagagttggccttccatattcgtgggttctatagccctggatgcagccaaactaaaagtgaaaatattcagaaagaaaagaatggcctaacctgttctgaacatgggtagactttttcattattccctaaacaatacagtacacccaccatttacatagcactcacgttgtttggggtattgtgagtaaggtagagattgattgattgattgatttcgaggtggagtcttgctctagtcgcccaggctggagtgcagtggcacgatctcagctcactgcaagctccatctcctgggttcatgccattcttctgcctcagcctctgaagtagctgggactacaggcacccgccaccacacctggctaactttttgtatttttactagagatggagtttcaccgcgttagccaggatggtcttgatctcctgacctcgtgatctgcccgcctcggccttccatagtgctgggattacgggtgtgagccaccgtgcctggcctgtggagattttaagtacagcagagggcaccgtgggttctgtgcactcagcactcacattgtttggagtattgcgagtaatgtagagatttaagtacatgggagggcaccatgggttctatgcactcagcactcacattgtttggggtattgcgagtaatgtagagattttaagtacacgggaggtcactgtgggttctgtgcactcagcactcatgttgtttggggtattgcgagtaatgtacagattttaagtacacaggagggcaccatgtgttgtgtgtactcagcactcacgttgtttggggtatttgggagtaatgtagagattttaagtacacgggagggcactgtgggttctgtgcactcagcactcacattgtttggggtattgcgagtaatgtacagattttaagtacacgggagggcaccgtgggttctgtgtagtcagcactcatgtttggggtattaagagtaatgtagggattttaagtacacgggagggcatgcattggttctgtgtactcagcactcatgttgtttggggtattaagagtaatgtagagattttaagtacacgggagggcatgcattggttctgtgtactcagcactcacgttgtttggggtattaagagtaatgtagagatttaagtacatgggagggcaccgtgggttctgtgcactcagcactcaacgttgtttggggtattgagagtaatgtagagattttaagtacacgggagggcaccgtgggttctgtgtactcagcactcaagttgtttggggtgttaagagtaatgtagagatgtaagtacacaggagggcaccgtgggttctatgcactcaacatttcttcaggtattgcgagtaatggagagattttaagtacacgggaaggcaccgtgggttctgtgtactcagcactcactttggggtattgcaagtaatgtagagattttaaggacacgggagggcaccatgggttctgtgtactcagcactcatgttctttggggtattgagagtaatgtagagatttaagtacatggggagggcactgtgggttctgtgtactcagcagtcacattggggtattgcgagtaagagagatttttaagtacacgggagggcacatgtgggttctatgtaaatgctgagccattttctatcagggacttgagcatcacagactttgggatcctgacccctggaacccacccccacggacaccaagggtgactgtacttcagcatgctttatttttttttttttgttcactgagagagtcgctagaagaaacagaattttttccacacaaaccaacattcaaaacctatagtttttagggaggaggaggggaaggatttcaggtttttttcctgccccttcaagctattaataacacattcctcaccttgtagttaatttgtatgtgtggtgagaatacagaagatccattctcttacccagtttcaggcagatgatgcattgttaactgaatttcaggcagatggtacattgttattaactgtagttaccacactgtacattcgatctccagaattgactcattttttcttgaagtgtgtgcccttgaccagcatctccctgtttccccttccccagtccctgctaacccctattccactctgtttctacaaattctacttttttaagatgccacatgtaagtgagatcatgcagtatttgtatttctgtgcctgttttatttcacttagcgtaatatcttccaggtttatccatgtttttgtaagtggcagaatttagttcgttaagttgaatagtatttgttttgtccatacaccatgatttctctgttcatccactgatggatgcgtaggtcaattccacatcgaagtgattgtcaatagtgctgcagtggatgtgagcatgcaggtatctctcccttacactggtttaaattcctttggatatttacccagacatgggattgctggatcatagagtcctgtttctagttttggaagatgctccatgctattttccacagcagctgttctgctttgcactcccaccaacagcgtgcaagggttccctttgctccacatctttgccaacactgcagaatttacgtttctgatccccttggttcccctgacatgggcacaggtggcgtgactgctcactacacctctctctgagctttcctttctcatgctgcatattgactggttgagcagcctcctcattacacctctctctgagctttgctttctcatgctgcatattgactggttgagcagcctcttggattgctttgactcttggtagctttgacttaaaaaggcaactgagcagaaagccgtagctactatgcagctgcttaaatgattctgcagagacttaaagtcagactctgggtgagggagtgtgtgcttctaaaataggaagataatgcttgatgtgttgtggaaagttgaggctctgttggccccggtgctgaggtcactgcgcgcctctgactctggtgtgaacacacagtgaccatggagctctgttgacagagatgtcctcctcctggggtttaggactctggactgcatgcgcttttgtgtttactgaggttagcccacttctttctgctgtcaaagtgattccatctttgatagccttagcagttctcttgtttctccaaaagcactttctgatgaagaagggggtcacatagtgtgtgttcatgaccatcccctgtggcccagcactcgggatagaccactctgccactcacctcggggtggtccagcgtgacttttcagatcctggaagtgacgtggattttgtttattccagttgtcctcctcccccttcagcagggctgtgatattctccctgctggggcatctgaagtgtctcctgtagttggaggtaggacggcggcactgggccaggcggttctgcacgatgactttgttgccaccagtctggcccttggccagatgccttgggcatctcggacttgctgagactgtcatctgtgaaacaaggatgatagtgcttgtggagtgtttaaatgacatagttgtctgtaaagttggcagtaagaccccgactttgtaggtggataatcggcctccatcctttctcctgtccacctgtcctcatgctcatgttccctcccaatccaaagaaaaaactctgagggggtctctccctctgtctgtcgggaagcggagggtggagcgtgagagacttgctctcaagccatgaggcccacggcggccatctgagaagagcccacagcaggcggcgggccatgctgggtattcttctacacgtcagcttctcgatgtccagctggaaataatggaagctgggcttcattgtccctaccttgccccttctcgctccccccaacaccaaaaaatgtaaatacaacatccactgaaaccaacttactgctgaggcctgagatctgcaaaattgagaatcaatgtcatgggaaagggaagtagctgtgtttaatacggcatagtcttctcagagctgtctttctacaggtcgggtttctttcctttttgtgtgaaggagggatttctaactcccaggacacactggagaaattatgcttgcctgaagagtttttagcaagttatgacagcggttttgtgtgaaactggcatgtttaaatcttcccactggccaggatgactgctggggcatctccggggacctcgtgcagagcccccagtcttgccagggactggaagggagggggtgtttcgaggctgcagtaggacaggagtctcctcaaactcacaaagcctctgctccgcgcggcacactgcacacgtgctttgaattttaaaaaattccatcggcattcatatttctaagcccttcagggactgttaatactacattattctcttttaacatcagaagcttattttcaagaccactgcggtggtgtgaacttctgttgatctttcacctgttcttttgatccatgtgttacaaatagaatggattccaaacatgctgtttcctttaatcccctttctaactggagttcttaacgtaccaaagagaagagctacaggggacaatacaaatttaaaaccaaaaaggtaaaactctaagtgaccttgtccacctgcctggcccgagtaagatcttactgcaacagcatgtctaaaatgtgtttctttcctgctcctaccgttaattaaatatttgtgtgcgtgtgtgtgttgtttgagacagggtcttgctctgtcgcccagagtgcggggcgctaggcactaaataacaataaataatgttttttattaagcaaaaagctcaggtgaatgtatgaatcctagtgcaggctttatgtttaccctggcaccttatttaaaagatctttatggaatttaagctgccgatgcttgcactggaaatgtggcaggggcttgtgagaatgagggggtgatgggcacagcaggtgcaggtggagccatggcagagcacgggtggccaaggcggcagggccaggttgggaaggacttggaggccctgtggggagtttggtcacagcccaaacagcagggagaagcctccaacgcagtttggggagagaggctcaccacgtttgcattcttgcagcgacccttctgtctgctgtctggggtatgcctggggcaaggagcctcagccccagagctggagtgtctccgacacgggggcccgcggcgtctggggtccctagatggtggttgacatcagagcagagcaacaactgggttctcaggggtcaggattttgagattcctcttagcccctgttttctggggtcgggattttgagattcctcttgcccctgttttctggggtcgggattttgagattcctcctagcccctgttttctggggtcaggattctgagcttcttcctagcccctggttttctgtggtccatcttctttgcctccctcccctgacggggcgatacctgtggccctgcagggtgcacagcaggtctgtgttcatgagtcctcccatcaacttggacgtctctcatgaattgaatgtgaaatagatactgaatgaatgcttgttgaactttttttaaagattttcttgtgtccttagtgctttgagaccttcacatcctgtgtgtttgatctctccatctgcggcagcaagtagataggtgctatctccaatattttatccatgagaaaaatgcgacccacactagttagctggcccatgggggaccctgctgtgctcagcttgctggggtgagaggacatcccaggtcctcctgcccctgtccccagtgcaggcgaggggtacacacaggagctgtcaccggtctgcagcgcctgctggagaacgaagaagcctatcggagatttaaaaacgaggctgcggccttgccttccggggcctcctggctccttataaagcaataggctcagagcagcagcaccagggctcctgacagccgtagaattcccaacatggaaacgattgctttgttatataaactattaattccagcattaaatagtctcctgacactgcacatggaaaccgccactgccgagtgggtctgtgtgcttggagctgagccacgctgtggaagcagctctgtggcccgtttctttcatcccctagggtcacgcggctcccaagtgtccgtgtcttgagcctgacgttcacagcactggctctgcactggttccagttgggccagattggctggtgcgtgcctgaggccgagaggaagccacaagggccgggtgtctgtctgttctgtcatcttaaccctgcgtttgccaggcagacctttccctgcttttgtaagattgggttttgccctgaaactctggattgcaacataagtgagaaaaagaattgttcccttcagggagggaaagaagcatcatccctcagtctcattcgaccttctgctggtgactttgcctcactggggttttcacttccaaagtaggacttgtgtgtaaatctctcctctttgtgattttaatttctgcttctgaaattttaattcttacggaaagtctctgagaataacataagtggcgtttttttaatgaagtagaaaatgtttctaaagagatcacttatttttctcactgaggttacaattactgcatttacttttctgtcataaagtgaaaaggaaattaaataaatgggtaccttgatgtggaagcaggaaaatatgctgtttggaattttacgtggaaagcgctctggcaggggctcctgtggttcacattctctgacagcagccttgagggtgtgccttagacccagcctcccggagggcctccccggagacgggagttgactttcgaaatagccttggatgacgttcccatcgcttccaggtttggggaaatatgaacaagcaggctgtgagcagtggatacgcctagcgggataacagacacgtgatggccccagcttagaaacgtggggaaggatgtgccctctttcggagcatttgcgcctttagtttacgtagctgcatgctgatgaccacatgccctgatggacgcaaggtgagagggagagaagagaggcaggaattaattgatcattcagcctgaaccaatgtgaaatggaggaagccccaggcaccgtcagagccaccgtgtccctggtgtgaaatggaggaaggctcgggcactgtcagagccaccgtgtccctggtgtgaaatggaggaaggaccaggcaccgtcagagccaccatgtccctggtgtgaaatggaggaagccccgggcactgtcagagccaccgtgtccctagtgtgaaggtggaggaagccccaggcaccgtcagagccaccgtgtccctggtgtgaaatggaggaaggctcgggcactgtcagagccaccgtgtccctggtgtgaaatggaggaaggaccaggcaccgtcagagccaccatgtccctggtgtgaaatggaggaagccccgggcactgtcagagccaccgtgtccctagtgtgaaggtggaggaagccccgggcaccgtcagagccaccgtgtccctagtgtgaagtggaggaagccccgggcaccgtcagagccaccgtgtccctagtgtgaagtggaggaagccccgggcaccgtcagagccaccgtgtccctagtgtgaagtggaggaagccccgggcaccgtcagagccaccgtgtccctagtgtgaaatggaggaagcaccaggctctgtcagagccactgtgtccctagtgtgaaatggaggaagcaccaggcactgtcagagccaccgtctccctagtgacagcgtggcattgattgaaggtcaggccttgggcccaacccaagaagctgttcagggaggatactgtgtagtcagccagctagcttctgcctgtcagtctctcacctcccaccacctgccatctgtccatcatctctgtcgtctgtctatatgcatcatctattatctacctgtcacctatgacctgattgtattcgcacgggaaacattggttcttcaaaataaaggacggcatgtaaaagtgctgctagaaggtttgctcatgtaaacctgcagcgagtctatcatgggaatctggtggacctctgtctaccagatgctgaggcagtccagagttaaaaataactggactttttccatgaaaacgtagcaggagtttgtgagccatgagctttggggcctgagtgagcctggtctcagggccgtggcatccagcgcttcggctttggggtagcatgcacatcaagccgtcgtcttctgcattttgggatagaatcatcgtaagtttcccctttgcccgccccccagtaactgaacaggtaaatgatcaccccgcgtctgcccaggtcttcagcgcactcccagccagtcacttacctgcaggtctctctgcgtcaggcacagacgtctgtgtgtgtggtacatgtggtacacgcaggagcaccctggcttcagtttgtaagacaactgggttggggcacagttctatgggacattgtctggttttaaggataactgtgcatgtgtgttacaaataaaccatgaacagtcatccacgacatcacgcaagctacagcgtgtgatttatgccgtgggtacccagaggcgtcatccatgcagggcaggggctgggagagggcaaagcaggaagtagagtcccgtttccttcggagaagggcacttcccaggcaggttatggagtcaggaggatgtacggggcgtgaacatgcgaggaaagcccaggaagccagggctgcggcctctgggcaccacaccagctttagagtggaagactctaggtgtggttttcatgggacatggttttggagctggacagagttttgtcttagatttgtggtcctgggtgaggaacgtgagtaccatttgtgcctcaaattctcatctgtaaaataagttcttataaggattaaacactttcatctttggggatgggccagcaaaccctcctgtgaagagctgcactgaactgtcttgccttgcagctcggcaaggagcaggccgtgagcacagagcgtgtctccagaagtggcctggaagctgggctcagcctcgagacttagttcccagaccctggtttgggggaaaatgcggggcatggaagttactcagtgctgccaccctttcccacctcctaggttttgagagatgatagtaacctaggatttattaaagtcttgtctggaaattttctttgctgattgactgggggctcgatttaaatcaagcacgtgcacatgtggctgcttctgtggttcagattttggacattgtttgtaaaacgggttaacaaggcatttccaaaagcaactgagcgtctccgtagtgggcagctgatggctgccggtgtggagtgcccggcaagctttaacatttctgcagaaattgtcctttgttgtcagtggccagctacctagttagcatcggctgggcacggtggctcacgcctgtaatctcagcactttgggaggctgaagtggcagatcatgaggtcaggagatggagatcatcctggctaacatggtgaaaccctgtctctactaaaaatacaaaaaattagccgggcgtggtggccagcgcctgtagtctcagctactcgggaggctgaggtaggagaatggtgtgaacccaggaggcggagcttgcagtgagctgagatcacgccactgcactccagcctgggcgacagagagagactgtctcaaaaaaaaaaaaaaaaaaaaaaaaaaaaaacactcattgatgggcggatgcgggttccgtgtcatttggttcttggctccgtgttgagacgtcagccttgtgttccgtgggggagacgagaacctgtatcatgagctgtgagttggtggaggcagccgtggaggcagaggcagcatccgagactgcccgcctttcactaggaaaagtgagttgaccagcttgtgtgtgtaccttgataacttttcattcatttgctatatttttgttaaagcttgaatttttcactcttcttggaattatggtttgatcagtcttagaaaacaatacaacagatccaaaaaaatgaacagcgaatgagtattctgtgtgtgctggagcttgtgaatgggaagggcctctgtgtgtcgatgaggtggctttgtcctgtgtgcttgcgctggctccaggaaaggcatggctgctgcgcgtccgtggctgtctgtgagctttaacatgtggattcttgcctcaccacaagcacctttctcttgtcttctggatttctgcaggtttcacaccttttgcttcttcccttagcctttgtcactcctttttcaaaaacactgtggcggcttcaagtccttgtgaccgacctgcttggttagaaaacatcttgttaatgaagaagatgccaataggtgctggtgtcggccatcccggccctggcagctgcaggatctgtcgttgactgagttaacgagagccccggccaccaggcttggcttcctgtgccagcgggtggggatgagatggcaggggtctaaccctggaccccatccggataaatacagaaggggccagaaacaggcgtgtgtttaacaaatgagttttagtgacttacatgctgtgggcttttgttcgagagcaggggaggaactgaagttgtttgatgtgcagtgcttgcttttaaaattctaacaatgaggcacacagaagatactgtgataactgtgtcttcttgggcaccgttgaatgataatgctctatccacggagaccatactgaacttcattttccttctcttgcaggtgacatcacacaaaaaggatatgaaaagaagaggtcaaagttaattggagcctaccttccgcagcctccgagtaggtaacccccatgagtagcatgagtcctctcatttcccgcattcactatgtgccagagaaacatctggaggcagacgctcccttgcttcccagtcggcaggaggaggcgtctggcgttcaccctccaggcattcagttcctttgagtgatcacacgtgctgtgtgaatatacaaggcacagaggatttttctataagtgtgcctaataggtgttttctctataagtagagatcggtattgggttggttactttaaaatgctataatcgtaaaaatatgagtgcattagtgatttcaacatatttggtttagagagctatttattactattgattctggtttaatccaaggcttctgttggtggcacaggccaaatctagacagtgctgtgataccccgcccaggacttggcaatcgtgaaagctggttgtgtgttgagatgtggttgcaaacatccatgatgattcttgagaagggcagtcggtttcccgccagcgtttctacgtgtgcagattggcagctttcctgcacttgagctgggttctgtaaatgtcaggaaaaagaatctcatattagatggggattctagcacctcagttcccagctggcaagctcaattcagcccaagagcgaccttgaaaatttggtaggcttgaggaatggcttaaagctaacacaagcagtttcttcctcaaacataaaggctagcaacataaattttaaaggtggaaattgaacttgcatagttcttaccattgaaagaagattttagaaggtttaaggatgcacatgtccacacctgcacaaaccccgattctgttcttcccgaggcccgtccgggtcctgttgactcagtaaggaaagtttcctgaggctcaggctgcaggaaacggtgtggagattctgctattggtagttttgttttcatttcgtgtttttcttgccttgatttttgagacagtgatgtaacagtgaacatgtttctgtggaccttgcttagcagaggcttaagtcagggatagacgccgaggaacccgagagaaggggagcagagggctgggctggaatgctggggcgagaggcttcagggcagtgctgggtagatcccctgatggcctgcgccccctccctcattctcttctcgcagagccatggggcgacagctgcccccgccctgtccctgtgagttcccctctgcaggtgccctcatgtgctgcagaaggtggggtctgactgtaggccacggacgctgttggttttaactttcttgccttgccaaacaaaagtgaaacagaagcggttcctcgcttgccaggacggttctccagcgcaccgtgcctcccgcggtggccctggccttagccgggcgcagagggcggtcgtgccctgtggtccccttggtggtctgtgtgctgtcctgcatggggtcggcagctctgctcagcgctgtaacaaatttaaaaaaaactaaagtttgaattaattagttttttttcaacttgttacagcagcgaatggagctgccgtggttcggtgtagactgcagcacagtgaaggagcgccgaggagaacattccgctctgcccacatcggggtgtgcgacgtccgagaagctgcggctcgggagcgggtggccagcaccgcagggaaccggcctctgttttactttcgtttcggtgagcgctgctttgctgagagccagccccacagcagggtacacattagaaaagggccacccgccgagtgccatcccgtacagacgtgtagggtgtggccttgggggcctgagggtcccattctccagtgagccaggtcgctccacaggcccagagctcgccagagaccaggtctgtccctgtgaatcagggcccagttctgcgtttcctattgaagtagaacgttgcttttacaattcccctttctcagttgggcaccacttagaaaacacttaagaagaatgcgtgacaaattataaaacttcttaaagccactggtattctacagactttcatcttatagccaaagacccaattaaaggatgagctgatgggtcttggcctctgagatctgctagaaggagtgattttgagatttccatctccaaagagcaaagtaagggtttttgaaatagaaaaagcagttaatcatagagtatgttcttagaggtaaggattctgttcaaaggtaagaattactttggcggacagtattttgaatacaggaatttcatgatgcaaaaagggagttcagtgcattttccaccagaatgaagaaaatcatatgcaggtggaagttttaggttcgtgttcagggttacacttcaaaatgtgttttaaaatcacatacaaggccgggggtggtggctcacgcctgtgatcccagcacttggggaggctgaggaaggggattgcttaggtccaggtgtttcagaccagcctgggcaacaaagggagtccccgtctctacaaaagaaaaaattaggcatgatggtgggtgcctgtgatcccagctatatgggaggctgaagcaggaggattgcttgaatccaagaagtcaaggctgcagtgagctatgattgtggcactgtgttccagcctgggggacagagcgagaccctgtctcaaaaaaaaaaaattggtaaaatgaagtcatagaggcaaactttattattacagttggccactggggtctcagaagaggacaccccgcctcgcctcctggcctccactgcgttcctcctctctgggccctctcaggagccctctctgggctgattccctcgcaccctctcaggagcaaggggcagagctgatgagaaggcgacagggctgggttttagccacgaggtccatttcagaatttatctgccggaaacgtgaggaaaacaggagaaggacggcccgggccgcctgattgaggcccagacaccagactcaggatggggggactccggacagcggtgctagggccccagcgaggctgtttccctgccgaccttcatttggagacgttgcttgtgacacgcaagtgtgcaccatgtgcagctgtcctgggaagcagcaaggaacgcagacgtttccaaagccgaggctgctttcttggttggccccatgggacgtgacttcctttgtgcaggatcttcgtggaaaacatctttctttcttgttcccctgtgctgctgcgcacttgcctgtaaggggtttgtgttctgattaacttccacccttttttcctaacatttacattcctattcctccagaaactattctaaaagtgtttctaggatgttgtttgggatgcagaattacgagctacaatgggggttctgttccctaggccagccaggcacgtcccagctgctcaggagggcagcgtctgtcggggcctccagtcgggattcagaagtgagcgttggtgctgagcacctgcctaaatctagttgaggaaaagactgtccggagccaggaagaaatgtgagttatacatgcagtgaaagaagggtcagagagggtgcctggaagatcatcttcagggagaagacgctgcttagggaagctgcccacttcgctctcacccttctgcggttcaaacccatccctcatcagtctctaagcccagtcaaagttgtaaacctaggaaataaaatccactgcctggcagcctcttcagagagatcttaataacagtgtcgacttggataacaaggcctcactgcttgtatgacacaggccgtggagatttagagagtaaaatttcagtgtggctataaatggtggaaccttctttgctcagatacagctcctctttctcacagcaacttcttatgtgtttgtctgtgaaatgtttcttggtattgagtgatttatgaagatctggtattcctctccaagcccagcttgcttttccttcaatagccggacagcttgatgcccaggtgcaagttacaaggactctgtaagggggtttgtctgtgcggcacagcctctctccatgaggtcacgtgagcggcctctccagggaagaggtatccgtggtcagtgtgagttaagccccacactttttccatcatggggtcgcgtgagcagcctctccaggaagaggcctcccatggtcagtgtgagttaagctctacactgtctgcaccggaggcctctggcctgcaggcttgcactgtgctgtccaactgttgagtcaaatcacaaatacggacttgtctcagttcctccctgctaccagggctcccgatggccacgccgctgtccctcccgacagccatgccgctgcatccacatgaggaactctgctcaggccgtgcacttggccgtgtccaggtggcatttaaagctcagtttggatgctctgtcctgagggatttctcccctgatccttcagtcagaccatccggattcccatctccatgtcgtcctgtctctgaaataccactgtcatagttgggtggtggttactaaacgctaagtctccaccccaacccccagcagcagtatgtaaatcacctgaggccccggctgcctgctcacggaaagtggacattgggcaggtatttgctgtatggatgtgtgggtgcggcacggaggggctgagtctgcctgtgggggtgggccggggcagccctcacttccccccgccccactgagtgaccgtccctaccgtggtacgaggatggatgtgcagtgtccctgagggcagacgccaccgtgtccgcatgatgctcagatccacgtgaagccctgaacaggcaccggagaccttccactgcctcaggtgtctatctgggctgcagttttatttttattcttgatttgggtaaatttaaatggcagatggtaacatgtaagggctaattaatgactgaaatgacagagggtaacatgtacctcagcaccatccaatcagtggaattttattatcttttcagaacttggctcccatcccagtgtttgatcctgtgactggatcacatgttctcatgagaacagctgctctggcctgagtgctgttgcttgcagtggctgccttgccctgtcgccacggagagggcttcctctgaggtcccgttgcagattctcccactgggctttgacagttgtgagggaggaggtccctgcagttggcatttgtgaattttgcactttggttacatacggaatgagaaagtttcttaagtacgtaaatgccattttgttctgtcgtctttagaagacgtggctggctggccctggcctgttcacctgggctggccgttggttgttctgattcctcgtgtcagcagaggctgtgctttcccggggcaggtgcgcagtgggtccgtattcttgttgtgccatgagagttacagtctggtgaccccaaggcagcgcttcctagacgtgctggggagggaccgcctcctcacctgggctggagggtcccggggacctgtcccgggcaggttgcctccacttagggtctcaggccatgtggcagctcacagggtaagggtgttttaaacttaaatcccagaggaggggaaacgtgggtgtccagatggcattgcctgtgacatagcgtgaatctttctagaccgcgttgctgtagtgacaggtgaatcacctgtgttccagatcagccgtgctcccgtcggcacttcacagggtaccacgcttagctgccggagacgtgttctgccacagggagctgtcagtttgatcccgtacgtttatttcctggtcttttcagcaacatttaatgaatcgcattcctcgtcttaggcgccagccgctatggagggagtgcagctgagcctacgccatgcggtgtgtctccagtggggagggtagcacccactttggaactgctcacgtgggttttgtgaaaaatccgaggtgtaagcaaagtgcagaaacgtgaaggcccggtcctgatggtgagattggcatctcatccaaggagcgtggactggagctcgggctggtagatgagaccgtcatccagtgagcatggaccagggctcaggctggcgggtgagactcatccagtgagcgtggactggggctcaggctggtggatgagtcttatccagtgagcatggaccggagctcaggctggtggatgagaccctcatccagtgagcatggaccggagctcaggctggtggatgagtcttatccagtgagcatggaccccggagctcaggctggtggatgagaccctcatccagtgagcatggaccggagctcaggctggtggatgagaccctcatccagtgagcatggaccggggctcaggctggcgggtgagactcatccagtgagtatggaccggggctcaggctggcgggtgagactcatccagtgagcgtggaccggagctcaggctggcggatgacactcatccagtgagcgtgaaccgggtctcaggctgccggatgagaaccctcatccagtgagcgtcgactggagctcaggctggcgggtgagactcatccagtgagcatggaccggggctcaggctggcgggtgagactcatccagtgagcatggaccggagctcaggctggcggatgacactcatccagtgagcgtgaaccggctctcaggctgccggatgagaaccctcatccagtgagcgtcgactggagctcaggctggcggatgagatgcagacgtcagactctcccgtccctggatcactgacaatttccagtgtatgagtccctaatcaagttaaaacattataataggaaaagggttgctaagcaaatatatactgatgtgtggcaaagatttgggctcatgaaagatggatagaaaggaggacagtgtggggacgggcgcattggctcatgcctataattccagcactttgggaggctgaggcggacaaatcatgaggtcaagagttcaagatcagcctggctaacatgttgaaaccccatctctactaaaaaatattaaaaattagccaggcatcgtgatgggtgcctgtaattccagctcctcgggacgctgaggtagaagaatcacttgaacctgggaggcagatgttgcagtgagtggagattgcgccattgctctccagcctggcaacagaacaagactccatcttaaaaaaaaaaaaaaaaaaaaaaaagcagtgtgagaattcatggggttagggcaggtgcttagaatggaatttcagtcttaccattgtatgatgttcccatcccagtgaatacaaggaaaattattaaatttcttaccagtgtttacaacagttgtcctgtttgctttctggcaaagtccttgattgcacttattttagaaagttttacgatgtgaacaagagcatgtaattgagacctggagagaatgggactggatttagaaactgctctgggacagacctgaaaatacagaaaaatccccggcagtttcactaagggcccagagcaggcttctcctgcaggacactcctgtggaggcctctgtggagcccagagcgcttgcccctgggtgctggggaaggagggcaggagagcctcttggccctcctctcctcctccctccctacccctctcttcctccccctatcttctctgggagctaaggtgagccatagagacgttgctatctgcacccccagcacgcccggacacgcgatgagtgagaataagatgggaatttggatgtatctgcacgcctggacacgcgatgagtgagaataagacgggaatttggatgtgtctacacccccagcacgcccggacacgagatgagtgagaataagacgggaacttggatgtgtctacacccctagcatgcccagacacgggatgagttgagaataagatgggaatttggatgtgtctgcagccccagcacgcccggacacgggatgagtgggaataagacaggaatttggatgtgtctacacccccagcatgcctggacactggatgagtgagaataagatgggaatttgggtgcatctgcacccccggcatgcccggacatgagatgagtgagaaaaagatgggaattggggtgtgtctgtacccccagcatgccctccccgtctgcccctcccctccccccctcccctcccctcccttcttctcccctcccctcccctcccttcttctcccctcccctcccttcttctcccctcccctcccctcccttcttctcccctcccctcccctcccttcccttcttctcccctcccctcccctcccttcccttcttctcccctcccctcccctctcctcccttcttctcccctcccttcttctcccctcccctcccctcccctcccttcttctcccctcccctcccctcttctcccctcccctcccttcttctcccctcccctcccttcttctcccctcccctcccctcccctcccttcttttcccctcccctcccttcccctctctccttttcccctcccctcccctcccctcccctcttttttcctcttctatcttctcttctactttctgttcccttccttctcttttctttccttcttttccttccttctttccctctcttttcctgtcttttctttccctctcttttccttttcttctctctcgttttcttctctctgcttccttcacttctccttttttctttctcccttctccttctctcttgttttccttctctttccttccttcccttctttctctctccttcttttcctttttcttctctctccttttctttctcgttctttctttccttctctttcttctctctcctttattctttccttttctccgctttcctcctatctattcaccacttcctgttcatctatttttcttctcttcctcccacccatccaccttcctcccacccatccaccttcctccctccccatctcccacctatgcaccttccacccatctaccttcctttcccccttcctcccctcatatctcccacccatccaccttcctccccacctcccacctcccacccatccaccttcctccccacctcccacctcccacccatccaccttcctccccctgcctccccccatccaccttcctccccatccaccttcctccccatccaccttcctccccatccaccttcctccccatccaccttcctcccctccctcccctccctccccctccctctcctctctcctatccatccaccttcctcccgtctcttccttcccttccttctctacctcctatccatccattcttttctccattcgttcctccattcttcctgtgtgtgtttccatccatttgtctattctttgctgactttgctaagcctgtttctttgaccttttccttcttcctgtgctggcctcactgccttcttttccttctgtgtaccttgtatctcctgctgtctgtgctcaagttttatttgtggtcttgctgtaattctagaggaaagtaaaaatgtcactgacgtttggatttaaatggaaatgttccagccctctgtgggagccctgagggttcagaattatttcccgagcccatcctgtggccagctccaccgagagcaaggtcacctcctgcctgcttctccaggatcccaacagatgcccctttcgggcgaccttgatagcttttccttgctccaagattcattcttggatctgaaattttagcagtttccgtgttttcttaattttcataatgggattccaaaaatgcttcttcctgttttcaaaacaagccagattttgttcttgtaacagagattgaggctctggacaccactgcaggtaccaggagaatgacagcctctgctctcaggagagggtgtggaggggcctgggagaggggcccccattgcaaatgaaaaggcagtcacgggagaatgttcagacaccgcacaagggtgacaccgggccgctcgcactcatggatcacttctgcacctgcatttccttgtcaagaaaacagcagaagtaatagtcctggcttggtgctttttgtgctgaggaatgagtgacgcatcaaatgcttaggccagggctgcagtgttagctactgctgcttctgtccagaggcaggaggctgagcctaggaaagttcacaaacttgcctaggatcccacagaatgacaggagccagacggattggggccacgaccgcaggcatgggatctcccgtccccggaggaccggatctgagctggtgcctcacgtggccaatgcatgatagctgagcaggtgctcctgggaggagaacctcatctccatctcggccgttttcttgcctcaagagaccttgctctttgttctccagactcttgagtgtgtgaaggcagccaccccatctccctggggatacctccttcccagggaccatgccggcctctctcccctgaccacgccttctgtcataaggcttctagtcttcctgtgatgctcctgagagctggttttcaatcacagttccccaaactgaacgtgactgtgaacgtgagccctcagcagcgcagagcggtatgctgcagtcatgcgtcttagtgattgttcatgtttgtgctacccagaggtatctgttccagcagccatgcttggtttccctgtgacggggacagtgggtatgcccctctgctgcccctgggccctgtgcggtcacaggctggaatccagttgagcgacgcctatttgtggcttttttcttccaggaacatatcgttaagccacttgcagcctcgtttggaatgacatcaaaggaaaatgaatgaaggaaacatgtacattcatactcgtttcttttgccgtcttattgcaacctgtagaagctagttcttctattttattcatttgttttcagacttttgttgcaaactttacatttccacttaggagatattcacgaggatggtatgcaaaagtagctttctgagatcagacatgtaaggtctgtgagaagccgagcagcagcctggaactccgtgcaccatcgtccatgggcaccaagaggaggttagggttggaggtaatcacaggaagcctgtttgagtggaccagataggtgtggtactgagattgaaggtgaaacattaaaaacgtcaggccactggatacgcttggcaacttggaagtgtgcctttatctgtttctcccaactgtgctgtcagtgactatataagtccacagcacaagagaagttagagaaatttgtggttcatcatttagcaaaatggagaaagccaagatgcagacacggcggacagccatgggtgctgtacacatggagcccagagaacggtgtccaggaagcaggcggccgcttttcctcctcctcccagccatgtgtgttatctggagaaattaaactgggaggctccagatttggggatgatactgacaacagaggctccaggttagagggtgaacatgcctgtgttggaaacaggagaggagagggctcttcgggcaaacgaaacagccccgttgaagccttccttggggagagatttggtggtgtgcccccgtgagaagaaaaacctgatttgcagcaaaaagattatcgagggagaaaagaaaggaatggatattacaacctggcttgcagctcctccagtgggaatgaataaaagattattgaaggagaagagaaaggaatgggtattacataaggattatagcatcagagtgaagtttaacttctcaccaataatggaaatgaaaggcaatgaataaaagtaattttcacccagaagtccgtatctaggcgaaagactcggtctcactggggtagaaagagaagcactttcggatgtgtggggcccccaagtgttccttctggttcttcctttctgaaacattcaaggtgctcctttagcacgggagtgtggagagacgagggggcattgaagagcatgagaacaagtgaccaacacagcagccacagccagcgggaagaaaggcgtggcccagtgacggtagcacgtttgggactggggcgggggctccaagaggacttccaggaaaattgaacagattctcaccaggttgtcagtgtttgatcgtgggcaggaaggtatgggaaagagtttttcagttctgctggagaattgtgaaaggattggcaataggtacattgtaagccaagatagtggaaaatagataaaatattaactccagaatcattgaaaagcgtaagatagaacggtatttgtagcacactgcggacgctgatgttgatgaccacagtggcgtaaggggtggtgtctaaaaaggacaattcaggaagtcatgtggtaagtccatgtttatgaatgtaagtgccaggtagctactgtttttcatgtgagacttgataatactctttgatttcctaaaatgcatctgtttgataaaaaggtaattgaagatcatttttaaaagatcagttgtagatgatgactggaagaggttggagcagcagacagttcagtcctcaggaactgatggtgatttggatgccctgaaagaaaagcacatgaaacttagcaaaatgacggtgtaggagccatgcttaacttagttctgaattcgccagcctgatacatgagacccacacacgcaccatcaaaagctgatgttcagaaaccaccagagtaaggaatatgaagtccacagactctacaactctcataagagcccatcatggaaaaccagggactaaatatttcttttgttaacttaaaacttttatttctggtttactttcaatcagatattactgatccatttctgaagaagcatctattagtgattggtgctcactcttagagcagttcttcatggaactgtggggacgacgtaggatgacgtccttcctgtggtatcagagccgttcacggagctgtggggacggcgtaggatgacgtcctttctgtggtatcagagccgttcacagaactgtggggatgacataggatgacgtccttcctgtggtatcagagccgttcacggagctgtgggggtgacgtcctttctgtgatatcagagccgttcacagaactgtggggatgacataggatgacgtcctttctgtggtatcagagccgttcacggaactgtggggatgacataggatgatgtcctttctgtggtatcagagctgttcatggaactgtggggtgatattgttcccgtggtgtcagagtagttcttcgtggaactgtgatgatgatgtccttcctttgggggcttagttttgtctagttgtgttccttgccaccctgttattgcctgaatgtaatcaatatgtgacaggtggattcacatcaatgttttgaccaataccattaaaccgtttttatctgaccgcattaatgttttttgttattcaccaagtaattgtgattcatagtcgaacataatctgttaaaacacttggcatccaatggagtaagtttccagagagtaatctggaatgagcaaagctggacgttcatggtatgtcctggttacctgaattatattgttaaattattatctaagatttattttaacaattactttaataacaaatatacttttaaattttcttaagagcttatacagctcattctgtatatttattacattaaaaggtcataacttgagtctatgtcttgggccctgttgctctaatcctgactcccaggaattcagttgccacctgtggctgagtttgtgtctctccctgcctgtcagtggacctttgtgctgtgaaagggaccgtggcggcgtctagccaggaggggtctccctggcggtgggagagcttcctcctcagtcctggccctcctgtctgtgggctctgaggcgccgccatgcccagtcccgtgggtagctctggctttgctgtggggatggagggcatgatttgttagagtctgctgactccgctgagtacagtcacacctcactctgctgtttttattgaaatccaggggtggaccaagctttgccgcaagaacgccgggctcctgtcactccttcctccgcctctcgctaccaccgccgacggtcttcagggtcacgagatgagcgctatcggtcaggtaagcacggggtggggtgatacaatacgtccatctgccacctgtgccaggacggtgcctgtgcccagccactgggcgaggcagaagtgcagtgggcgtggacctgcagcacgcgaggggcctccagctttctgcacggacacaccctctcgggagacgccagtgtccggtaaatagctcttcacgtggtttacaagcccatgttggctactattcagaattgcatattaattaaaaagattataatctcgtgccaaatttttcttttttaggtgtcactgttaaataactttttaatcgtggttgctagtatagttttttctttttcttaccatcagtgatttgttttctaggtctacttttctaaacagaaatgaaaaccatacattgttatgtgtttcctgtctttcatctgtgttttatgatgccgtctgcacagggttgtctggagactgagttgccagtgccacctgggcttggccagctgaaatttcattaatttagcaacagaaaacttaggctgtcgggcgtggtggtgggcacctgtagtcctagctactcatcaggctgaggcaggagaaatgcttgaacctgggaggcggaggttgcagtgagccgagatcacgccactgcactccagcctgggcaacagagcaaaactccatctcaaaaacaacaacaacaaaaactcaggctgtgattaatgtttgaattattctgagagagtttttccaacatgtaggttaaagttgcttctttaaaagaaaattacctgtgaattcttttgtagttcccagggcaccggtgagggtaggggcgatcgctggtgatggacccgattcgtgaatccctttgttttgcaaatgcccttcactggcatcctcacattgttctcacatggagctttcatgataagcaggtgaagtcgtgactgttgtcttctgtgtcagaagaaaaaagtgaggctaagggatgacggaactcacctggtgttcgaggaaagcctgtgagtctcggaactcacctggtggtcgaggaagcctgtgagtgtcagtcgtgctgtaatgaatctctctgtccatgcaggctcatgtgattagctgcttctgcatcctcagttgccgtctgcctggcctcctggctctgctcctctttctggagaggagattttatggcctcagagagtgtcacccatgcaaaagaggacacacctgagagcctgaatgaaaagctggtgccacctcctgggcgcccctgctgccttctccaaggaggctgtgacccaggaaaatgtgtgcggatggaatgaaggagaatttgttcccaaatccaccctctgttgtttcacacctgtcttaagccccgacacatattgagaccttctcttactcatgtgggtgtctcggaggcccctgtcgagttcaggagtgtggaggcacctgcgtactgtcagcctgtgaccaacgcttccctcactgtgtgtcagtgctgccatgcagacaccctgtctgtgaacacacaacacacccagacatgcacgcaggctgagttcacatggcttcagttctcacagaggccagtgggggtctatcttccattttatagatgaggaaactgaagttcagggaggctgtccaatggctgacgatcacacggggtcgctcctcgcaggaggatgcaagcccatctttggccggccatcttaccacacaggagatccgcgtcagtcgccactgcgtgtttcctacattctctctctctccacgatgctgcaggggtgttgataaaccctgtgtttaccttcggatcatgccatcttcacaatcccagctactccacgagataagcatggcgggttgtggttgtctcacggtcttctctcttgataaaagcctgagagaggtgggtgtagtaggagatggttatctcttggcttggggtgcgttttctgttcatccgtgcaccttacctcacctcttcaaaggcaggaaggtgtggaagagagaggcacatggcagagggggtggctgagagtggcaggatgggtggaggagaccgacacttcagctcagagtctgcaggctctgctctggaggggaagctagacccaacgtgagaagcacggttcatttctcctgtttttgtaaaattgtgaaatatggcgcctcttcacacacaatctctcccgttccccatcctgactcatgtctccatcgccattataaccacatgatactctgtctatctgcatgtctgtgtattcgttatttacctacctgtcaatcatccatccatttatcaacctctctgcatctgtctacatattcgccaatcatctacttacctatcaagcatccatttacgtccaccatccgtccatctatcaaacatttcatccatttaccccactactcagccattcttccaccatccacctccccacctctcactttcttccataagaatacgaggtccacacaggccaggatctctgttctgttcattcgtgtaggccaagcacctgaaatactgcctggcttctatattttgaaggaagatgagggagtgtgacacatttggggaacggcaagaagttaggtaggagcggctgggttatagcatcttgtgcatcacgctcgggaatttggacttgatcctgaagatgatgggatccactagaatattttaggtgaagggacagtgggggccagtcagggtttgaagatcactttagcagcagcatggagcatgggctgaaagtgggggagtccaaacaaccctgaatgcctgaaactgatgtgtacttaagagatatctgtcagggctgggtgctgtggctcatgcctgtagtcccagcactttgggaggccgaggcgggcagatcacttgagttcaggagttcaagaccagtgtggccaacatggcgaaaccccatctctatgaaaaatacaaaaattagccaggcatggtggtgcatgcctgtaatcccagctattccagaggctgaggtgggagaatctcttgaacccgggaggtggaggttgccgtgacctgagatcataccactgcactccagcctcggcgacagagtgagactgtgtctcaaaaaaaaaaaaaaaaaaatcagtaccagtgagatttgagaaatgctcaaaagataatagcaataggacctgaaggttgggttaatatggaggaacatgagaggaaatcagggtgaccttgatgtcctagttatgcacctgcacagaggatagtctccgattctgcacccagagtgactccgagatgtccagcttatgcacctgcacagataatggtctccaattctgctcccagggtgaatccgagatgtcctagttatgcacctgcacagatgatggtctccaattctgcacccagggtgacaccaaggtgtcagctcatgcacctgcacagatgatggtctccaattccacagctccttctctttagggaatcaagcttactgtgtataggttacaggtggtagaatttgccttactgtgtagaagatactatgaacgattaggaagacagtccttgaagtgtcatttatttgagatataatggaaagcactattactccatggatgccgttgtagtttttaaaagttgggtactcatctttttttgtttgtttttgagatggagtttcactcttgttgcccaggctggagtgcaatggtgtgatctctgtggtgtgacacaggtcacgccacaaactctgcctcgtgggttcaagcgattctcctgcctcggcctctcaagtagctgggattacaggcatgcgccaccatgccttgctaattttgtatttttagtagaaacagggtttctccatgttggtcaggctggtctagaactcccgacctcaagtgatccacctgccttggcctcccaacgtgctgggattacaggtgtgagccactgcacctggtctcatctttgttttaatcaataatgactgattggcatatggagcgcaccccatgacctttgcattgcctgtgaagtctcaggtggggttctcattttctgtagccaacacagagcaactcccctttatgtgtcatggcagccacccttcaggaaagcaggaggggcatggggtcattactgggtttccttattctttgctgtttcttgctgttacaggaatctagttgtgagttctctaaatttagatatactataatttacttagagtatatgctcacgtggttttaacaataaggtgtgagataagaggagcttatgttagtttattaccaatagacagatttcacaattttctgtctgcttttttctttctcctgaaccgaccgcgaagactggaatcattcacaaggaaagggctgtggcttctagggagacttggcagctcgaggtctgtgaccactcatcttgcagtagagctactgtggttgccccagggactgaattttttaatttatatatattttttattatactttaagttctggagtacatgtgcagaacatgcaggtttgttacatacgtatacatgtgccatggtgctttgctgcacccatcaacccatcacctacattaggtatttctcctaatgctatccctcctgtagtcctccagcacccaacaggccctagtgtgtgatgttcccctccctgtgtccatgtgttctcattgttcaactcccatttatgagtgagaacaagtggtgtttagttttctgttctggtgttagttgactgagaatgatggcttccagcttcatccatgtccctgcaaaggacatgaatttacccgttttttatggctgcatactattccatggtatatatatgccacattttcttttttttttttttttacacttaaataatttttattttatttattttttttttatactttaagttttagggtacatgtgcacattgtgcaggttagttacatatgtatacatatgccatgctggtgcgctgcacccactaactcgtcatctagcattaggtatatctcccaatgctatccctcccacctccccccaccccaccacagtccccagagtgtgatattccccttcctgtgtccatgtgatctcattgttcaattcccacctatgagtgagaatatgtggtgtttggtttttcgtttttgcgatagtttactgagaatgatggtgtccaatttcatccatgtccctacaaaggacatgaactcatcattttatggctgcatagtattccatggtgtatatgtgccacattttcttaatccagtctatcattgttggacatttgggttggttctaagtctttgctattgtgagtaatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgttgtttcctgactttttaatgattgccattctaactggtgtgcgatgatatctcatagtggttttgatttgcatttctctgacggccagtgatgatgagcattttttcatgtgttttttggctgcataaatgtcttttgagaagtgtctgttcatgtcctttgcccactttttgatggggttgtttttttcttgtaaatttgtttgagttcattgtagattctggatattagccctttgtcagatgagtaggttgtgaaaattttctcccatgttataggttgcttgttcactctgatggtagtttcttttgctgtgcagaagctctttagtttaatcagatcccatttgtcaattttgtcttttgttgccattgcttttggtgttttggacatgaagtccttgcccacgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcattatttctgcaggctctgttctgttccattgatctatatctctgttttggtaccagtaccatgctgttttggttactgtagctttgtagtaaagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatgtcattgaatctgtaaatcaccttgggcagtatggccattttcacgatattgattcttcctacccaagagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgctgttggtgtataagaatgcttgtgatttttgtacattgattttgtatcctgagactttgctgaagttgcttatcagcttaaggagattttgggctgagacaatggggttttctagataaacaatcatgttgtctgcaaacagggacaatttgacttcctcttttcctaattgaataccctttgtttccttctcctgcctgattgccctggccagaacttccaacactatgttgaataggagtggtgagagagggcatccctgtgtcgtgccagttttcaaagggaatgcttccagtttatgcccattcagtatgatattggctgtgggtttgtcatagatagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttattgatttgagtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttgagaaggaatggtaccagttcctccttgtacctctggtagaattcggctgtgaatccatctggtcctggactctttttggttggtaaactattgattattgccacaatttcagatcctgttattggtctattcagagattcaacttcttcctggtttagtcttgggagagagtatgtgtcgaggaatgtatccatttcttctagattttctagtttagccacattttctttatccagtctatcattgatgggcatttgggttggatccgagtttttgctattgtgaacagtgctgcaataaacatacgtttgtatgtgtctttatagtatcatgatttataatcctttgggtgtatacccagtaatgggattgcttgatcaaatggtatttctggttctagatccttgaggaatcaccacactcttccacaatggttgaactaatttacacttccctcagtggtgtttcttcacatcctctccagcatctgttgttgcctgactttttaatgataaccattctaactggcgtggaatggtatctcattgtggttttgatttgcatttttctaatgaccagtgatgatgagcttttttttttttctaagtttgttggccacataaatgtcttcttttgagaagtgtctgttcataacctttgtccacttcttgatggggttgttttttcttgtaaatttgtttaagttctttgtagatgctggatattagccctttgtcagatggatggattgcaaaaattttctcccattctgtaggttgcctgttcactctgatggtagtttattttgctgtgcagaagcactttagtttaattagatgccatttgtcaattttggcttttgttgctattgcttttggtgttttagtattgaagtctttggccatgtctatgtactgaatggttttgcctaggttttcttgtagagtttttatggttttacgtcttacgtttaagtttttaaaccaatttgagttaatttttgtataaggtgtacagaaggggtccagtttcagttttctgcttatggctagcctgtttccccaacaccatttattaaatagggaataatttccccattgcttgctttttgtcaggtttgtcaaagatcagatggttgtagatgtgtggtgttcttttctgaggcctctgttctgttcccttggtctatatctctattttggtaccagtaccatgctgttttggttactgtagccttgtctatagtttgaagtcaggtagtgtgatgcctccagctttgttctttttgcttaggattgtcttggctatgtgggctctgttttttggttccatatgaaatttaaagtagttttttccaattctgtgaagaaagtcaatggtagctcgatggggatagcattgaatttataaattactttgggcaatatggccattttcatgatattcttcctatccatgagcatggaatgattttccatttgtttgtgtcttctcttctttccttgagcagtggtttatagttctccttgaagaggtccttcacatcccttgtaagttgtattcctaggtattttattctctttgtagcaattgtgaatgggagttcatgatttggccccctgttggtctattattggggtataagaatgcttgtgatttttgcacattgattttgtatcctgagactttgctgaagttgcttatcagcttaaggagattttgggctgagatgatggggttttctaaataacaatcatgtcatctgtaaacagaaacaatttgactttctctcttcctatttgaataccctttctttctttctcttgcctgattgtggctagaacttccaatactatgttgagagagggcatccttgtcttgtgccagttttcaaagtaatgcttccagtttttgcccattcagtatgatattggctgttggtttgtcataaatagctcttattattttgagatgtgttccatcaatatctagtttattgagagtttttagcatgaagggatgctgaattttatcaaaggccttttctgcatctattgggataatcatgtggtttttgtcattagttctgttgatgtgatggattacatttattgatttgcatatattgaaccagccttgcatcccagggatgaagcctatttgatcatggtggatcggctttctgctggattcagtttgccagcattttattgaggattttcacattgatgttcatcagggatatcggcctgacattttctttttttgttgtgtgtctgccaggttttggtatcaggatgatggtggcctcataaaatgagttagggaggagcccctcttttctattgttttggaatagtttcagaaggaatgctaccagctcctctttgtacctctggtaagagttggctgtgaattcgtctggtcctggactttttttggttggtaggctattaattcctgcctcaatttcagaacttgttattggtctattcagggattcagcttctacctggtttagtcttgagagggtgtatgtgtcctggaatttatccatttcttctagattttctagtttatttgcatagagatgtttacagtattctctggtagtttgtatttctgtgggatcagtggtgatatcccctttatcatttcttattgtgtctatttgattcttctctcttttcttctttgtctggctagtggtctatctattttgttgatcttttccaaaaaccagctcctggattcattgatttttttgaagagtttttcgtgtctctgtctccttcatttctgctctgatcttagttatttcttgtcttctgctagcttttgaatttgtttgctctttcttctctagttcttttaattatgatgttagggtatcgattttagatctttcctgctttttcttgtgggcatttagtgctataaatttccctctacacacctctttatctgtgtcccagagattctggtacattgtcttttgttctcattggtttcaaagaacttatttatttctgccttaatttcattatttacccagtagtcattcaggagcaggttgttcagtttccatgtatttgtgcagttttgagtgagtttcttaactgtgagttctaatttgattgcactgtagtctgagagactgtttgttatgatttccatccttttgcatttgttgagtgttttacttccaattatgtggtcagttttagaataggtgcaatttggtgctgagaagaaggtatatcctattgatttggggtggagagttttgtagatgtctattaggtccgcttggcccagagctgagttcaagtcctgaatatccttgttaattttctgtctcaatctgtctaatactgacgttggggtgttaaagcctcccactgttactgtgtgggagtctaagtctcttggtaggtatctaagaacttgctttatgaatctgggtgctcctgtattgggtatgtatatatttaggatagttggcccttcttgttgtattgatccctttgccattgtgtaatgcccttctttgtcttttttgatctttgttggtttaaagtatgttttatcagagaccaggattgcaactcatgctttttttgctttgtaaatattcctccatcctttattttgagcctatgtgtgtctttgcacatgagataggtctcctgaatacagcacaccaacgggtcttgactctatccagtttgccagtctgtgtcttttaatgggggcatttagcccatttacatttaaggttaatattgttatgtgtgaattcgatcctgtcattatgatgctagctggttattttgcccattagttgatgcagtttcttcacagtgtcagtggtctttacaatttgttatgtttttgcagtggctggtaccagtttttcgtctccatatttagtgcttccttcaggagctcttgtaaggcagacctggtggtgacagaatctctcagcatctgcttgtctgtaaatgattatatttctccttcacttacaaagcttagtttggctggataggaaattctgggttgaaaattctttaagaatgttgaatattggcccccactctcttctggcatgtcgggtttctgcagagagatccgctgttagtctgatgagcttccctttgtgggtaaccctacctttctctctggctgcccttaacattttttccttcattttaatcttggtgaatctgacaattatgtgtcttggggttgcttttctcaaggagtatcttcgtgatattctctgtatttctcaatttgaatgtgggcctgtcttggttggttggggaagttctcctggataatatcctgaagagtgttttccaacttgttccattctccccatcaatgactgaattttagcagcccagaaataattttgttattgcttacataattgacctagttaataattaatctactcagccatttaacctctactggatgtattttctcatttcatttctaaacccatgaccttactttgtaatgaattcttatgaaagctcttcatcatagtacatatcttctctttataaatagctttcttttggaacttgagcttgatttgggaagtaagtgaatgagctggcatttattgagcacctagaatgtattggagtcgattttaagcacttcattacctttacttgataaactctcagttagagcttagattctagctttagttatcacctttttttccccaaccaacaactctggaaaagaaaacctggagacttgtgttgtgcccattccacccaagactgggagaggaagatcctagagctcatgtgcagcatgccgttccctgatgtgactgtgagaggaagatcctagagcccacgtgcagcacgcgatcccttgatgtgactgtgggaggaagatactagagctcatgtgcagcacgcggttccctgatgtggctgtgggaagatactagagctcacgtgcagcaggtggttccctgatgtgactgtgggaaggtcctagagctcacgtgcagcaggtggttggttccctgatgtgactgggaaggtcctagagctcacgtgcagcaggtggttccctgatgtgactgtgagaggaagatcctagagcctacgtgcagcacgcagttccctgatgtggctgtgggaaggtcctagagctcacgtgcagcaggtggttccctgatgtgactgggaggaagatcccagagcccacgtgcagcacgccgttccctgatgtgattgtgggaagatcctagagcccacgtgcagcacgccgttccctgatgtgactgggaggaagaccctagagcccagatgaaggacactgttccctgatgtggctgtggaagatcctagagcccacgtgcagcatgtggttccctgatgtgactgagaggaagatactagaacccatgtgcagcaggccattctgtgatgtgggtggagctactgctgtgtcttttgatgaactaagaacttccatgtgtgagcatgcatggcttgggctgccctctcagggatcagcatctgacttcagccttgcccctcctttgcagtagaatgtcccggtcccgtgtcctctgggacagcaagcttccaacagagcccagggaccctcaggggttcgagaccctcccagggatgtctgcagtgttgtgctttccagaatgacacggccatgtctcctgttgactctttgtctcctgagtgcacagtgggtttttccaaggctggctgtctgtttgggggtgggggagggttctgagagccagtggattctgtgactgtgacatcttgttttttaaaaagttttgatttactttctaatgccacaaatatcaaaatattagccccactggcaaaagctttttaaggttttcaacagtctttaaagtgctctttgggtcaaagagtttgagaactattgttagatttttaaagcttttttttttttttttttgaaaaagttgagaggtaaactggaaacttgtgcttctgaacccatccttgaggcggattttatgctgaggatagtttagtgtcagttttggaaatagacttgtgttctagtattctttcagcaaatgtgcaggtgattctgggttccgagcactctgctgtgccctgccggtgagtcaggaatgtagagggcatcctccttgccgtcacggggtgccgagcactctgccatgtgctgccggtgaggcaggaatgtagaggatatcctccttgctgtcatgggttccgagcactctgccatgcgctgctggtgaggcaggaatgtagaggacatcctccttgctgtcacggggttccgagcactctgctgtgtgctgccagtgaggcaggaatgtagaggacatcctccttgccgtcacgggttctgagcactccgtcacacgctgccggtgacgcaggaatgtagagggcatccttgccgtcacaggttccaagcactctgtcacgcgctgccggtgaggcaggaatgtagagggcatcctccttgctgtcacggggtcatctgccatcatgggggtcaccgtataagttcctcctctatgccgaagtttaattttctagactgagaaggtttatctttcctgagtcagtctggatttactgattttgatgaggttcctgtcctgtgacctgtgttctctctgaacaactcaattttctcattgattccaatacacatagtgttacttccttatttacatcagaatgatgctaggagagaaggcggcctacagtgcggccaagtaggactgtgtagccactgtgatgtccccagaggaggtgacaggctctgtctggtgggagctgccctgtccagtatgagggcagtagccttgtggggccttttacatttaaatgtgttaagatgatatataaaatcatcctcctgcttcatcactgcactttcgggcgggtggctgggcggctctcatgctggatggtgtgggtgggactgttgccagacctgcagacagtccccatcacgtgctgctctggggccgcagctgtgggaggagaggccacaggcacagctgaggacgcagcataaagatgtcccacactacagaaagtgacttttggccaggtgcagtggctcacgcctgtaatgccagcactttgggaggccgaggtggaggagagcttgaagacaggagttcgagaccagcctgggtgacaaagtcagagcccatctctacaaacgatgaaagactagccgggtgtggtggccacacacctgtggtcccagctacccagggggctgaggtggaaggatcacttcaacctaggagctggaggctgcagtgagctgttgtcacatcactgcaccccactctgggtgacagagtgagaccctgcctctaaaaagaaaaaaaagaatttaatcttgctatctgtgcctcgtcatttctaaagagggaattttggacatatcaatgtagcagaaatatataggatagattggtttcattggattgggttcctgactgaaggcagaaacaggttagggggctgttgtatttcaggtgaaaaatgatgaatcaaaatttgtgagatgctgtggaaatggtacttgaatttatagactaaaatctttatattaagtcagaagacatcttggaaactgaagaaataagcatttatcttaacatgttagaaaaaattaagtccacagaagggagaagtgagacaataataaaaagaataaaataaaataggagatgcatagacttgtagcttccagtccagcacctaaggagcttggaagtcatcacgcttgtcctcttgagcaaaaagctgtacaaaccgaaaataagcaactcctcctagatctgtcaaagaattgagattataacctcaaaccattgtgccgtaattggaggtggatatgtgagcagagagatggaaaatctaggaatcaaaaggcaatgctagaaataaacactgtaagagaaatgaagtatgtttttgctgggcccatcaatagcctggacatggcaggtcagagaatccagtccacatgaagaaaagacttagagaaggaatgagtgaggataaaataaaatcttcttgccttcactctgtcttgaccattttgcacaactctccacacctctgcttttgtgtgcagtttaccaaagaacgaaacggtggaacaaaaatcgtcgtggaagggaacacagatggccctatgtagtggagacaaaagggagggaacacagatggccctgtgtagtggagacaaacggtggccgtggacaggtggaattccatgcagcctgtctcgtctggcctcttgcacagttttggcttctcccaggcttggctttcttctctgtcctctttccagacttgggtcacactaaccaggaggagcatcttaagctcttgcacttgcagagtgttttaatcaccaggaggcagctccgctgtgagtgctttgattcagtcactcatttactcctcacagtctcccctcaggcagggactcactgcagagtgttttcatctcatttactcctcacagcctcccctcaggcagggactcactgcagagtgttctcatctcatttactcctcacggcctcccctcaggcagggactcactgcagagtgttttcatctcatttactcctcatggcctcccctcaggcagggactcactgcagagtgttttcatctcatttactcctcacggcctcccctcaggcagggactcactgcagagtgttttcatctcatttactcctcacagtctcccctcaggcagggactcactgcagagtgttttcatctcatttactcctcacggcctcccctcaggcagggactcactgcagagtgttttcatctcatttattcctcacagtctcccctcaggcagggactcactgcagagtgttttcatctcatttattcctcacagtctcccctcaggcagggactcactgcagagtgttttcatctcatttgctcctcacggcctcccctcaggcagggactcactgcagagtgttttcatctcatttactcctcacggcctcccctcaggcagggactcactgcagagtgttttcatctcatttactcctcacggcctcccctcaggcagggactcactgcagagtgttttcatctcatttactcctcacggcctcccctcaggcagggactcactgcagagtgttttcatctcatttattcctcacggtctcccctcaggcagggactcactgcagagtgttttcatctcatttattcctcacggtctcccctcaggcagggactcactgcagagtgttttcatctcatttgctcctcacggcctcccctcaggcagggactcactgcagagtgttttcatctcatttgctcctcacggcctcccctcaggcagggactcactgcagagtgttttcatctcatttgctcctcacggtctcccctcaggcagggactcactgcagagtgttttcatctcatttactcctcacggtctcccctcaggcagggactcactgcagagtgttttcatctcatttactcctcacggtctcccctcaggcagggactcactgcagtgttttcatctcatttattcctcacggtctcccctcaggcagggactcactgcagagtgttttcatctcatttactcctcatgggccactcctcaggcagggactcactgttcctgatttgcacccagggaaatgggggtgcaaataggttaagcaacttgcccaaggtcacagaggagctggggtttgaaccggtgcggcctggctcccgaacctacgtcttcctgctctgctgctgtgaagccacgtatctaccttggaggaacattctcttctgttgactcatggttgtctttgccattggacagcagccccaggctgtgtgtgtgctcactgtgtaatgctgtgagcttggtgcaaatggcaggagctctaggaaatggattgtgatttatgacttcaaaagatggaagtgaagggtatgggtttttctaaagatttaaagctgtggatatacatagtaatctagaatactagtaacagcaataatgacttcaagcataaagggcgcatttgtatactacctctttctctgagggttccaggggtgctcatgtttttatcccccgaatatctcattgcaataatgacatcgagcatagagggtgcgtttgtatactacctctttctctgaggggtgctgatgtttttatccctgagtatctcattgcaataatgacatcaagcatagatggtgcatttgtatactacctctttctctgaggggttcgaagggtgctgatgtttttatccccgaatatctcattgcaataatgacatcaagcatagatggtgcatttgtatactacctctttctctgaggggtttgataggtgctgatgcttttatccctgaatatctcattgcaataatgacatcaagcatacagggtgcatttgtatactacctctttctctgaggggtttgaggggtgctgacatttttatcccctttttagtactttatccctttttagtatttttagtattttatccctttttagtactttaagaaacgctgttaaatgtattttagttaaccaatttatctaacactataaatgtaagtagtaccaacaaactcttcactagcaatagtgatttattcaatgctgcatgaagctgatcctgaataagcccttctcttaatagatgggtgcttctgggttcttagagtgaaaggcctaaagggaatgaactgttagcagccacagcagaaaaaacgagaaagatctgcctcttttggagtcaccaaatgcacctctatcaatttattgcctctcagctccaaattcaccctttattgccttcttcagaaaccatggatctgagtcctgcaaattctgttgagttgtgtttgtgaagtgtgacagaggcatgtgaggacagtggtttcacttcttagtctcagggctgtgcacagaggctctagcaggtcctgctgctgctggggtctctggcctctgtgttgcatggcagccagcagctcacccccagctccgacagctttgtaggagcttctccagcaatatccctccctgcctgagatggctgcaggcagcgtggtctccttggagcccctgtgctgtgtttgccctgacagccctgagtccagctgtacctgttacattccctcattcctttctcattcagtatttatgcatctgcttcttttctctttgctttgataacacgttaatgctgctttaggatcccaaactagaatcatcttccatttacgtgaaattttaagccgtcacttcctagcctctccctaagtggaagtatccttgaccactttcagtgctcttcctcaaagatacttaaaaatactagacaatcactgccctctgtcctgactgctgagcctccagattattttctcctatcgttttaagcatttgtatttcaggcatttgctggagtctttgacactgtatgtccagcatgaccagcaaatcttgttactctcgtgatgtttgcacacatgtctgttgactccgctgcaatcctgcctggtaccttcacccgagagatttctgtttctcattgtttccattccacggcctctcatctggtgtctcattcatgtggccgggtaaaactgtattcagggcatttgtaattaaggctttggaggacgcttgatcagatgctgtaatggatttctgatgctgcacagctgctagatttcatttatcagctcattttatgaaaaggatattgtgttttcaagggaatatttgttttgtagcaacctgtttacccatgttatattttcctaaaagttcttcatcttatgagctcttctcacagtgatctgggttttatgcagagctctgtaaacgtctttgttctcagctcataccctttccagcactgtgtgttaatccaacactgcccccttcctcgcactggggcctcagactggccaggcctcccggtgatccgctggcgttggctctcaagggagatgggtccatcctgccccgtgccctgtggtcaagtctatccctcttctctcgcctcacctgtgggatttgggccactggccagtggacatgcggccttttaagctggatgtcataagagacctcctcagtagcggtgtgtggtgttttctctgcaggagggcaccagcagagccacccggctgtgctgaggacccaggaggagcagcgagaggaaccagggggccatcgtggcttggttgcttcgcttccctctaggtgtcacgttgtgaaaggtctttcgacaaagcgctgtccatttaatcgctattgtagatgttagtggccggatgctcctttctggcttggatattttgagttggactgggattattaaacacagcaacaacttagcacatggaggtagattctgactcactttagtcactcataattacactgcgtgcttcagaagctgctcttcacccctgggcaggttgtcctttttccacgtgtttgccgtgttttgatgatggggttagtgcgcgctctaagggtctgcactgagaagaccccttagcgctatcccgttatcattatttgccttaacattgttccatgtagagtctgacggaatcttcagggtgctgtttatggatgttttgaagtgtcactgtgccactgatttccggttaaagcagaatgtagacatctttttgcaattgtttttagtgactccactggtttgtgttgctgtcttctgctgtgcagtccacagtctgacatctttgtggtccccatgcttccctcctgctcgtgttacccgatcctgtgggtcagctgtgaggaaaccactctctgtcctcgtctggagtcgccccgagctgggtgtgctggtctccttgtgtcgccctgagctgggtgtgctggtctccttgtgggcagaagtattcttctgttactgttttctcagttttttgaccaaatgtagcagacttgtgtatggtgcaaacatttcttaaaatgtcttttgcctttatggaaaaaaacccgcatttcttcaagatgtacctttcctgtgtctccatccttccccacatgattgctttgtgttagagggtggtgtgtgtgctctatggcctcattccatcaagcactatatgtaacctctgatggcaaaagtggttacactcaaggcagaaaacttcgcaaatgttgaagagaatgaacaaaaaacaatacgttgtcatcttgtcatcctgaaatggctactgttaatattttgatgtagttctttcaattctttttaagtaaaattgcttctaacacaagcactttaattacattgattaaattatagtcaggaaataaggagaaagtaaaaagaatatccagtttggggcaaaaagaaagaccacatagaaagaggctgtaaaactccctacaacttgaagaaaagctgggttgcggtggttgtggttttgtttttactgcgagagaccacatgattattctgggcactgaagggcgataggataataccctgtgagtgttttggtggccgagtaaatcccagtcccacgtcctctttccaagtagacaaagtgttgaggtttgaggtggtggtttggtaactttttgaaaatctgtttgtaggactgcactgcagagattaggttaacctgacttagaatcgaatgatctgttcaggctgtgggagctttctataccaggtgtacgtacgcctgttccggatgtggtgtagaaggaacagggctgggagggtttgttgcttcaccagtcaccgcccacaggcaggggctggggagcacagcccggtgctgcagagatgggctttgagactccctccctggccctgaggaactcacaggctgaatttagacgatgccgttattgaggcatagacagtatattttatacccacacatatggacatatacatacatgtacgcacatacagacctgtacatgtctgtgtgtgtgtaagtgacagaaccaacctggcttttgtgctatttccttcgtctttttagttgcctcagttgaaacaagatgtgttccttgttggaggtgagtggtttcattgttccagaccagtcatggaaatgcctgcaattatcagtgtttctgttttctcttgggaagctcttctgggaaggaagtgtactttccaaggctgttggttggcctgtcgtcaccctgggggtcttggtgtgggtcacagacccaggtgctgtggctgctcatgcgtggagctctgtctctcttgctgctgctagtagacagctgatcaccaacaaagtgtgtgtcccagtggcctttcagaagaattctctgcatcatttttatacagtcttttttattttcaatgtcaacattgtgtgttgcagccaagtgatatgttctgcagaagcaggaagtgtggcccaagagagaaataagggaattgatccataactgataccagcttttatacagttgagccattgtaattgatacgtaaacatcttaaatctgtagaagtgagtcaaggtgccagatcctgacaagtgccaaatgtctacgtgggacctctcttgtgtcgggtccacatcacaagaagaaaagtcattcaaatgcaacacgggaccattgtaatttatacataaacatgttaaatctgtggaagtgagccacggtgccagaccctgacaaatgccgaatgtctacgtgggacctctcttgtgtcgggtccacatcacaaggagaaaagtcattcaaatgcaacatggagtggacgtgaagctttcagaaacgtccgtgaatcagagcgactgttttcccatttgctggattccccattcgagatggtgagattcctgttccaaggctccctcaatttcccagcacccatttcactccttcctggagataacaatctcacaatgatatcttgttctcagattttcttttttttttttttttgttgttgttgactgaaacatctttatttggcacatgactgtagttgtgtgtgtgtatgtgtttttattaatagtttattaatattttcttcatggaattaggtaactgaatgtgtttacttcttttttttttttttttaattatactttaagttttagggtacatgtgcacattgtgcaggttagttacatatgtatacatgtgccatgctggtgcgctgcacccaccaacgtgtcatctatcattaggtatatctcccactgctatccctcccccctcccccgaccccaccacagtccccagagtgtgatattccccttcctgtagaaaaatcacatatttcacaagaataggctgccttactcactccttagcctggagtaagccacataccacttttctctttaagatactcacttttcaggactcttgataaattatttaagagtaggaaagtaccgtgactttggccacaagcagtattatgtataatatgcaagtgtgtgccttgatagccgcagtcactaaaaacaaattttctcagaagagaaaattgtaagcatttctttacttgatcgttaattttgtttgcctaaataacatcttgcctttgtatggggaggtggagaagtcgacttttgttacacaagatgagcttgaaagtcccttaagtggtaaaggatgccgctgagtatcgacgggggtgagtgggtcttgctgccccactgtatgtgatcctgagtattgacaggggtgagtgggtcctgctgccccagtgtatatgatcctgagtatcaacagggatgagtgggtcctgctgccgcactgtgtgtgatcctgagtatcgacgggagtgagcaggtcctgctgccccactgtgtgtgatcctgagtatagatgaggatgagtgggtccttctgccccactgtgtgtgatcctgagtatcgacgggagtgagcaggtcctgctgccccactgtgtgtgatcctgagtatagatgaggatgagtgggtccttctgccccactgtgtgtgatcctgagtatcgacgggagtgagcaggtcctgctgccccactgtgtgtgatcctgagtatagatgaggatgagtgggtcctgctgccccactgtgtgtgatcctgagtatcgacaggggtgagtgggtcctgctgccccactgtgtgtgatcatgagtattgatgggagtgagcgggtcctgctgccccactgtgtgtgatcctgaatatcgacaggggtgagtgggtcctgcttgccccactgtgtgtgatcctgagtatcgacgggagtgagtgggtcctgcttgccccactgtgtgtgatcctgagtatcaacgggagtgagcgggtcctgctgccccactgtgtgtgatcctgagtatcaacgggagtgagcgggtcctgctgccccactgtgtgtgatcctgagtatagacggggatgagtgggtcctgctgccccactgtgagtgatcctgattatcgacaggggtgagtgggtcctgctgccccactgcgtgtgatcctgagtatcgacgggagtgagtgggtcctgctgccccactgtgtgtgatcctgaatatcaatggggtgagtgggtcctgctgacccactgtgtgtgatcctgagtatagacagggatgagtgggtcctgctgccccactgtgtgtgatcctgattattgacgggaatgagtgggtcctgctgccgcactgtgtgtgatcctgagtatcgacgggagtgagcgggtcctgctgccccactgtgtgtgatcctgagtatagatggggatgagtgggtcctgctgccccactgtgtgtgatcctgagtatagacggggatgagtgggtcctgctgccctactgtgtgtgatcctgagcatcagtgggagtgagcgggtcctgctgccccactgtgtgtgatcctgaatatcaacgggggtgattgggtcctgctgccccactgtgtgtgatcctgagtatagacagggatgagtgggtcctgctgccccactgtgtgtgatcctgattattaatgggaatgagtgggtcctgctgccgcactgtgtgtgatcctgagtatcgacgggagtgagcgggtcctgctgccccactgtgtgtgatcctgagtatagacggggatgagtgggtcctgctgccctactgtgtgtgatcctgagcatcagtgggagtgagcgggtcctgctgccccactgtgtgtgatcctgaatatcaatgggggtgattgggtcctgctgccccactgtgtgtgatcctgagtatagacagggatgagtgggtcctgctgccccactgtgtgtgatcctgattatcgacgggtgagtgggtcctgctgccccactgcatgtgatcctgagtattgatgggagtgagcgggtcctgctgccccactgtgtgtgatcctgagtatcgatgggagtgagcgggtcctgctgccccactgtgtgtgatcctgagtatagatggggatgagtgggtcctgctgccccactgtgtgtgatcctgagtatcgacaggggtgagtgggtcctgctgccccactgtgtgtgatcctgaatatcgacaggggtgagtgggtcctgctgccccactgtgtgtgatcctgaatatcgacgggggtgattgggtcctactgccccactgtgtgtgatcctgagtatagatggggatgagtgggtcctgctgctccactgtgtgtgatcctgagtatcgacaggggtgagtgggtcctgctgccccactgtgtgtgacaagccctttgtttctggcctgggaatgtcccagctctgtcagcatgttgggctggtgctggctcccttgttagtttgcatgcgagacaaaaatctcacacttttcactcttcttgacatatagatgccgaagctttttacaaattattactacatcaaacccaaaatatgtaaaagggatatgaatatcacaaccagttgagtttgttctcttgatgtggtgtagttttgcctggcacacttggctcatcattcaaaaatcaatgtaattcactacattgacaaaaaataaaggagaaaacccattttatcatctcagaagatgctgaaaaacatctgttgaaatttaatagtcgttatacgaatttcctgtcacatcaggaacagaagggatctttctctgtttgataagggcccttcctgaaaaatgagagctgatgcccctcctccatggtggcagccggggcgctctgcccacagttgggtgtcaggggatcatggccattctccgtggttcaggtctgcatggcactcactggggccctcgtcaatgaagtgagtcaggagaactaaaaggcacagacttggaaggcatgagacacttgatttaccgaagacacagggccttatttagaaaattttaggaaatctagaagcaaccagaaatggtgtgaattttgcaagcatgcaagatacactcttcacaacagatgtatacagatgcccagtggaccatgggactcttcacaacagaggtatacagatgcccagtggaccatgagactcttcacaacagttgtataccgatgtccagtggaagatagactcttcgcaacagatgtatatagatgcccagtggaccgtgagactcttcatgacaggtgtatacagatgcccagtggactgtgagacttttcacaacagatgtatacagatgcccagtgcaagatagactctttgcaacagatgtatatagatgcctagtgaacggtgagactcttcacaacagatgtatacagttgcccagtggaccatgagactctttgcaacagacgtatacagatgcccagtgggcctgtgagactcttcacaacagatgtatacagatgtccagtgcaagatagactcttcacgactgatgtatacagatgcccagtggaccgtgagactcttcacaacagatgtatacagacgcccagtgggcctgtgagacttcacaacagatgtatacagatggccagtgcaagatagactcttctcaatagatgtatacagatggccagtgcaagatagactcttcacagcagatgtatacagatgcccagtggaccgtgagactcttcacaacagatgtatagagatgcccagtggtcctgtgagactcttcacaacaggtgtatacagatgctcagtggactgtgagactcttcacaacagatgtatacagatgtccagtgcaagatggactcttcacaacagatgtatacagatgcccagtgcaagatagactcttcgcaacagttgtatacagatgcccagtagaccatgagactcttcacaacagatgtatacagatgcccagtggactgtgagactcttcgcaacagatgtatacagatgcccagtgcaagatagactcttcacaacagttgtatacagatgtccagtgggcctgtgagactcttcacaacagatatatacagatgtccagtgcaagatatactctttgcaaccaatatatacagatgcccagtgggcctgtgagactcttcacaacagatgtatacagatgtccagtgcaagacagactcttcacaacagatgtatacagatgtccagtgcaagatagactcttcacaacagttgtatacagatgccccatgggccatgagactcttcacaacagttgtatacagatgcccagtgcaagatagactcttcacaacagatgtatacagatgcccagtggtcccatgaaaggcgctcaccaggggtcatttggtaagtacaacttaaacccatgaggttccacttcacaagagtggaggaggaggatggtagcaggtgctagtgaagatatgacaggctggatctcagactgatggagacttaaaacggcacggccactttagcaaacagtgtggcagtttctttaaaatgtgtacatttaccatatggcccagcaggtatgctgtagatgttcaccaaggagagatgaaaatgtgtgtccgtgtaaaagaatgcacattatctccagagtaaattctcatagccaaaaactggaaacaacgtaaatctctctcagctggagaaacatgagcaaattatgatatattcatacattgtcctagttcccatcaggaaaaatgtacaaaatactgaaaccaaaataggcaacggcgatgagttccaggagccttgaattgagcagagagtgaacaccatgctgtggagtccatgtgacggtggagaatctacacgagtgtcaggtgacggaatagcgccaaggaacactcctcatgaatgaacagtggctgtctctggagtgaacaccatgctgtgggctccatgtgacggtggagaatctacacaagtctcgggtgacggaagagcaccaagaaacactcctcatgaatgaacagtggctgtctcttgagtgaacaccatggcgtgggctccatgtgatgatggagaatctacatgagtctcggatgatggaagagcgccaaggaacactcctcatgaatgaacagtggctgtctcttgagtgaacactatgccgtgggctccatgtgacggtggagaatctacacgagtctcgggtgacggaacagtgccaaggaacactcctcatgaatgaacggtggctgtctcttgagggaacaccatggcgtggagtccatgcaatggtagagaatctacacgagtctcgggtgatggaagagcgccaaggaacactcctcatgaatgaacagtggctgtctcttgagggaacaccatggcgtggagtccatgtgacgatggggaatctacacgagtctcaggtgacggaagagcaccagtgaacacgcctcatgaatgaacagtggctgtctcacgagggccaggattgaccgggaggggatgtgtgggaactttgaggcaaaagatttgatcagggtaataggtagatttccacttatcaaagtgcaccaagtgtacttaagatctgaacatttcactgtgtatactttgtactcccgcccttccaaaagaaaacaatgaaaaaataattgtaaatgaacactgaactctatttgatagatttttcacagtggtactagatagcaattctgaaagcatttctgtatctccaggcttaagcaaataagcttaataaattagtgaatatattgagggtaacaggagccaggtttcttttttggcaagagaggtagaaataagaaaaggccaaagcctggaatggatcatgtgggattgggttgcagcaggaggtaccagtatgagctggtggctcccgacagatgtagacagggacagaagtgcctgtggatgggtgtgggtgtacatgtgtgtacacacatgttgtgtgttctgcttgctggcagtgcccagcagcagagacccccagtgacagcacacccggttcctagtcttagcttccaaacaccatacttcactagcaggagccctggtccaagggctggggaatccggtgtcaaatctggaaccaattgagcaccaaaacaaaccattataattatgaattatgacccaccaagccagactccatgagttcatattgacagaagtaaatgagtgatgaaagataaaatgagtaaatatttttaagtgaatgtagaagatctaatgatttagaaggaatggcaggaaatcatcagtggatgctaaaactagtagtgaaggatcgatgaaaaacagaatatgtacatagtgtcacagtctctcctcccaaatcttaattgcaatgtgagtagtagcatctttgctttggaggaacttaagcaccaccttcactgagttgccgacattaacattgccacacaggacagacttctgcggtatccctgctaaaatgcatactcttgagtctagtccggaagataccaaaataaaggacaagctgtaaaataactaacctgtattcttgaaaatttccaatttcaagaaacaaaaaagctgagaaacttggattcacgaagggtaaaaatcacttgacaaataaatgcaattcatgatcctggattggatcataaaataggaagacaaagtaagaaaattatggagacagttgacaccatttgaatgtgaactttgtatatgacagctaaatttcctgatcttgaggaaaatgtatgtgagagaatattcttgtgtttaggaaatacattgaaacatttaggtatagaggaatatagtatctgaaatttattttcatttgacttagaaaattcatgggggagcggggagagcagtggtgtaagataggagcagttggtgagcctggtaaaagttatatgggaattctctacactggtcttgcagattttctgtgtatctgaaattatatccaaaaagtttaaaatggagaatatgcaaaacaaaaagtgatttgtgggaagtgagtggactgtgtcacctcactgatgagcccttcagtttttggccatgagcccaagtcagtcacatattgatttttgacctgggaattagaaagagtggccagaaaaccaggctctttatctagttagagagagaagtacgcacaaaggctgaccaagaccaagcagtgtgatgagctgattgtgggcgtgatgcggcgggtctgggtcctgtctcaggtggcagctcgcggggtttaagcaggaaagacatgtctgattccctttcagtgggatcattctcacagcttcagagaagactgcctcgtcctggggaccctttcccccaacccgtcttcactcacactggccattttggttggtggtgattttattctgctaacaccgttctcactcacagtttagggcctttgagtgggtttttgcctgtgtctcgaagattcttgtcttgaagcctgttattctgattttgtgttgagagggttcttccctggcttcacagtttggagttgccacagcgtctgtctctgctttaattctctaccccgtctgtcacctgtcttgtccattaggaattggcctgcgtgagatgctgtgacactgtctgccttatcaccactgcgttcccagcccttagggacttacagaggaggcacttggtgaatgtgtggaattaatgtaatggattcatagccacaaagcgtgttaatggttgtattagtccattttcacattgctgataaagacatacccaagactgggaataaaaaggtttaattggccttgcagttccgcatggctggggaggcctcagaatcatggtgggaggcaaaaggcactttttacatgtcagcagcaagagaaaacgaggtagaagcaaaagcggaaacctctaataaaccatcagatctcatgaaacttactcactatcacgataatagcacgggaaagatgggccccaatgattcaattacctcttcctgggtccctcccacaacacatgggaattctgggagatataattcaagttgagatttgggtggggacacagccaacccatgtcaatagccaacacagtcctggcctgtggctggtgctcagctgagctgtgaccgtggctgtgagttggggtgcgaggcatgcacagcctctcagcagtacagtgaaaggatttggaggctcgaacgtgtgacctacaaagagatctccaaagatcaaggtccattcaccctaaaaagacaaatctcagtgcagtttacagccagtgtttgcttatggatatggattctgtggtaataaaataaatgattaaaagtctgtgaatgaattttaatgtctttactggaattgtaaacactgattttctttcctcgcccacccatctgttggtgagtttcagaaggtggatgaactgtgctgcagggacagagaggagggtgcagcttggcctctgggacctcagctgagcactgagtgactgagctctctccgtttcagacgtccacacggaagctgtccaggcggctctggccaaacacaaagagcggaagatggcagtgcctatgccttccaaacgcaggtccctggtcgtgcagacctcgatggacgcctacacccctccaggtaagggacacgctccccgacacggcctcctgaatgtgccgggcacctcagaattgacctagcccagcaatcaggggtttttgctttcaaaataatgaagcagtaatgcagattttgtgaaccagaagtccaaaaacagtgttgtatgagttaaacgtggaaggaaaagtaacattattatgtatctgtataaaaacacatttttaacttttcatcaagactcatacatatgatacataccagtaaaatctcaaacaattttattcatttaattctttgtaggggaaagggaagagtttgtacccctctgggtggaattggacttttcttctgattaggctggtgcatacatgttctcaaatcttcatataaatgtgctatattgttgtattgttttagaacaagcaaattggacaatttaggcagttacccaaatcacgggtcataaactttgcctgcaagttgccagatagtattttagttcctgcaggccataaggtctgtcacaaccactcaactctgcccttggagtgtgaaagcagccataggtgatagcaagtgggtatggctgtgtaccaataaaactttataagaacagcggaccagatttggtgcacagatgtgccaaccccgatctgaattactgaaggtaatagcccatttatatttgtgttatgtaatactgcttttatttaatcttgaattttacataactacccaaattctctattttctctgcccaaataattataaactacatctcatgatcttcccacccaagtaaagcagaaagtgtagttatccagatacttgttagaaacatggattgaacctacgttgtttggtgtttagtttctgtgattttgattccaacattattcatgtgacagttgcaagcttgtcttctcaaaggacctaaatcaccttacatcccactttgaagctacacaccactttgacaccatttttttctccactacaagagaaacttaaggtacaatatgaatagttgaaaatgtacaattttttgggagtatttttacttttgaagtttagcttggtcttggcaagcagtgagacagaaggacatgcatcagatcagagctgagatcaagcatatgcccacattattccaagtagctcctgagtattcacctttatacctttactaatgaaggtactgagattgataggacagaacttaaagagtgcataatttggggtttttgttgttttttgtttgttttgagacagggtcttgctctatcgccacggtcagaattcagtgtcatgattgcagctcttggctcactgcagccgtgaccacctgggctcaggcggtcctcccacttcagcctctcaagcacctgggaccacaggtgcatgccaccacacccagctaatttttaagtttttgtggagacagggtgttcctatgttgttgttgtttttcatttacacatgcgtgatcttcgtctaaagaacacagtgccagcgggcaagagagtgaacgccgtgctagcaaatgccagtgggcaagggagtgaacgccgtgctagcaaggttgttggcaagggagtgaacgccgtgctagcaaatgctagcgggcaagggagtgaacgccgtgctagcaaggttgttggcaagggagctctttctgccaacgtgctcccttgggctcctccttttctttattttaatattaagcaacagcacgtaattaggggctaggcacggtagctcatgcctgtaactcctgcactttgggagtccagggcaggcgtatggcttgagcccaagagttcaagaccagcccggaaaacatggcaaaatgtaccaaaatgccttttgtacattttgtctccaccaaaagtacaaaaaattagctgggcctggtggtgtacacctgtagtcccagctacttgggaggctgaggtggaaaaatcacttgagcctgggaggcagaggttgccgtgagctgagatggcaccactgcactccagcctgggaaacacagcaagaccccatctcaattagaaaaaaataacgataataaatagagactctttaaaaatgattaggccaggcatggtggctcatgcctccagcctcagcactttgggaagccaaggcaggcagattgcttgagtcctggagtttgagaccagcctgggcaacattccaaaaccctgtctccaccaaaaatacagaaatcagccaggcatggtggtgtgtgcgcatagtcccagctgctcgggaggctgaggtgggaggatcacttgggcccaaggaggctgaggctgcagtgagccatggtcatgccactgcactgcagcctgggcaacagaggaagaccctatctcaaaaaaaaaaaatgcttaatcctgtttgtttagtttatggttataatttgccaaaacttatggtaaaaaaatgttatttgtatgtgttctttgtgtaactaacaaaatggacttaaaaggataacccacttgaaatattttaaaccgaattcttggcactaaccggttatttaaggcaacacacatttttcttgaccactttttataagagaaacgatgagtttgaaatggaagaagcagtgtggttatttgcttgcttatttctcatattgaatccaaccactgagagatgttactgggtcatgtgtgatgaataacctcattgtacagatgtctttgcaaaatgcaaaagaatatttgaaatgttatttttgtgaaatatttggatttgactagcatttttatataaaccataaaaaaccttctgtaaattttcatcaggagtccttgtgatatcacatggggtagttttgtacaatcataaatatcaatatcataaaaattttttactcccagctattttgtgcttagcagtagtctgcatgtttattaccctgcttacttgaacaaaatcttagctgcattttcttacctatttttcttggttgttggtaacagtggttagatcttatctcagtttcattgctcttcagagaatattcttaaagtttatcttctatgaaatgactggctgctgaccaggatcatagtttctggagaaactctcattagcattgtcacaatgctaatattccatgggtgaaactttcccttaattttcaaatgtaaagatacaagaataatttgccaaaacttctgcttctagccatgatgagataacagggacccaaatcacacctctgccataaacaactgtaaaactgcacaaaacgaatgagatggctgttttaagtctgtgactacagctgtgccagccagaacttgagggcaggagaatgaatgagacgcacagacagtacatttgccctctgcctggagaacacctgcagaccgtggctcagagagctcaggtgtgagtggagcatggccaccctaccacgtccaggaggcggagatcagagagagctcaggtgtgggcggagcatatcaccctaccacattcaggaggcggagctcagagctcaggtgtgggtggagcatggccaccctaccatgtccaggaggtggagctcagagctcaggtgtgggtggagcatatcaccctaccatgtccaggaggcggagctcagagagacctcaggtgtgggtggagcatatcatcctaccacatccaggaggtggagcttggagagagctcaggtgtgggtggagcatatcaccctaccatgtccaggaggcggagctcagagctcaggtgtggacggagcatatcaccctaccatgtccaggaggtggagctcagagagagctcaggtgtgggcggagcatatcaccctaccatgtccaggaggcggagctcggagagagctcaggtgtgggtggagcatggccaccctaccacatccaggaggcggagctcggagagagctcaggtgtgggtggagcatatcaccctaccacgtccaggaggcggagctcagagagagctcaggtgtgggcggagcatatcaccctaccatgtccaggaggtggagctcagagagagctcaggtgtgggtggagcatatcaccctaccatgtccaggaggcggagctcagagagagctcaggtgtgggcggagcatatcaccctaccatgtccaggaagcagagctcagagagatctcaggtgtgggtggagcatggccaccctaccatgtccaggaggcggagcttggagagagctcaggtgtgggcagagtatatcaccctaccacgtccaggaggtggagctgagagagagctcaggtgtgggtggagcatatcaccctaccacgtctaggaggtggagctcagagctcaggtgtgggtggagcatggccaccctactacgtccaggaggcggagctcggagagagctctggtgtgggcggagcatgccaccctgccaagtccaggaggcggagatcggagtgggtgcaggactggagctctccacccatccacaccagcagcaaatcaatccaagcctgcccatggtcacgatgacccagcagtgcctgcgctgcctgctaaaacaagagctggaaagcttccgaagaagcttatgggatcctgagcgtgctcaacacgttacccacaatgtgcaatattaagcaaacaatcactgcatacacagagaaaccggaggtagaatctgtggtcaagaaaaaggcagtaaaatgtggacacacatgcaagatgatctctgtcactcaccacacgtggtggctgagtacatgaagtgcgcccggtctgaactgaattcgctgtgtgaaagacaccagttaatataaaaaatagaaaatattttctttgtatttcttattgaaagtatagtatgagcattttgagttaaaagtatattaataaaattaattgtacctgtttatatatttatatatatatatgaggctacaaagtaggtttaaagttctatataggattctcataattctgttggaaggtgccagtctagatgtctgatacagcaaaagacagagtttttaaatctacaattataaatatttcgggaatcaaattaaaatgtgtcaaagaacgaaaagaaaatattttaatacttgagccagaggaagggaagacactttttattacaatggagttggggagtttcaggttccatacgtgataatcttgagaattgtcactgcctcctcacaggtgaaaagctgagcaaactgaaaactcagcagctcttcttaaacctgcaagagacatgaggtcacaggcaagccactgtccccagatagggtggacaggtgaagtggagaatcaccatacactggagcagaaagctccaaggaacccccgctgggattggaaaacctgaactggaattgacaaattgctgtagtgaggttgtggccaagtctgagagttaaaacgtccaggaggcctgtgcatacagggccatgattttgtgagttgtaccatcagaagctcaaccaggttctcgaagtaaatatcagggaagaatcccctcatacttactacaggggacggagaataggaatcattttcaaatatgcaggagcactcttaactaggtctaccttccagagaagctagttaactagagactaacctggtggggttttatcaaagccttccggcctggggaaaaggaaatatccaactccaacctccagaactgaaaagcaaagagaacactaaaaagcaaaaaagaacagagtatccaagcactatgggacgactacagaaagcataaattatgcggaacggtaatacaaggagaagaatgaggaacagaagaagtatttttaacattaatggctgaatttcctcagattaatgccagacaccaaaccatagattcaggaagctccagaaacacgaagcaggataaatgtaaaaacaacaacgacaaaaacaaaaataaactatacttgggcatataattttcaaactacggcgaatcaaagattttttaaaaaccccaacaaagaaaccagagtaatctccttccctatagaggatcaaagataagaattctattcaacttcccctcaaaaaccacgaaagcaagaagtagagtgaaatatttaaactattgagaggaaaaaaatgccattaacctagaagtctataccctgtgaaattatctttcaaaaagtgaaggaaaagtaaagactttctcagagaaaaattgagaaatttgttgccagtagacctgccttgcaaaaagtgttcatagttctttagagaaaatagtagaggtcagtaactcagctgtgcataaagaaaggaagagcagagtctgtgtacaggggctcacacctgtcaccctaacactctgggaggccaaggcgggagaattgctggaggccggttatttgagaccagcctgggcaacgtagtgagactctgtctcttaaaaaaagccaaacatggtggctgacacctgtagtcccagctactttgagaggccaagatgggagggtcacttgagcccaggatccttttcaaggctgcggtgagctataatgatgccactctactccaccctgggcaacagagcaagaccttgactgttaagaaaaagcatcaaagaaggaacagtgaaggtaggagaaaaacttttatttttcttaatagatttaatgtaacagttcattcataatagcgacagtgtatttgattatatgcttatgtatataccatatacacacagttaaatgtaagtgaaatgaatgacagcagtgatacaagggatgggagagagcaattaggatttaggattattttgtttttatagtgtgcttgcattatccagaaagcagtatagtgtcatttgaaagtgggcttgggttacttgtgaatttatattgcaaatcccaaggcagccacttaaaaaaaagtaactgatatgataagaaaggaaagaaaatagaaaatgctcaattaagaccacaagaagaaagaaaaaaaaagacaaaagggcaacagatagaaaatagtaacaaatatggtagatattaattcaactgtatatcattactcactttcaatgtcagtctaaatgcacccaactatatattgtctatataagaaatctactttagatataaagaaatatatatagatcaagagtaaagggatagaaaaagatataaatgttaacactaatttatttattttattttttttgagatggagtcttactccttggcccaggctggagtgcaatagcccgatcttatctcagtgcaacctccgcctcccagattcaagtgattctcctgcctcagcctcccgagtagctgggactacaggcatttgtcatcatgcctggctattttttttttcctatttttgtagagatggggtttcactatgttggccaagccagtcttgaactcctgacctcaggtgatcatcctgcctcggcctcctaaagtgctgggattacaggcatgagccactgcccagccaacactaattttaaaaaatggaagtggtgatgttaatttgacagagcaggctttacatcaagggaagttaccagagatgattattttctccaagaagataaaacaatccttaaatgtatttttgcctaagaaagcatcaaaatgccaaagcaaaaactgataaacttcaaggagaaataatccagtattatagttggagactttaacacccctttatcagaaatggaccaattcagtagccagaaaatcagtaaggacaaaattgaaatcaacaacatcctcagtcaactgtatataattgacatttatagactatttcctccaacaacagaatgctgaacattcaccatgatataccacgttttggtccataaaacacaccttaacaaatttaaaagaataggaattaaacgagtatgttctcaaccacaatgaagtagaaataaataatagatgactggaaaatattaggaattaaacaatacacttaaaaataatgcattgctcaaggaagaaatctgaagatttctttaaagttttgaagtaaatgaaaatgaaaactttttaaaatttgtgagatgcaatgaaagtaatgtttatagggaaatttatagctttaaatgcatatgttaaaaaagatctgaaatcaataagctcccaccttagaaaactagaaaaagaacagcaaattaaattctaagtaagcaggagacaaataatgaaagagcagaaatcaacacattgaaaacagaaaatcagtagagaaaatcaacgaaaccaacagctggttctttgagagaaaatctataagcctttaacaagaaaaagaaatacagcagataaattaccaatatcagaaatgaaataagggacataactacaggtcccatggacattaaaaggataataaatattatgaaaaactctatggccacaaatttgataacgtggatgaaatggaccaatttctttaaagacagaatctgccaaaatttgaacaggaggaaacaatctgtataggcctgtatctgttaaattgaatcagtagttgataacctttcaaaacaggaagtgccaggcccagttgggttcattggtgaattctaccaaacatctaaaagaaattatgccaattctctacaatctctttcagaacataaaagctgaggaatacttcttaactcattctaagcatcattttaataccaaaactggaacaaaatattacaagaaaacatctctcatgaacacagatgcaataaccttcaacaaaatattagcaaattaaatccaacagtgtaaaaaaaaaaaattgtgcaccaaaaccaagtggaatttgtttcacgcatccaaagctgctttaacatttgaaaaccaattaacgtaattcatcacgttaacaggctaagaaaaaggaaaagaatttgacaaaatctaacactcataataaaagctcccagcaaactaggaacagaggtcaccttcctcaacttgataaagaatatggacaaaaaacctattgttaacatcatacccaattgtgagaaactagaatttttcccactaagatccggaaaggggatcaggaaaaacaaggatgtctcctctcaccacttcttttcaacattgtactagaagtcctagctaatgcaattatgacaagaaaaataaatacatattcattgggaagagaaataaaactttgttcatagatggcatgtttgcctatgtagaagatccaaaagaattgagtttaatatacaaaagttgaacgaatttcctgtttaccagcaaagaacaagtagaatttgaaataaaaaagtggctcatgtccataattccagcaatttgggaggccaaggcaggcagaacacttgaggtcaggagttcgagaccagcctggccaacatggcaaaaccccatctgtactaaaaataataatttaaaaaaaaatttccagtagcactccccaaaatggaatactcaggcataaaatctaacaaaatatgttcaagatcttatgaggaaaactacaaaactcattcacagaaaaactaaatggacaggtagtccacgttcatggataggaaaactgaatattgtcaagatgttttccttccaatgcagtcccaaccaacatccgaacgagtttttttttcaatatcaacacactgattcaaaagtttatttggagagatgaaagactcagaacagccacttcaatattgaaaaagaagaacaaagttgaagactgacactatgcaacttcaagacttactataaatcagtgataatccagacagtgtggtattggtgaaagaacaaacaaaaggatcaatgggacagaatagagagcccagtaagaaaatatagtcaactaaactttgacagaggaacaaaggcaatacagtgcagcaaacacaatatttttaacagatggtactggaacaactggacatccatatgcaaagaaaaacaccaaacctagtcacagaccttacatctttcaaaaaaattaaacagatcacagagccactgtcctcattagtatagtggtgaaatattcctgcctgtcaaaatagatgacagatgtaaaatacaaaactatagaattcttagaagataaggtaaaaatctagtgactttgatttggtgataagtttttagatatgacaccaaaggtgcaaggtgtgaaataattgataagctggactccaataaaaatgaacatgttctgctatgtcaaagactcttaaagtaattaaaatacaagccacagacagggagaggatgtttgcaaaagacataaatgataacttttatttgaaatatacaaggaactcttaaaagtcaacaataacaaaacaatcaatctgattaaaataggggccagccaagtgtgatggcatgtgcctgtagtctcagctactcaggaggctaaggcgggaggatcacttgagtccaggagctccgggttgttgtgagttatgcctctcaggtgtcgacactaagttcggcgtcaacccagcgacctcctgggaggggtgaactagcttaggttggaaatggaggaggtcagaattcctaagctgatcagtagtgggattgcgccttggaattgtgctccagactcggcaacattttgagatcctgtctttaaaaaatgaataagtaaaaaatgggtcaaagactaacagatggctcatctaagaagatataaagatggcaaatcgacatatgaaatgacgcttcacatcatatgtcatagagaaatgcagattgaaacaacagtaagacaccactatacacctattagaatgcccagaatccagaatgctagcaacaccacagcctatgaagatgtggagctgcgggaattctctctcattcattgctggtcttaaagcaaaatagaacagcctttaggaagacagcttggtggtttcttacaaaactaaatatactctttaccatatgatctaggaattacactccttggcatttgctcaaaggagttgaaaacttacgtctacatacaaagcctacacatagatatttagagcagccttattcataattgccaaaacttggaagcaaccaaaatgcccctcagtaggtgaatgtataagtaaactgtggtacatacagacaatgggatattattggatgctgaaaataaatgagctctccatagaaagacatggaggaaacttaaattgacttctttcacttagcaatatgcaatctgaaaaggttgctgtatgattttagctatgtgacgtcctgggaaaggcaagactatggagacagtaaaaagatcagtggttgccagggtccagggggaggcagccagggtctgtgggggaggcagccagggtccggggggaggcagccagggtccggggggaggcagccagggtccggggggaggcagccagggtccggggggaggcagccagggtccggggggaggcagccagggtccggggggggaggcagccagggtccgggggggaggcagccagggtccgggggggaggcagccagggtccgggggtgaggcagccagggtccgggggggaggcagccagggtccgggggggaggcagccagggtccgggggggaggcagccagggtccgggggggaggcagccagggtccgggggggaggcagccagggtccggggggaggcagggatgaataggcaaagcaggaggattttttagtagcatgtgatctctgtatgatactgtgatggtggatacatgttatacatttgtccagacccatatattgtacgacaccaagaatgaaccctgatgtgaacgatggagtttgggtgataatgatgtttcagtgtagaagcatcagttgtgacaagtataccactctggtaggcaatgttgatgataggggacgctgtgcacatgtggagttggaaaggataagtgagacatcactataaagctggaaaatatgatagaagaaattttgctggtgggtttaacaggttggagaaggaagatgaagtctgtgagcttgaagagggatgaaaagaaattaaccaaagtgaagaccagagaaaccaaaattaaatgcgaacagaacctcaagctcctgtgacacaatgttaatatccttgtaatataagaaggaaaagagaaaagagcaggagcctttgaagaaatgagtcaaaatttactcagattgatgtcaaacacctgtgtccagccccgagaagttcagtgaactccaagcagaacaagtataaaaagaatcacatccaggttcatgatagtcaaagtgcaggattaagaggagatcctgaaaggactccgaagaaaaagacacgttacactccagagaagcatttgaacaatgcatgacttctgtgaagatacaatggagaccagaagaccatggaaagacattttttaaagtactaaaaggagaagaaagggctgtcaactcatatccggtgaaaatctcctttataaacacggatgaaacgacacattcacacacatgaaagctgagagaatatgttatcagcagaactacactataaacatgctaaagaatgtactttaggctgattgcaaatgctatcagatgaaaggttagctctatgaaaaagaaaggaccctagaaatcaaattttctggaatataaaatcatagaacactttatgattttatggtttttagttttttatgatcttagaattttatgatataaaatcataaaatgtccacgcttctctacaccttcacctgttttgaagtccgtgctgtaccatgcatcagtagtttattccttcttattgttgaattatattctgttagatggatctaacacatgctgtttattcatttaccagttggttattcattctttcctctattcggcaattatgaataatgctgctgtcgacgtttatgtacatatctttgtgtatacgtataatttcctttatcttgggaggatgccaagtagaatgattgactcttattgtaagtttaggtttagctttttaaaaactgccaaattgtttacaaaatagctgtaccattttacatactgccaccagcagtatatgagcatcccagtttctccacatcatgagaagcagttggtattttggtatttttatttttgccattctaattgatgtgaaatggtatatcattgtgtatttactttgtaacagttaatgatgctaagcatcttttaatgtgcttattagcttttaatgtgctaattcctattcatagctatttgtatatgttaattggtaaaatgtccagattttttgcccatgttttaaaatgggttggttgtcatcttatgggttataggtgccttatacgatctgaacgacttttacaggtgtaaggtttctcagtgaaaggacaaactgttctgtagcagacagaataatgaccctcccccaagatacccaggtcctactccccagagcttttgaacctgttaccttaagtggtaaaagggattttgcagctatgattaatatagagatcttgatatgggaccactatcctggtttaagcaggtggacccactgtaatcaagaacgtccttacaagagaaaaggaagaattggagactggagtgatggactttaaagatgaggaggggccataagtcagggacacaggtggcctctagaggttgggaaagaccaagaaatggattctcctttgaagcctccagaaggaacgtagctctgctgacactcagattttacacttctgacttctccatctgtaggataatagatacgtgtgttgttataagccacgaagatcaaggtaatttattacattagctagaggcagataatcatcttttaaaacttagtagttttctattttaatgaagtccagtttactaatttttatggattttttggaagttttagaagtctcatagtcttactgttctttcatttaggtctgtgatccattttgagttaatttttatctgtgcagtagggatctaagtgggatttttgtttgtttgttgtggtttggtttgggggattttttcccccatgctttttctttttggtgtgttgggtacccagttgccacagcaacatttgttgaaaaaaatactacctttctcttactgaattgtcttgagacgtttgtcaaaaataaattgaccgtaaatataagactttatttctgggtttaattctgttcctttgatgtatacatctattcttctgctaatactactgccttaattactgtgactttatgtaaagttttgaaatcagatagtgaagtcctccaactttgttttcctttttcaaaattattttggctattgtaggtcctttgtatttccagataaaattgagaataagctttcaatttcacacacacaaagccttctgggattttattaggcagtgccttgaattaatggaacagtttgggaagaattgctctcttgataatactgagttttccaattcacaatcatgaatctatctccatttatttagtttccatttatttggatctcctttaatttcagtaatgttttatagttgtcagtgtacacattttgtacctttttgttagaagtttggctgagtgttttatgtttttgatgttactgtgaatggaactattttcttaactttattctcaggttgtttattgctagtatatgtatatcttgtgtcctgtgacctcatcaaactcattttttagtaatgcaaaacatttttgatggacttcttgccgttttctacatccaaggtcatgtcatctatgaataaaggcacttttattccttcttttctaatctggatgtctttattattaaatttgttaatttatttcactagctagaacctgccagataatgtcaaataaaagtggcaagaggggacatctttgtcttgttctccatcttagggaaaacgccttctattgtttaccattaaatacactattagccatggcttttcatgaatgtgctttaacaggttgaggaaattgccttctattcctgattttgttgagtttatcttgagtttgtcagtacttttctatgtctcctaaggttaacatgcggttctactcccataattctatatggtgtatgacattaattcacttttgaatgttaacctgaattcctgtcgctctggtatttacttctagtcaccgctggtcatgctgtatcatccgtgtcatattagtcaccactggtcatgctgtatcatccatgtcatattagtcaccgctggtcatgctgcatccatttcatattagtcactgctggtcatgctgtatcatccgtgtcatattagtcaccactggtcatgctgtatcatctgtgtcatattagtcaccgctggtcatgctgtatccatttcacattagtcaccactggtcatgctgtatcatccgtgtcatattagtcactgctggtcatgccgtatcatccgtgtcatattagtcaccgctggtcatgccgtatcatccgtgtcatattagtcaccgctggtcatgctgtatcatccgtgtcacattagtcaccgctggtcatgctgtatcatccgtgtcatattagtcaccgctggtcatgctgtatcatccgtgtcatattagtcaccgctggtcatgctgtatcatccgtgtcatattagtcaccgctggtcatgctgtatcatccgtgtcatattagtcactgctggtcatgctgtatcatccgtgtcatattagtcactgctggtcatgctgtatcatccgtgtcatattagtcaccgctggtcatgctgtatcatccgtgtcatattagtcaccgctggtcatgctgtatcatccgtgtcgtattagtcaccgctggtcatgctgtatcatccgtgtcgtattagtcactgctggtcatgctgtatcatctgtgtcatattagtcaccgttggttatgctgtatcatccgtgtcatatgctgtttgtttggtttgctgctattatgttgagtgtctatatcatattatccttcaggtttcttggaagaggtaggtgggagtggggaatgaaagattgtaaagagttgtgagaagacattctggggagatggttgtgctccttctggacacctgggtgtgtacctttctcaaaagtctcaaggctgtgtcaattttacttttatagaaattgtgtaagttttcttaaaaggcagagtgggccaggagcggtggctcaggcctgtaatctcagcactttgggaggctgaggcaggtaaatcacgaggtcaggagttcgagaccagcctggccagcatggtgaaaccccatctctactaaaaatacaaaaattagccggtcatagtggtaggtgcctgtaatctcagctacctgggaggctgaggcaggagaatctcttgaaccagggagtgagaggttattgtgagctgagatcgcgccactgctctccagcctgggcaacagaggaagactctgtctcaaaaaaaaaaaaaaaaaaaaaaaaaaaacccaaggtgatagagaattttcaggctcttaacattgttgcttttctaacaagtaaacttttaaaaaaattcccagacagcataagtcatgtgacagtgataataagtgtgtatattgtttgcaattattatcttttaaaaaacaaacccgtgtcttaagattatttgccgtgacttctcctctcacccgatggctggagctgctcacctgagctggcgtctctcataactcacctggaggtaggattctgagtgtcattcttaaattgaagtttaaataacaaatacaccaacaatttattcccaaaaaccttggtactgcatgaaaagttattaaatgaaaaatattctcataaattatagtgaaaaaattgatgtattttgttataatccaagatatccaatctgcacagatagaaaaatcaataatgagaatgtataagaaacaaatactgtaaaggtgaattgatttgagtgtaaaatgtgacgtgatgaaggtttgtcgtgtgccccggaggaaaacggggaggtggaggggctgctccgcgtgaggcacgttctgctttctctcctgttaccatcatcagtgtcttgatccttaaggaactgtatgggtatctaacacacacacaccgacgtagaaataaatcagctgcatggttatctaacacaccaacgcacaaatcaggtgcatcggtatctaacacaccaatgtagaaataaatcagctgcatgggtatctaacacactgatgtagaaataaatcagctgcatggttatctaacacactgacatagaaataaatcagctgcatgggtgtctaacacacacaccgacatagaaatcagctgcatgggtatctaacacaccgatgtagtagaaaaatcagagcccacaagaacatctcaggactaacaagggctaaacatacgtcacactgagactcctgagagccgcacaggccctcagcatcccctaggaaacgcggcccttgttctctcactttgtgggtgacacaagcaaacacttggtttcttcccaaactgctgtgtagaggaaatgggtcagtgtgtatttgtctgagatgacagtgtcaaacatcttatagcatgtttatataaggtgtgttggatgaaaaactcattatgctaaaataaatggtttattatctgaaacgtggtttaacttctcaagagtgtatcaaaaagtcattgaacaactattgagacttacgtgaagtaaatctgtgtttggcgagggactgagattgtggtgcacgtttttgctgcaacatacagcaaatcacctttcttcttacacagatacctcttctggctcagaagatgaaggctcagtgcagggggactcccagggcacccccacctccagccagggcagcatcaatatggagcactggatcagccaggccatccacggctccaccacgtccaccacctcctcgtcctctacgcagagcgggggcagcggggctgcccacaggctggcggacgtcatggctcagacccacataggtgagcacgcttcacggtgtctttctgtgcctgttgtgtaaacgcctttgtgtgtgcacattctctgtttgcatcgttgcagcggaatccctcggtggaaagagcacagagctcctctggcccctggggtgctttggctggattgtttctggaagctgctttacacttctcatgcccaggtccctcccacagctgcaattccaggggccttgttcctggggaatcctgcagccgtatccgctcccatcttttcttctcacttatgctcctacatgaaaccttaacagtcccaatcaacaggacagggttttaaatgtgctcgtcctgaccgtgggagtcatttaaggaaacgagggctttaaccacagctgcttgacgctgctgtctgccacaggtgttcagacttcttgggggccggcacactgctttgtgtaggttctatgacagggagatactctgtatgagaaaaagcacaaagttaggatcactgccctatgacgtttgaacatgctgtggaaaaggagtaaagtgagaattattagaggaagagctggcacgtggggagcggtgatgggcctcacgtcgctctgcctttgaacggttcagtagtaaatgtttttcatcaagtacgggacttgggttgaatagggttttgtgtgtgtctccattaaagcagtaaccggagacgactgcttaccacgtcgccgataacggagctcgagccacgggctcagaccctcccggtatctcagctgccgcaggaaaacctgatccctgaaaaaatcatcagtgggaagcaggtgcacgtcattgtgattaaatagcccacagacaccccagaaccccagaatgttcacttctagatcactgactcctttacgctcagaggcgttttggattgacttgggtctcagccccttggtcgctcactgagacttaaagcgtcggccgttttctgtctggaacaggagtttgctggcaggagagctgggtctgtctcacttttcccaataactgctgctgggatcttgaagtcagttctcctgcttttaggcttttggtgaggaaaaaaatgaaaaaaaccatttcttttttctctctcagaactgttgtgagtataaaggagaaaatagaaatactctgtaaaagtttgtaaagtaatactcaaatgcaaagcagtattaaacttcagtttaacacagtttcaggaacatgtacactggtttatgtgaattaataacctgtacttgaaatcacagtacgttaaacaatgaacaggaatgtgtgactgttatttttttttgtaataaaattccatgtgtatattggatcccaggatagtggctgaggctctgccagctttatcgggcacctgaacggggaggccaaacaccatctctgccacttgggggaagcatttgtatcctcggattttattcaattttaaggaaatgggcagaatcttaccaaggaaaacacatatttttgaacaagtgaatcacggcacttggcctccctttgcgggtttacccttgcagtactggaggaagttttagtacaaagaatgtatccaaactatgaggggctcataactcatgtacatcaaggctcagtgtgacccaaatgtaactctcgggtgaccacattccggtaatttctaattaggcacaaagataatcttcctagactatctggaaattttctgtaactttgaaatttttttggaaaaaaagcagtggcaaaataatgaaacttaatcagaaaaggaaaaatattttctgtggcaaaacaaaagaagtaaaaagtcagatttgcacttgaccttgtgagataatcagaagcctacaaacaggaaagtagcgtgtgtgatcgtgcgtctgcgtgcgcgtgagtgtcctaaggagtccaagcacaacagatggctgagtcacactggccgatccctccggcaagggacagaagtggaggctgcagaggctgcttgtgtccgaggggagaaaagcccagggctgcagactcaggtcacggagtctctcagagctggccacgcttctacttgctgttgaagcaaaatctcaagtcctttgtggattttttccaccaatttaattatgccggcaattaagtagggacatctcacatgtatcttaagagtcaagccaatttggcataagataggaaatcccattctagttttctttttccactgctctacccgctgtccatctacaagctgtgtccagcgttttcacacctcggagctgagaggaggcctcccagacgctaccatccaagtccgctgaggacttgagggggtgtgtgttggttctgcaggaagtcgggcctgcctgcctccaggtggaatgtcgtggcactgacgggcggtgtggcgggccctccccttagttcttgtcttttcagtcacgggttcccagtgaacggcattgccgaatctacttgtgacaccggactgacaccgtcaggaggggccgacgccgtgtccaggcagctcggcaccgcccacccggcccgattctcagatcacaaagcagcgtcctgtcacggcctcttctgtgcctcgatcttctgtgtcctgtttttgtgcgttcagttgatttcgccgtctagacggcctccgggcacggtgcggacatgggcagcgtccggtgaagagaggcttttggggatgagccccactttcagcgacacaaagtaccgcccttctgttgcgtgggacagtggcggggtgatcctgaaaagcttccatcagaggaggattcaggatcgcgatccgcatcgtggcgcccgtcatcaagattctgggtgtgacgggcgtcatcagtgggctgcttggcacatcttcctcaatgcgttattcattaaatagaaaagcatgcttttccccattcagccacgtacggcttaactttatctccagggggtgctgtaagagaaagagctccacgcgctcattggccttacacgatccttagtacacattagggtgtaacgtggttttttgaatgactgttgttgtttgtactaagagaaataataaaataatagttcttgatgtctcccccttttatgaagaagatcctatgaactgtatacgtgttaactcacataatccacccaactaccctacacggtcatggccattactgttcccatttgacgaagaaactgaggcacggagagcttaagggacatcccaaaatccccagaagtttccagagccgggtttccaattccaggcctttggctgcgtcgactgtggcagacaggaaacaggacccctccgtgaacacacacagggttcctgacgccctgccattgccagtctaacgttattctagttaaaatgctgctgacatggctcccgttaggaaattacgtctgaggttttaccgaactctgctccatttgcggcaacatgagttatgctggggtccccctttgtgctggatgtgtgtggcagatgcggctgagatcggctctggctttccatggcacacccagggtgagcacctgtgcttcagtctcttcctgggctgtggcttgttccaccttcagagcaaacatcacaaccaccagaaaatctcatgatgtgtttctttacagaaaatcattctgcacctcctgacgtaaccacgtacacctcagagcactcgatacaggtggagagaccgcagggttccacggggtcccggacagcgcccaagtacggcaacgccgagctcatggagaccggggatggtacgtcccaaaggagagatgcgtttttttctggtaaacggtttgtgctgacgtcccgttccgtgcccatgactggatgtgtttcttcctggggtacaatcggttctgacaaagccaatttatcagatcttcgggagcctctcatggaaggtggcctagccacaaaaatgcaaatattctccaagtgagcccacagttattccttgtaggaaaaatgtaaatgttgtaggaatttagtcatgagaagaaaaagaaattttagaatttgctgccgtttttgctgctgaataacggtggttcagcaactgagaaattcttgtacaggtgtgttaagaccatgaacagtcacttagaagagcaagatgaagttaaatgtacaacagaattactgtcagatgggctgatatgttgctttagactttggaggaaagagggtctttttatccacgttggacagagatatcggtgacttggtaacaggctgtggccgagggcttcttccttccttctttgtggcccagtcttggtatattctgactacagcggctgttcgtgtcactcagcccctattccatttaggtctcagtccttcccgaggtcataaaagtcagggtagaacctagcggtgaaatacaatgcccttgtgtgaagctgcatggagcagccttggtatgctgtcatcttgcggtgcacgggactcacaggcggacagggaggcctatcagagccccgacaggcacagtggacagggaggcctatccgagctccgacaggtggacggggatgcctatctgaggcctgacaggtgcagtgaacagggaggcctatcgaagccctgacaggaacaggtggacagggaggcctgtccgcgccctgacaggtgcaggtggacagggaggcctgtccgagctctgacaggtgcaggtggacagggaggcctatccgagctccgacaggtggacggggatgcctatctgaggcctgacaggtgcagtgaacagggaggcctatcgaagccctgacaggaacaggtggacagggaggcctgtccgcgccctgacaggtgcaggtggacagggaggcctatccgagccctgacaggtgcaggtggacagggaggcctatcgaagccctgacaggaacaggtggacagggaggcctatccgagccctgacaggtgcaggtggacagggaggcctgtccgagctctgacaggtgcaggtggacagggaggcctgtccgcgccctgacaggaacaggtggacagggaggcctatccgagccctgacaggtgcaggtggacagggatgcctatccgagccctgacaggcgcaggcagacagggaggcctatttgagccgacaggcacaggcggacagggaggcctatccgagccctgacaggaacaggtggacagggaggcctatccgagccctgacaggcgcaggcagacagggatgcctatcctagctccaacaggcgcactgccacatcctcacgtgaggcagagcccaactgtgccttcgtaagtgtccagttagtgcgcttgaaatcgccctgattgccagtgcgatgacttttcctggaatgccttttggtgtcattatttgctttagttctctgatgagttcgtctttactaaattggccatttttgttattcttgtcattttagtaactttgtcgtctttcaagtctgtacctttgcctttgttccccaggtaaatcctgcgtggtgtgttgtgctgtctcggcgtgtcatagcctcccacaccagaatcccacaggggcccttgctgggagggtgattctgggtcacaccccagacgtcatgagctagaagttcgggggtccctgaggcaattctgacatctgccaaattaagcttgagaatcgttggcctggtggaatggtatgattcatctgaaccaaattagttgggctatttaatgggaacatactatgtgtggatattgagagttctggattgtgtgtttttctgtattttcagagatatgaaatatttaatgtctcaattcttaaagtgctatagagcattttgagactacctattaaaaaatcttgatagaaaaaatttccttgaattctgttctattccccgcaaatgttgaagtctgttttttatggtccagtgcgggggcgaacaagggctctgcctcaggtgaggggaatggactgccagctgcacctacagagacccctgcaccgtccaagcccacagctctgggtgatggtttcccaggtcctgccggcctgcagcgtgtgcctgaggaggacgcttttgatctagttgtggcatcagcgtcttggtcctctgtcttgttcatttgatttatttatcttaaaatttgaaaaccttgactctttcattgatcaaaccagttgattttcagaatggtgcagcattcattataattagcacagtattttaaaatggggcttttctcggtccacttggataggtaggggctagtattctgttacacaaaaatttgaatttagagactttaacttctgtgctttaggatgcattgcctgtgtgtgggctgagctgcgtgggtttggaacgcgtgtgaggagctcagtctttattaggagtggacagggcttgggcgtggtggtgctgaaacctgagcccggggctgtgggatgctgggggttccagacgtgactcagcggcccgatgttctcgtgcctccatgaggctgaatgctggtgtgaggctgaatgctggtggtctctggagagatagacgcagggaaggacttactgctccacggatggtctcaccctgttgagaagagggggcctggggcagtgggaatgaggagtctgccctctgcaggtgacaattctgtcctgagaatcagagctggggtcaagcaggtgtggccctgaggctcctcccagcatgaccagcagaacagcacatcctggaacgtggtagacattcgggtccgatgtatctctgtccggtctcctgcctagccacggggctaccgtacagcatgatcacctcgggcccttcccaggatcgcatctaggatgcagcctgttgtagccgcgctggggagggggctgtgggactgtgggactgtgggtgctcattgaagctgtgatgatcgctttccccacccgctgattcctgtttttcaggagtaccagtaagtagccgggtgtcagcaaaaatccagcagcttgtcaataccctcaaacgaccgaaacgaccacctttacgagaattctttgtcgatgactttgaagaattattagaaggtgagagaactctttaccacacgtttcttccagatgctcctatggtcccgtaaacaatgatatttttttctgcaaggctattttactttttaagagcagtaatcgtggcatttgccgcatgatgggaacccaggtagggagcgggtgatgttcccaggcagccttggtgtcggcaggtctctaaacctggttgttagtcgtcctctgtgggagttgattttgttctgtgacccaggtcaggtctctctctaagaactctgtaagagtatagaaatacaagtaaagtataaacatgtagaaaaacaagtaaactggggaaatccttcgctggcagcaaaactggcgtgtgaagtgctgtctcctccctcctcctgctgcctctccttataggtgccggagctgctgcctttgcccctgaatgctcctgggtctttttagacaaacaacttaaagttgaaataaagcacaagaactgctcattgtagcaaacttgagctccttagtatcttatgtgttaaaccacaagtagaaacgactgattttgtcagtcataaagtgacagacaagtctgttccagaaatggaagagataatttccattcttcacctctctcaaggattgggcaggtggtatttatgatgcactgattttagttttactcaggaaaatactcactccgtgttcctgttattcagagtacttgtagcagatttaaatgtacagctcaggccaggtgcggtggctcatgcctataattccagcactgttggaggtcaaagtaggcagatcacttgagcctgggagttcgagaccagcctgggcaatatggcaaaaccctgtctctaccaaaaaaaaaaaaaaatatatatatatatatacacacacacacacacacacacacacacacacacacacaaatatatatgtgtgtgtatatatatattgcccaaacctgtctctacaaaatatatatacattttatatatatatacacattatatatatacacattatatatatatatatgtacacacacacacacacacacacacacacacacatacatacacactctaaaattagctgggcgtggtggtgcatgcctgtagtcctagctacaggctaggactgtagcagaggctgaagtgggaggataacctgagcctgggaggtcgaggctgcagggaactgtgatcatgccactgcactccagccaaggcaaaagagagagaccctgcctcagaaaatatatttatcattaatctttcaggacaaaatataatttagcaagatttaagcaatttggggtccaaaatcactagctgatgttggtaatggaaatttcagcatggctgtttgaattccagcctctgggcacagtgtgcagcgcagtttccacctgttatcagtttgcagctgtgtgcaggtccacctaagcgctctacccacatgctgccttggaaattacaagaactaattttttaccagcatccgtgatgctagtgtatagaccccaattctagaaaagcatgcttttctgtcagctaataaatgtacagcttaagtataaatctcttggcttctttataaagaataaaaagtagccatgctaatgtggatgcatttctcttgtaacctcttgtattcaaacgatttagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggtaatccccaggctcactctctgccctttgcccaccccctcgcacagccactcccgaacgcaggaaactcagtgtccgtttacatcctcacttaaggtaatcccgaggctaaccctctgccctttgcccacgccctcgcgcagccactcccgaacgcacgaagctcagtgtctgtttaaatcctcacttaaggtaatccggaggtttaccctctgccctttgcccaccccctcgcgcagccactcccaaacacacaaagctcagtgtctgttacttctggtgactgattgattttgtgctgccttatgtttccgcacagaaataaatggaatctcaagaaactctttaggaaaactatttgatttcaatataaaaagttatttgttaaatattttttgagttaaaaccagaaatggctgcttgaagcagtgaccatagctctaataagatgttagatcttaaatacatgtgtgatttattgaaatgcatgctttcagcaaagattggtagttagaaaaaatgtctatctaaactttctggtatgtatcactcagaaaaatcaaaatcggtttccaagggactttttcagaaggccagagaaaccgcctttcccttaagtcttcagtacaattaatacagtctgtaagctttttgcacatggttaacggtagcagagaagtgcgtttctcttttttctgtggataagaggccatggaggggcagattgtcaggctattttctgtctgcttcagctttacaaagaaagtagtaactaaaaggctggcatgatggctcatgcctgtagtcccagctgcttgggagctgaggcaggaggaggaggtcgaggctgcattgagctatgattgtgtcacagcactccagcctcagtgacagagcaagaccccatctctaaaaaattaatcagttagaattttcaaaagatacgaaaataactgaaggaccaaaatggttcatattgtgtctgcatgtctgagatttatgttgatagctgaaattttaaacatagctgtttcagttctagactcttgggatagtacagtacatagttccgcctgttgtcagttggcaggttttgtttttaactttagcttttgttgttacaacacttttctgattgcaggtaggaaaggaattgatttctacattagccatggaggtcaaaagccagatgctatgttgaaccgtggaacctcagaccctagcctttcagggtggggctctgggaggcagcagctgtcaacctgtgcatctcaggacagatgtgggatttgggcctaggagcatattgggtttgggagcgtgcgtttcgtagcccctttgcttttatggcttcattgagtagttttaaatggacagtgtgtggcatccatgatgaagcataaactttatttttttaattatgctctcagaaataggttttattgagtcaaaagcatgaaagacttttctatgtgaccctcatctccggccaaattcagccctggagctaattgtgtacttggagtcgctgctgcatgacagctgatggcctctgaggcctccccgcctacatgcggggaattccaggagcagccgaactgttcgggtgcatgtgttcactctgagaactaatagacgttcacttgggtgttttaagcatgcagtatgcattggcacagaactaagctttgggaaatcaaagacaataagacacagttctcacggggcttctgatgtcgatcagaaggatcgccactctctgctgctggaactttgaacagggttggtgtctttccccttcctgcaaggttaagatgaatgggagacgtaagacacagactgaatattcatatgaaaagttggattcttcagaactcatgcccacaaccaaagcattttaactcctttatatgttgtattttaatcatctatatgttgtattttaattatccattttaattgcaggctgtgggttgatcttggtttttacttgttaaaggaatgtaagaaagcaacacatttccaaatttaagattacagcttatcagatgaaaacgcagtgaacactggaaagcgccatctgcgtagaaacgctaacgtagatgaacgcatgactgggtgttgctacgatgagtcagaaacaagctcgtcgaatgagaattgttctaatactgagtgatttggtatcgaatgagaattgttctaatactgagtaatttggtatcgaatgagaattgttcaaatactgagtaatttggtatcgaatgagaattgttctaatactgagtaatttggtatcgaatgagaattgttctaatactgagtaacttggtgtaactgaaggggctgtattctctaaagtcctgccgtttcccctcaacccccaaatttagcttcctacgaagcgctggggtagcagaattcccagcggataaacttgggatcagtaacagaaagtgtaggtggctaatgaaagccacaactgaataaacttgtaaaacatcattctgttttccactttagactacccgtggcatttcataatcttaataaaaataagtcacgctgtgctgttaatttcccttcacgtcctgcctcacagcagctctctggtacgctcttcctctgcctcctctgtggatttctggagagacctatacgttcatctggctttcctaccaaggagatgctcatgctcatctcccttttaacgttttatttatggttttccttttactccagatgtttcaagaaatctacatgcttgagctagcagcacgctgggccacctttctgtggccttgctgcttttttgcgtggttgatggtgtctctctcaagctcccgcctccttcccgggcttgctccggttcagcccttcgccacccaccgcctctcccctcaccagttacactctgttcagttgcctgttcctcagtcaaagccaagcgaaattacaattaatatctaatacaatagtgctgacatcacacacatctcctttatgaatcagttaagaactgctgtatctttatatcagcagcttaacttcctgccttttctctttgagaagtataaaaataccaaatatatttcaagaatttttccaaaagtttgcatgtgttttatcaaactctctattgttaactagcttgtgtatgaacttaggatgtcaagactcttagctgagaatgaagttgaaactttcacaaactagaatggtgctaattgagtgtaattgatttattcagttacaacacattgtttttctttcagttgcaaagaattgattgtaattgttttacccaactataatagttccctaatcttgttcacattaaagaaatctgaagccacaaaataattgtttttgttggggaaaaaatactccctgaattatatctaatgagccagtgatcttttccaggaaaataaaatcccctaatagaattccagatgactgtaaagctgcccgtcttgaagactgcctatggtgttgaggatgaggagctaaggaagacaggaggagggaacatgaataaatgtgtgtctagcaattaagtgctcaagaatatgctagaatgcacaccgtaactttgtattttattacagcttgcctgcgacatcagtaaaatgaagaaacatttgctgagcacgtagtatgaccgggaagtgtcctaggaaccagaacaatcaaagataatcattctcttcacgttctcattagcaaggggataaatactgtggtagataaataataataacactaatctaaggaactctcattctgatatgaaattaattcagggtgttttaatttgcactgtgttgtaaacgacaaaatctgatttagtgtttggatttaaaagagggaaaagattaaaacagtgatggtactgaaatagaaaacagttaagatagctgttacctttattacactattacagcattatcacgtcttctaacaccttgactactgagacgctctggcagctgaagcctctgagactaggttgtaaaaggccattgtgtatttaagaactcattttaggctttaaagtcattgttatttgatctcagactgttacatttaccattatctttatctgaatccaaggattgtgattaaaaaccctaaaaccctgaggttaggaaagtttgaaggtgagaaacacagggcttgtgagtttggagcctctcgaggcagttttctgctctgtgttgctcacattcacgtgagaccggctgtggatgagggacgtcaccgggagtgactttgtggcagtgacaccgttgcggtggccccagaggactttcctccctacaaccttccccgcggtttctgtgctgaccttgctgcaggcacttcatgcactaagaggggatttgttttgtgccggccttgttccagtgtccaggcagctctgactgttggagtcattgcttttactcctcttgactccagggactcaggatgagtttgaagctttgatctgctaggagaaggttctcagggccctcccgctccctgatggtgtcatttcagctgggcagatcccagccctgtgacgacggtgtgtgcactgtccgcgccccccctcgccacccccacatcacagacagatcagaagacaggccaacacttggttttagcttttttattttcattctctctcctgaagttttgtctttagaatccctgatgcttttctactttcactcattttccattcttgcctaccagttccccctttgctcagctgcccccacttcaagtcgcttgcagaccatgatacgcaggaagcagaatggactcatgtcctagactttgacttgcagaagctgtgctctccgtatggtttaatacgcacatttgtctgtgatttgtattcataggcaagctgtggacaagaagtatgaaggtcgcttacagcattctacacaaattaggcacaaagcaggaacccatggtccggcctggagatagggtaagtgcaacttaaactgctggatctacaaaacacaagagtcctgtgggaaaaggtgcccactgtttaaacattacagagttcagcgccacctccactttctattggaaagcaagtttttattcttaactgctacctggtaagttacacaggacagatactattaatggtgtctccattctaacattacatcctgagcaggtaatggtcttgtccatgctttatgccccagtttagatgtggagcttggtatagaagctggttttcttgcatttatgtgtagagcctttttacctatgtgctttagatgcccccaagattaggttatcctacctaaaggactccaagtgaattacataaagacatcatttagagctccataaaccaacaagagcatgagctttgattacttaagcaatactataaaggcatgagtctgctgtgggcatgttcaacagattgcagcagctccaggagaccgtggcctgggattctttcccattttttattgaacacgtttggcctcttttaaaagtaaattgtaggtgtcatatttcctgatcgtaaaatttactacaaagcttataataatcacaacaatgtggtactggcttagagacagacacatacaccagtggaacagaataaagggcccagagataaaccctcatgtatatggataagtgatttccacaggtgccaagatactcaacggggaaaggacagcctttccaacacacagtgctgggaaaactggacatccacctgcaagagaatgaaggcggatgtttacctaacatcatatgcaaaaaattcattcaaaatggaccaaacgcctaaatgtaagagctaaagccaaaacctagaagaaaacataaagaaaatgccttagaagaaaatatagagaagacacctcatgaccctggatttggcaacagtttcttggatgtggcacccgaaccacaggcaacaaaaggaaaataaataaattggacatttacattaaacatgtttgtatatcaaagagtactatcaagagagtgaaaaggccacctacagaatgggagaaaatgcaaattatttgccaacagagattaatatctaaaatatttaaagaattcctacaagtcaccaccaccaaaaaaagcaacaacaacaaaaacgtttaaatgggccagagacttgagtaaacgtttctccaaagatttagcagtggccgataaacacatgaaaagatgctcagcatccttgatcagggaaaagcaaagcaaaacctcagtgaaatgctgctttacaccgagaagcacggcaattactaaactactgaaaagggcacgtgttggcaaggatgtggggaagtcggaacccttgcgcattgctggtgacagtgtaaaatggtgcagcctctccgaaaaacgtgacagtccctcaaagaattaaacatggaattactgtgtgatccagcagttctgcttcggggtgtgtacccaaaaggattgaaaacagagtctaggagagagatgagtacactcaggctcatagcagccgactcacacaaccaaatggtggaagcaaccccaaatccacggactagatgtggatttcccattagaagggaggaagttctgacacataacacatggatgaaccttgcagatactatgcctagtaaagtaagccagacacaaaacaggtattgcgtgattccgttcctgcgagcgtaactacccaacagttcaccttgcccgctgcctggccagagccgatttgtctagacggggattgcaatggagaaagtgattcacgcagagctggctgtgcgggagactggagttctattatttctcaaatcggtctccccaagtgtttgaggatcgttcagagtttttaaggataacttggcgggtgagggcttgggaagtggggagtgctgattggtcaggttggagatgggatcgtagggggtcgaactgagtttttcctgctgtcttctgttcctgggtgggttcgcagaactggttgagccagatgacctgtctgggtggtgtcagctgctccatccagtgcagggtctgcagaatacctccagcactgatcttaggttttatgatagtgatgttatccccaggagcaatctggggagattcagactgttggagccagaggctgcatgacccctttagggtcatgcagtaatttctaatcttgtagctaatttgttagtcctacaaaggcagactggtccccaagcaagaaaggggtaatttcgggaaagggctattaccagttttgtttcagagtcaaactatgaactgaattccttcccaaggttagtttgttctccacccaggattgaacaagggacagcttaaaggttagaagcaagatggagttggttaggtctgatccctttcagtgtcataatttcctcagttatcattttcacaagagtggtttcatgacatccctagagtagtccagctgtagagaaacaaaagcagaaaggttaggtgccagggactgggggagaggaatgcaaagttcgtgtttaatagggacagagtttccatttgggaagatgagaaagttctagagatggctggtggtggcagttgtataaccttgtgattgtgcttcatgctactgaattctacgtgtaaaaattgttagaatcgtaaattttgtgttaccacataatgaaacgttaattgtaatggaatagctcctttatctgtaatgtggtttgtagtcttaagagttgttttaaaaattctttcatagtatggcctccagatacttgaagtttccatatgataataatcacaaaataaactcctgtgttcctctaagatgtcagtagagatacgggagcacggtttgatgaaatatgtaaagaggcttattttgggcagggattggtttggcttggttgggtcaggggtgaaggcgctacttttctaaaatttttctgaggaaagattatctgagaagggctctcgaggagaaaagatgagccggtagctcttgggcgggttccaggaagtagcgtggaaggtgctgaagcctttcgcctggacagcagggccggctgtgtgaggagccctggaggggagctgggaatccttcagccggaaaggcctttgctcccctgaagagttgagtgtgcgtctcctgatcggctgatgcctgctgtgtgaataattaggtacagtgaagtatcaaagaagtacacagaggattgaacggagggaagccatgtgggtttacaaaaatcgagcgtctttgtatttgtccagtattgtattgggatcactatggaggtagcaatacaacaggatttgtgactgattcaaatactgaaggaatgcctaacaaaaatgatgtaagtacaacgttctcttccttaaaacaaattgcaaaaaaattttcagttttgatgctaaaagagcctttaagtattttacccttttctatccattacttgtattgttgtgtgtgtacaataatgtacaattttatattctgcttttattaactttgttataccacatttcagtacaactctgcagtggtctataatatgaaattttcagcattaactctagtgataaatcagtgagaattttaaacccctgataaagaagaacttcctttgagcagaggcaacaggagctgggagaggaggcagacacgaggtgcttctcgggagagggctgatcgccgtctggccgtggggatgacacgcatcctctccgtctcagctgtctgcccttggtgaagactctgcctccagagctggtattctgggaagattaacaagtcagaactgaacatgttctcatgaatgggtgcaaccatcagttttggatggaacttcaacatctgaattttctaacgtttcctggtgttttttggtccgccttaggggaagaagttgtacagcagtggtaatgtggaaatcttacaaacatttaactgaatactgtttgttcaccatatcaagatctgaaaaacatgccatcagctctcagtccgtcacatgacactcatgcctagtgtaaacctcggatagtttgaagaaataattggttgtggcttatccgcatagatgtacaaataattttattccctttctaatctctcttagcaaattgtagtggactatagaaattccatacagaaaggaaatattcatatattcatagaatctacaacttaattttgtgtctgccagtgatcctgcattccgacctttccagcatggcctgctcccctctcaatgaccatctggatgcttttatgtcagcctgcttacttagatacacagatgattaggatgtttgtctaaaactgttcgtgatgaaattacttccagttaggacatttttcataaaaaattgtttaacttcaagaatgaggcctggtgcggtgactcatgcctggaatcccagcacttcgagaggctgaggtgggcagatgactaggtcaagagattgagaccagcctggccaacatggtgaaaccctgtatctacaaaaaatagaaaaaaattggctgagtgtggtggtgcatgcctatagtcctagctattcgggaggctgaggcaagagaatcgcttgaaccggggaagcagaggttgcagtgagccgagattgcactactgtactccagcctgggtgacacaacaagactctgtctcaaaaaaaaaaaaaaaatccagaatgaagtaatgcaaaaatgatgcacatgtgctaaatcataggattcacgtgctgatgaacacataccaaacttgtccataaggaagagtaatgctaatgctaccacacatgtaaaatcataggattcatgtgctgatgaaaatgtaccaaacttgtccataaggaagagtaatgctaatgctaccacacatgtaaaatcataggattcatgtgctgaggaacacataccaaacttgtccataaggaagagtaatgctaatgccaccacacgtgtaaaatcacaggattcatgtgctgaggaacacataccaaacttgtccataaggaagagtaatgctaatgccaccacacgtgtaaaatcacaggattcatgtgctgatgaaaacgtaccaaacttgtccataaggaagagtaatgctaatactaccacacatgtagaatcacaggattcatgggctgatgaaaatgtaccaaacttgtccataaggaagagtaatgctaatgctaccacacgtgtaaaatcacaggattcatgtgctgatgaacacataccaaacttgtccataaggaagagtaatgctaatgctaccacacatgtaaaatcacaggattcatgtgctgatgaacacataccaaacttgtccataaggaagagtaatgctaatgctaccacacgtgtaaaatcacaggattcatgtgctgatgaaaacgtaccaaacttgtccataaggaagagtaatgctaatgctaccacacatgtaaaatcacaggattcatgtgctgatgaacacataccaaacttgtccataaggaagagtaatgctaatgctaccacacatgtaaaatcacaggattcatgtgctgaggaacacataccaaacttgtccataaggaagagtaatgctaatgctaccacacatgtaaaatcataggattcatgtgctgaacacataccaaacttgtccataaggaagagtaatgctaatgctaccactcatgtaaaatcataggattcatgtgctgatgaaaatgtaccaaacttgtccataaggaagagtaatgctaatgctaccacacatgtaaaatcacaggattcatgtgctgaggaacacataccaaacttgtccataaggaagagtaatgctaatgctaccacatgtgtaaaatcacaggattcatgtgctgatgaaaatgtaccaaacttgtccataaggaagagtaatgctaatgctaccacacatgtaaaatcacaggattcatgtgctgatgaaaatgtaccaaacttgtccataaggaagagtaatgctaatgctaccacacatgtaaaatcacaggattcatgtgctgatgaacacataccaaacttgtccataaggaagagtaatgctaatgctaccacacatgtaaaatcacaggattcatgtgctgaggaacacataccaaacttgtccataaggaagagtaatgctaatgctaccacacatgtaaaatcataggattcatgtgctgatgaacacataccaaacttgtccataaggaagagtaatgctaatgctaccactcatgtaaaatcataggattcatgtgctgatgaaaatgtaccaaacttgtccataaggaagagtaatgctaatgctaccacacatgtaaaatcacaggattcatgtgctgaggaacacataccaaacttgtccataaggaagagtaatgctaatgctaccacacgtgtaaaatcacaggattcatgtgctgatgaacacataccaaacttgtccataaggaagagtaatgctaatgctaccacacgtgtaaaatcacaggattcatgtgctgatgaaaacgtaccaaacttgtccataaggaagagtaatgctaatgctaccacacatgtaaaatcacatgattcatgtgctgatgaacacataccaaacttgtccataaggaagagtaatgctaatgctaccacacgtgtaaaatcacaggattcatgtgctgatgaaaatgtaccaaacttgtccataaggaagagtaatgctaatgctaccacacatgtaaaatcacaggattcatgtgctgatgaaaacgtaccaaacttgtccataaggaagagtaatgctaatgctaccacacatgtaaaatcacaggattcatgtgctgatgaacacataccaaacttgtccataaggaagagtaatgctaatgctaccacacatgtaaaatcacaggatttatgtgctgaggaacacataccaaacttgtccataaggaagagtaacgctaatgctaccacacgtgtaaaatcacaggattcatgtgctgatgaaaatgtaccaaacttgtccataaggaagagtaatgctaatgctgccacacgtgtaaaatcataggattcatgtgctgatgaaaatgtaccaaacttgtccataaggaagagtaatgctaatgctgccacacgtgtaaaatcacaggattcatgtgctgaggaacacataccaaacttgtccataaggaagagtaatgctaatgctaccacacatgtaaaatcataggattcatgtgctgatgaaaatgtaccaaacttgtccataaggaagagtaatgctaatgctaccacacatgtaaaataggattcatgtgctgatgaaaatgtaccaaacttgtccataaggaagagtaatgctaatgctaccacacatgtaaaatcacaggattcatgtgctgatgaacacatacgaaacttgtccataaggaatagtaacgctaatgctaccacacatgtaaaatcacaggattcatgtgctgatgaaaatgtacgaaacttgtccataaggaagagtaatgctaatgctaccacacatgtaaaatcataggattcatgtgctgatgaacacataccaaacttgtccgtaaggaagagtaatgctaatgctaccccacatgtaaaatcataggattcatgggctgatgaaaatgtaccaaacttgtccataaggaagagtaatgctaatgctaccacacatgtaaaatcacaggattcatgtgctgatgaacacataccaaacttgtccataaggaagagtaatgctaatgctaccacacgtgtaaaatcacaggattcatgtgctgatgaacacataccaaacttgtccataaggaagagtaatgctaatgctaccacacgtgtaaaatcacaggattcatgtgctgatgaacacataccaaacttgtccataaggaagagtaatgctaatgctgccacacgtgtaaaatcataggattcatgtactgatgaaaatgtaccaaacttgtccataaggaagagtaatgctaatgctgccacacgtgtaaaatcacaggattcatgtggtgaggaacacataccaaacttgttcataaggaagagtaatgctaatgctaccacacgtgtaaaatcacaggattaccaaacttgtccataaagaagagtaatgctaatgctaccacacgtgtaaaatcacaggattcatgtgctgatgaacacataccaaacttgtccataaggaagagtaatgctaatgctaccccacatgtaaaatcacaggattcatgtgctgatgaacacgtaccaaacttgtccataaggaagagtaatgctaatgctaccacacgtgtaaaatcacaggattcatgtgctgatgaaaatgtaccaaacttgtccagaaggaagagtaacgctaatgctaccccacatgtacaagtaacctgtgttaaaatagaagcagagttcacagggcttagtgggaatccagaaatagggttgtctattaacactctatcatcgaaggaaaattgttcttcgtcaagatacaccatactgttaaggaccatcagaaaacatactggccaggcaacagtggctcacatctgtaatcccaacactttgcggggaccaaggcaggagaatcgcttgaggccaggagtttgaggccagcctgggcaacataacgagaccccatctaaagatattttttaaaaattagctgcatgcagtagtgctcacctgtaaggcaggaggatcactggagcccaggagttcaaggctgcagtgagctatgattgtgccactgcactccagcctgggtaatagagtgaacttgtttctttagaaaaaaaatcataatatctattagtaggtaccaatattacttggtaatttacattaaccacacttttagaactctgataattctactcttaggaacttagttcttaagagaggctgagctggcaggatgggttggtgccacatccaggcagctacacagggaagactgctgcagggccagggcccacaacacatgcacgtgtgtggcaccaggggactgatgctgccaccagccctagtgccagtaacttgggctttactcatagtcagcctccacgaactcacgccatgtgtgaagcagcccactgagttctctatgtgcattctctcatttgaccttgaccaccgcattaagacatcagctctatcattattctcacttttcagagaagaacactaaggctcagagaggccacaattgtgcctgagatcccagagccaaacactgccatgggatctgagctgagtcctgcacatgctgtcccaggacagttatgaagactgtatagaaatacaaggaagtatttacaaagcttagtgagaaacagtaggatataacttcatctatgtggaaacgtgtgggtatggaaggtagtatgcagaaaataaaggcagttgtactctggtgacagtatcatagacgactgttcacgtttgtcttctatatgaattcaaggccgggtgtgtgatgcttattaaaacacagcttactgaaatgcattttacataggatctggttctcactgaagcgtgccctctcacctagaaccaagctcttccgtggcgtcttaggaagccaggaccccacgttaatgctgacccgctctggcctgtcccacaggtggcactggtgttccccaacaatgatccggctgccttcatggcggctttctacggctgcctgctggccgaggtggtccccgtgcccatcgaggtgccgctcaccaggaaggtaaggaatgcgccctttgctcggtttctcgctgagtgagatggctttcacggtggctgtatcccggctgggtgagggtctcctcgctgtttctggggccctgggtttccttcggttgcctcgataagggatgcggtcgctagtgggccctgcagcctgggatgggcgtcctggaggtggagcacagcttgctttggggtcaaacgtggatcagcagcctcttggtcagtaaagcaagggtgtttgagaatcttgttccttggtgtcatgtgcactagaattggggtaaatgatagtttttttttaattattattttgaagggtggtggatgctgcttttgttcaggtgttttgacatccagtccaaggttgacctatgatttgtcaggttttattctataatgaaaataagctactaaacttgccattgtaattattgtttaatccaatgtaaagaaattaatgtgcgttgtcaatcaaaaagtatttgagacaggtttcaatttagaattttattttgccaaggttgaggacgtggccatgccacagcctcaggaggtcctgagaacgtgtgcccagggtggtccggctgcagcttttgggttcgtacattttagggacacatgagacattaggcaatacatgtaagacatatgttcatttggtctagaaaggtgggacagcttgaagccgcagtgggggccttccaggtcacaggtggattctaagattttctgattggcagttggttgaaagagtttatctaaagccctgaaatcaatagaagccagtgtcttagggttcggggttgtggagaccaaggattttattatgtggaggaagcctccaggcagcaggcttcagagagaataggtgtaaatggttcttatcagacttaaaaatgtgccagactcttagttaattctcccctggatcaggaaaaggacctggaaagggaaggagattgtctacagaatgtagattttccccacaagagagagctttatagggctatttcaaactatgtcaaagaaatatattttgaggtaaaatacttcgatttctttcagggcctgctatttgtcatgttggtatcttattgctccagagagtcagctttgtcagtctggaggtgtctgttttaatgccattgctggtcaactgtgtctgaatttcaaacagaggatgagggagtaaggggggcatgtccgacccctccttcccatcatggctgaactggtttttcaggttaactttggaatgtccttggctgagggaagaggtctcttcagttggttgaggggcttagaattttatttttggcttacgctcataccaatgtaaggttttagtccatgtggatggtttgttcttctgtaaagcagttacggtaactgtaagagacatgaagtggggcggctgcagtgcaggtcacgctgctgctccctgtaggcggccagtcgtgtaggaggaagccagcagcacgcgccccaagggactgcccaggtctgaacctgcaatgtgcctgtgcacactgcccttaaaccatcagctcccttcagcacttttttttttttttttgagatggagtcgctgtgtctcccaggctggagtgcagtggcacgatttcagctcactgcaacctctgcccctcgggttcaagcgattctcctccctcagcctcctgagtagctgagattacaggcgtgtgccaccacacccggctaatttttgtatttttagtagagatgaggttttgttacgttggccaggctggtctcgaactcctgacctcaggtgatctgcccacctcggcctcccacagggctggaatgacaggtgtgagccactgcgcctggcccctttagcacatctttaatgtgtgcacagtgtgggtgactcttccagctctaaaaggcaacaatcacaggtagcccaggcaaagaaacttcagctgtctttgtggctactccagcattaaagtttgttgactcaatatttaagaaaaccatctgccacgtgggtatctcttcagagtctgtgccagttacatggttgcatttcaaacttccccttggatgggaagggagagaacacggggttccttttggaaacaggaaagatgattgctattttcatttcctatgtacaaagccaggaggttcatgcttggcctcctgagtatgctcgtgtctggcagaggcaggggagtctgtggtagctgctatgggagaatgccagtttcccccccaccggatttgcagccagtttcccccccccccaccggatttgcagccagcactccacgtgtgcatcagacagctcagacttcccgtgaggtgctttctcatcccctgggtcccatggtcttcacaacaggtgagaaaagtggaaggactggaggactccagtcatgcttacatgacagcctcagtactatagttaaccccagtcctgggatctagtgaggagtttacaaggcttctcttcagctgatgttcatgtccatggttaggggctctctggacatgctctgaggtctctaagcgacagtgaaatgatgatttgcaggaacttgtaggcatgagcatatggtgatggttcaataaccagacacaaaacatttatcattgttattcgtaacaattattcttttcttcactttaataatttgtatttatccatgttaaagtgtatagcctggtgtcctccagtccaggctggtttgtagaggaaaatgatttggataaaggggggaggtggttttcctgagcatgttggagtgctgctctcaggttggcagaaatgccatcctattatctcaaatcctaggcatagctccaaataccaaggtggcatttatttcagccatgaaacgtttcactgtaacacatttaagatgctttgaaataatgaattaagtacctttgaatggtagtagagacataaaccgtacgttttgaacaaatcagaaatctttccaaggccacgtggctgggaagctgtggcagtgatgatggaggaagaggacagttttcctctcccacaggaggacccaacagtccccctcagctgagagccccttgtacccgagtagaggctgcacgttcactgtgcacagggcagggtccacatggggatgaggggcatctcggggggactctctgtggtccgagggcagggagcatagcaggagaacagtgtggggacatttcaggaggccaggacttctcacgctgggaggtccctggggacttacgtgtcagtgactgtaacctgtgcatgtgatgaggacacggggacaggaaagatcccctgcctgtccctcacctccaggacatagggaggggccctctgtggctatggttttatcaccaagcaccaaaacccctctcagaagaaagggctgacattcctgtcttgccctctctgtgccaatataaccctgaggtgactttgcctacagatgcctcaggctttgcagaaagctgtggagaacgcacagaccttaacaaggcatttagaaacctttactgtgccaaccagtggtcatgggatagaatgctagggaagccacaagtgatttcacaggtgaagtacagagaccctcccctgaggccgagcctctcaggtctaaagacaccgtgacttgattttactttttaaatattattttaactgacaagttataattatatacatttatggggtagagtgtgatgttctgatatatgcatacgacgtggaatgtttatcaaactgattaacatatctgtcaccttgcttacctctcattttttatggtaagacatttggaatatactcttggttattttgaaatgtagattacattttcatttattatagttaccctgctctgcaatagatctcaaaacctcttcctccaatctgaggctttgtctcttctgaccaacatctccccatgtcctccctcccccccatctcctccctcccccaactcctccctccccccaactcctccctcccccccagccctcgtggtcaccattctattcactgctaaatgccacgtgtaaatgagctcatgtagccttggtctttctgtgcctggcttatttccggcagcctaatgtcctggttcagcatacggcaggcttccctcctcactgacggctgaatagtgcccactgtgtggcacagtgtccttcctgttcagcatacggtcaccttccctcctgtctgaaggctgaatagcgcccactgtgtgaggtaatgtccttcggttcagcacagagcaggcttccctcctccctgaaggctgaatagcgcccactgtgtggcctagcgtccttcctgttcagcatgtggcaggcttccctcctccctgaaggctgaatagcgcccactgtgtggcctagcgtccttccggttcagcatgtggcaggcttccctcctccctgaaggctgaatagcgcccactgtgtggcataatgtccttcctgttcagcatacggtcaccttccctcctgtctgaaggctgaatagcgcccactatgtgacgtaatgtcctttggttcagcacagagcaggcttccctcctccctgaaggctgaatagcgcccactgtgtggcataatgtccttccggttcagcacacggcagacttccctcctcgctgaaggctgaatagcacccactgtgtgatgtaatgtcctcctggttcagcacacggcagggttccctcctcgctgaaggctgaatagcacccactgtgtgccataatgtccttccagttcagcacagagcaggcttccctcctccctgaaggctgaatagcgcccactgtgtgacgtaatgtccttccggttcagcacaggcccggcttccctcctcgctgaaggctgaatagcgcccagtgtgccggctctgcctgctctgcatccattcgtgggtctttgggcactgtggttgatttgtcttcttgacccttgtggataacactccagtgaatgtagggatgccgataatctggattcctgatcaatttcagttcctttggcccaatacccagtagcaagattgctggatcatatggtagttctatatttaggtttttgagaaatctccataccattttccataatggctgtgctaatttgcattcccaccaatagcgtgcaagggttttcttttctctgcatcctcatcaacgggtatttttcctctttttgataaacacgttgtaaccagtgcaagaaatgtgaggtgatgtctccttgtgggttgttttttttttttttccttttcctttttctttttctttttttttcttttttttttttttttttgagacggagtctcgctctgtcacccaggctggagtgcagtgacgcaatctctgctcactgcaacctccgcttcccgggttcaagctattctcctgcctcagcctcctgagtagctgggattacaggcgcgtaccatggcacctggctaatctttatatttttagtagagattggggtttagccatgctggccaggctggtcttgaactcctgacctccactgatctgcctgccgtggccacccaaagtgctgggattacaggcctgagccatcgcgcctggcttccctgtggttttaatttgcgtttccctgatgattagtgatgtggagcaccttttcatggacctgttggccatttgggtgccatcctttcagaagtgtgcctttagaaagtagcagcttattggtcttagagaacttttcttatttttaactgaaagaatctgttggctatggtgcaagtcaaagtgaggtcagatgagcatattcgtgtagttaagtatgtgaatcctaatattgcttccatctgccagtcctacagccgctagaagtgtcttcgaataaagaccctgatgagaacctagttttctgaatgcatcctgggaggattctttttattcactttcctgagatgtagcacctgtttcccggagttggcctcagatccagccagactgaggccgacgccacctttccaaggacagaggactgaggcctgtgagtcaggaaagccactagtccaggtgcagccgggtcccgtccttgggtcaccggcagaggtcgtgaggcccactgaggacccgcagccctttgcttcaggtgctgtgtgcagggtccatctgtctggtccctttctttgttgagtgtgtgtgcgcgcctgtgtgtgggcacgtgtgtgtgagtgttgagtgtctgtgtattgtgtggggacgtgtgtgtgcgtgggcgtgtgtgtgtgtgtgcgctgagtgtgcgcatccgcgtgtgtgcatgggcgcgtgtgagagtgttaagtgtgtgtgtgtgtatgtgagtgtgtgcgcgtgtgtacctgggcgcgtgtgtacctgggcacgtatgtgtgttgaagactccactgggctgcctcccacatgggtgtgtagggtgagacatggttaagtgctgttctgagcacactggccagggctgggcagagctgtgctgagggctggcgtctgacggggccgcggggggcactctacacgtgcggaggagcagcaggcccagcctcaccttggctgaatagcagccgcatcctcccaggcctgctgctcctgtggttttcagtctcttccttattttttgggatcttcttatgtgtatgattttatcatttgggggattaaatcacgggcggacactaccagggcagggtttagcgaaaggttggctcctggcctgaggtcagcattccacccacagccatgagcgactggcctcagccgttcctccgtcttgtgacagtcacgcgtgttctcctgcctcggcccggcacttcctggctcagcagagccgccttcctgctgcagaagctgatgtcgccccacctctgcccctcacctgtgtcccttcaagagtcgggacgtttgctaatgtgatgttcagattcacattaaagtgactgattagggctttacttgagcaagcagcatctgtgtgaaaagcaccacaagatgtccccgaagtgggttccatctgtccgcagagctcccggcggccagatcttggggagctgccctgcatgtgctggttggctcatttggctgttgctccatgaaaattccacagagaggcgttttcactgtagatttaaatctacaataagaaaagtactaaacacttaagagactacagctttgaaattttaaatctgcctaatttacccaggtgaaaacaccactcttcagctcatgttttcctgttatcagggaacaggtgggaagatccacagccaggcctctgattactgacagcaaccaggccttgtagggtccataattgaggggttcatgctgagccatctggggagcgaagacggtgacttgctcactacaatgtggcatttttaggtcctggaaccctggctgttttggagctttcagtttattttatgaatcaaataatggaaaacccacacagctggcacagctggtgggcgtagagagagtgatgcgagtgccttggctgctcgcccacctgcctttgggcagctggacaggagtgacgactggcgtaggtctgttcaggtctgaccttcccaaaccggagctggcagcctggagccacctgtatctggtgtctccagtggggctgcacagcagtggcctgtttcagcaagcttcagttagttcgttgagactgggctgctcagggtgaggagaaagtgacccaggtcttccttcctctggccgaggtgccctgcctggcacccatgacaggtgtgcctttcgtgcctttggtctttgagtgttttaaagatcaggcacttggtgttagcatgttagtagaagtgttttttcaggccctgtctattctctacagtaattgcattgtataatcatagtcttatggaattggagagagctataacagcaggctcttaacgcgacccgctgaacgccagcctgcactgagcactttccacaccctcttctaatttatccctcaacaaacctgggagacagctgttctttctatacctgttttacacgtgaggacactgaggccatgcagtctcacctgttcagggtcccacagataccaagcagcagggctgggggttggatcctggttctgcagactcgagggtctgtgtgaacgctggagggagggccgaaggctgggcggagtggggcaggtcgtggattctcaactcctctctgttgccctctcaggacgcagggagccagcagataggtttcttgcttggaagctgtggagttactgtagccttgactagtgacgcctgccataaaggacttccaaaaagcccaacgggagagatcccacagtttaaaggtaagccaccgagcctccgagagctcgcatgcccacgtcctttgtcagaagacgggtgcgggaatacgtcaccccgcctcggtttcaatcctctgtggaatgaaacgtcagtcacagacccacgagttttcacgcgttctcgtccctgatgacacagccgagttgccagcccgtggggtgacgtgaggtaacgcatggtggcggcttgggtgctcttctgttgatgtcttagatctcgtgaagtccggagacaccagagattcgatctagttgacgtgtttgaaagggtaccacataaatggggagaaattctacagaccgactttcagagtaacatttaaaaggaacttgttgtttatttccaaggttggccaaagctgctgtggtttgtcacagagtctaaacatctctccaaaccgccccgagactggttcccacacattaaagatgccaataacgacactgcgtatattgaggtgagtcagccttggcctcctccactggccctgagtgtggccttggcactaacgtgtgtttctgacggttacacgagtgccaaaattcagggacttggagaacctcaagtaaccagaaaaactgccgtgacctgtcagccccacttccctcacgctttgtctcgtttcagtacaagacgtgtaaggatggcagtgtgctgggtgtgacggtgacgaggactgcgctgctgacacactgccaggccctgacgcaggcgtgtggctacacggaaggtggggtgccagaccctgactccttgggaccctggttctaaccgggacacctgacacgaaggccacatcactcccacgaggagccatagaaatagcgtgaagtttgtgcccagctccgctgacatgaacttattgttgagttaggatatcagctcagcctaccatagcaaatactacagactgggcggcttcaacagcagacatttatgtccgcacagcgcggaggtctgaggtcagcgtgtccttgggcagttcccagtgggggtctcttccaggtttctcgtaggaggtgtgagaagatgtgcagttaggaacccatccctaccaccccactgaatgcaaaggacctcctgaaaggtgcgctctccacacagccacgccggggcctgggcttcagcatgtggatctggggagacgctgttaacgccgtggagcttcatccctgggtgcacatgagcatatctttagttgtaaagaaaacgcctgtgtgtccacccaccctcccaattgagtcagagtctctgcattggtgctcgtgatgtgttttccttcccccgggtgggctggtatgggaggcaaagaggggaagtgagtggagggaacttgagtggagggaactgtggcaaccacactgaaatggcacagagaggggagggtgcgaccccggggaccccagagactccccccattggtggcctgagtcctgctgatatcccctgaaacctcctgagatgttctgagacgttgtgatgtaccctgaggccctttgagaccccttgagaacccccatgcccctgagatcccttgggatgccctgaggccctttgagaccccagagaacccccatgcccctgagatcccttgggatgccccaaggccccttgagacctcagagaacccccagagaacccccatgcccctgagatcccttgggatggcccgaggccccttgagaccccagagaacccccagagaatccccgtggccctgagatcccttgggatgccccgaggccccttgagactccagagaacccccccatgtccctgagatcccttaggatgccccaaggccccttgagaccccctccggagaccccctgaggctccctgacatccccttgaccaggctcctgacagggcaccgctgcggcgtgcacccctgcctggcgtctctttctggaacttcacgaagccgtggtggcatctgccgctccgctgtggaatgaaacacttttctttttctactatttttattatctgcccatcctcataatctcccttttaaaaacagcgtgtgtgtctcgtgggtattctgatgtttggccatggagttttcacacctggggacgcactgccccctgcgcctccaaggtccagggtggtcacgcttgtggaggttggggagggaatgatacgttcgctctttacttcactactttcaaaaggaacttaggttgtttacttttggccatttattgtgaaagcctcctgtctattatcctccacactttagcctttggaaggggaggtgagactgagtcacctgcaggcagctgctgaccttggctggccaggtgacttcgggagaaagctaggtctgttcagggccagcatgctctgtgatggtaaacctcatcaagcacgagcttttagcacctttttagagccctcccccatagtcattgaatagattgtcctccccgtcttccaaattgcagtgcctcctttttttattgcagctccaaccttggagacttgcagtagagctgtgtaggcccctgtgttgccaaaaatccacttcctcctctgtgcgcagagggcatgccagctgcaaagcttcctttcctgggagactcatgaggaagtgaaaagaaatcttttaaagaaaaaggcagagagggggaaatatataaaaggagaaggaacgctgcgttttaaggtgcagtgtggagagctaacgctgctcactcatgtgtcaggatatctgtcgagaaactccagggtggccggcactcaaaccggcctacttggagtctacagaatttccaccaagatacggcaaaatgatattttcccaagatctgttatttcccctgatgcaatattggattttgtttgcattttgatctgttgccgccctgtcctaagtaaaaatctcctgactccctctgttgtgcagctgaaaccattgtgaatgtgctggatttcaagaaggacgtcgggctctggcatggcatcctgacagtaagtgaggtccccccggccgtgtctgtccacaaaggagtcccccaccctgccctgcctgtccacacaggagtccccctccccatactgtctgtccacacaggagtcccctccccacactgtctgtccacacaggagtctccctcccaccctgcctgtccacacaggagtcgccccccaccccgccctgcctgtccacacaggagtcccctcccctcactgtctgtccacacaggagtcgcccccccgccgcccgcactgcctgtccacacaggagtcccctcccctcactgtctgtccacacaggagtgtgctgggtgtaggaatacaaatgcctagatttgcctacgtttcacttgtgcaagctgcttcctgccacactgtgaagcagaaaatcgtcactgttagaagaccgaggttgtccactaacgtggttcacaactgcaccacaaagccagttgtgtcagcagccactggtgtgagggtcttggacacgtggattgaggttacagctgccgaaaacagccttccagggctcacgtggagatcattatctttcttcccgcacttttggcattcagtatcttagaataacgtcaaaggttggttcgtgtgtgggctactgtcccgtacatctggttagctggatgtttctgtttgttgagtcggtggggcctgctattgtgttactctgcgggggaaagtagtttccagatttgcccttgaggatggcagtctgtgtgtgttgtagggaaacgactgtctcacagtcacgagtgccctggatgacgtgccgggcttgggcacttttcgtggggaagtagccttgttatttgtttaaggtgggcctggcccttaaaagctacgtggagcatgactgcttagacgctccccccatctgtttcatatgtggtaattttcactcatttttcttttgaataatttcttacgctgaagcttcttaccttttggaggtagaaaattctaggagttgtcacatgagtgatgggcatatgaatacaggaattcctgtattcgccgtttcttggcgaaccagaattcatgtgaagaggagccggcaagcatttcctagaccaaatatctgtggctgcagagcagcccggctggcttctttccgtgttacacacaggtcgtctctcaagtctggatgctgttgggggataagatggagcagcgtgttcccagcaccactgtgtgctggtgcagtggggagcccctgctttgggattgaaggacctgggataagatggagcagcttgttcccagcaccgttatgtgctggtgcagtgggagcccctgctttgggattggaggacctgggcttgtgtctcagcctttcctttcttagctttgtgactcaggcatgtcagacgtgcgtccaagtcccttctcaaatccaaacctcagtttttctgtctgtgaatggaacgacgatcctatttgacgtggccggtgtgagaattctgtggcctaaagttgaagcactcactccacctacacgtttgacgcatgtgattcaatgatcaggtcccaaagaacagacagctacatcactggtgccgttagtcactctcgtcattagaacacccaactttccggctgtgacgttgtccacacagccctgctttcgaggcctcgtcgcggggccgcctctctgaggagctcccgctggtggtgccagcctgcctgctccgtgctccggggtacagctggcagccctggcaggtgcgagtctctccactgtcacatctaaagcgaggtctctgagcaggcagcagcatcttttgagacacccttacctcccccagcagagtggcggggagtcggcagagctctggggagtgaaggcacatgcttttttgctttcatctggagcttcccaaatcgagccagtggcagaggggtctctgccctctcgtctgcccccaccccgtagcctacaagactgcaagaatcctagcccgccacacagcctgccaggtggtgcctggtctgactgctgcggtgtgaggcaggtgtgttgctgccgcccctgtaggtgtgagtcccagcctctgtgtgcagcagcgtgcaggtactagccagtgtttcccagtttatttttgtcagaagtagtaatctgccgcagcaaggcccggccagagccagaatccgagcttcccctagccctgcgattcagagcagtgtgcggttctcaagatgggttctgtgaaataaaagttagcataacacaccgggaagaattaggctttgaggatacgaaaggctgttgaaaatgacgatctgtttcaccaaaggtttcgtcttaaaaagatttggacttaaattacttaattctgtcaggagtagtttagggaaagcagtggagttcgagggagaccttgggaagtcgcttttcatggacatgttttaaaggattacacccagaccctaccgtgtcacattcatgcagaccagccatccctgccattcccacactgaggagcctccagggtcctgtgcgaccgctcctcctccaggcctgtgcagcccggtgtccgtggtgctccctgagagctgctgatcctcgggtcccgtgcagcctggcgtccacggtgctccatgagagctgcttctcctcccagcccgtgcagcctggtgtccgtggcgctccctgagagctgcttctcctcagggcccgtgcagcctggtgtccgtggcactctctgagacctgctgctcttccgggcccttgcagcctggtgtctgtggtgctccttgagaactgctgctcctcctggcccgtgcagcctggtgtccgcggcgctccctgagagctgcttctcctcctccttccctgggggcctgtgcagtctggtgtccatggcactcactgagagctgctcctccactatgcccctctgtatttgccatccctgccagccccaccctgaggagcctccaggggcctgtgtgcatggtgtctgcagcgctccctgagagctcccccctgcccgtgcggcctagtgtccatgccactgggtgagagctgctcctctgcgtgcccctccatgctcaccctgcgtgttcctttgttgattgcagagcgtcatgaacatgatgcatgtgatcagcatcccgtactcgctgatgaaggtgaaccctctctcctggatccagaaggtctgccagtacaaaggtgggtctcgccgggcgcagtggctcacacctgtaatcccagcgctttaggaggccaaagcaggtggatcacctgaggtcaggagttccagaccacccgggccaatatggagaaaccccgtttctactaataatacaaaaattagccaggcctgatggcgcatgcctataatcccagctactcgggaggttgaggcaggagaaatcttgaacccaggagaaggaggttgcggtgagccaagatcacaaaaaaaaaaaaaaaaaaaaaaaaaaaaggtttgtgggggctgggtgaccagtgattcttcacccttccccactactcacaatgatctctcttttgcaataggggacgatctgacggtggcacatgttaacttatttctatttttctttttagcaaaagtggcgtgtgtgaaatcgagggatatgcattgggcattagtagcacacagagatcagagagacatcaacctctcctctctgcgaatgctgatagtggcggacggcgcgaacccctgtaagtgaggagcgtgtgatctcgtgaggcaggcgggctgtggagtcttttttttttttttttcgtgaggcaggcaggctgtgaagtcttttttattttttccccaggtttcattctttgcactttgatttttctttttctaatccttatcttagtaaagaaattgtcttaaaatcaccaaacagtaatcactcactcgggccaagaggtacgatggcataataaggacaggcatttgtagactccacagccctgggattcagaggatgtcttgattctgtagagaaagttcctttgctgaccctgtttccccggctgtaaaacggtgcttaagtcataaattttcatgaggatgaagtgaagtaagccctaagcaggtaataaggaaatattcaagaaatacttgactgctagtactttttggtgtatagtagttttcttgatcagtaaattaatttgtcgttttaaatgtaattgcgttatcacatcctgtaacaaaaatacccagttaaagtaaattagcagctccacagaatactataaatacaccttgagaaatatttcagccaactgaaacaagaacctagctagcatgcttttgtgaaaaaagtacataaagcttcagaagcaaagtgaaattaaaggtatctgaccacatttatgaaacatgcaacgttcatgtttgtaaactaaagcagcataaactcctttaatgcctgatatacaaaagcagactcataaacaggttttataaacagtcttcacttatagaatttcataaatcctgagctaatttaatgaacaattggttttaacccataagtacaaaacaatacatcttgcataaagaaaagtatatctatatttggagatagtttagctgatatgttcttgataattgtgcctcgacctcatcatttaaattaatagagaggaaagttttcttcatttggtttagatttacccctgtcttggaacttctgtactgaaaatggtggaacaagtctcagaaaagttactaaagtaagttcatctgtcagaaaaggtgtcataaatgtggaggttgcattctttaaattcttgagttctgtttgagaataaccactttcagtgtaacataaataataaattgtattaaatatttttccacgctgcctagatccacttgtgcctgaatcccaccttcggaactattttctatggtgggattttgtaatcaatcacagtgcttcagctgtctgatcattgtccctctttcactctagggtctatttcttcttgcgatgcatttctcaatgtcttccaaagtaaaggccttcgacaggaggtcatctgtccttgtgccagctcgccagaggccctcactgtggccatccggaggtactgggtcatgttgatttacgtagataacctagagacagtcctaattcagcagcgaagggagatcaggaaatcctaacagttgatgctgagggtgagggtgaaaacgggacctaacctttcaagatgagtttatttctgtttttatgtgctggaacagattcttttgaacagcctagattcattcattaaaaaacatttatcgctctctgcagtttcacggtaattccttaataagtggaactgtctagaggcgcatggaatcgtaataccgtgtccttggaatttactccaatttccatgtgcgtgtaccaatctctggtttcttctggggtgggatagggtctgttttcatcagcctgcttttcttgtagtgttaccgacttccatgtgctgtgggatttactggtatatttattttttcattgtctgtctctggtgtatagttgatgcctaatacatattttttgagtgaatgaaagtgaaatttaaagtaggtaaattcagagtgcactttgctctgacaatctcatgtcatgcaccagaagtaaagcccaaacctcttcctgtgtgatacgcacacacttgacattttacctaagtggagccgtctgtgggtttggggttttgttttcattttccttggtcaacgtaggtgccactgacggcctaaatatgctgttgtaggagaacaggctcctgcagagaagttgtgtcggctgtcaacggcccatccaaggctggtccagagggaaggtgtggcaagagagaggaggtgtggtgtggggctcttggggcagcatgtccacggcaatactcccagtggtggggaagagaaggaccattcctttcctgtggggtgagctctggagtgtagagtgagtgcaggagacctgcttgcaacaggcttcccagagcagtgtgtggtttttaaattattgcaggcagaactgtggaagggcaggcattgaccaggacacagacagaaataacaagagcaggacgtgtctccctcccactgtcttgcctggtgttgcacgtgggcacgcatgtcaggtcggctgcggcctgctcccgtgcagtgtctggaggagtggtctctggacacggcccaccatgggttacagcagcccctctccagagccacctccctggagctggcttcagtggtcttctctggtgtgccacttttctgattggcgtgattgggctcaacacaccgaaggaccgaaaaggattaaaggtacaattttagcattccaggttgaattagaaatgacagtgtcctgaaaactagaagcagcccgcagtgtccccatgccggttctccctgcccctccatcactcagtctcattaagactgtctttttatgtcgttatcatgcatatgatgcatatttaaaccgttcagtgctgatgctgtaagaaagaataatctgtataattggccattgcagttggactccctaatttcctgagatgaattaggcagcaactctatctcagtggtgaaaatctttaggagagaagccaatgctggtccttagaacctgtacctttcgttaccctgatgtttaagttacttttgaataaatttgatgaaagcagcactcgtacttgcgtttccaccaacacatccctctctgcattgttttctgaatgtgtgaacagaagggaaacttccctctgtgcgggggtttcagttgtgtgccacagaaaggttgggacagatgcgtgtttttggaaaatgagccagtgcctgtgaactcaagtgtattctgtcttaaaacttgaggtgaatttcccatgtaggagtggtcagaggccaggttattaagtgaaaaacggctttcgtacattccgtaaagctgtactaagtgaggtctggcaaggcttccctgtaggttttggcatgagaacaaaatgaatgccttcttaaaggtcgtcacgtccaatgtgggaggcagtacagcgatctcattttatttactccttatgttttttaaagaagaaagacaagtgttcggctgctacattcccctgttttgttgcagagaagggtctgtagaggacggattatgcctgtttggatgggttcgaggatggccgtttcctctgtgttgtgatctaagcatttgtgtcctgcgtgttaaccatcatccagggacagcctcttctgcctgttaaccatcatccagggacagcctcttctgcgtgttaaacatcatccagggacagcctcttctgcgcattaaccatcatccagggacagcctcttctgcgcgttaaccatcttccagggacagcctcttctgcacgttaaccatcttccagggacagcctcttctgcgtgttaaccatcatccagggacagcctcttctgcacgttaaccatcttccagggacagcctcttcttcgtcttaaccatcatccagggagagcctcttctgcacgttaaccattttccagggacagcctcttctgtgcgttaaccatcatccagggacagcctcttctgcacgttaaccatcttccagggacagcctcttctgcgctttaaccgtcttccagggacagcctcttctgcgtgttaaccatcttccagggacagcctcttctgtgcgttaaccatcatccagggacagcctcttctgcgtgttaaccatcttctagggacatcctcttctgcacgttaaccatcttccagggacagccttttctgcctgttaaccatcatccagggacagcctcttctgcacgttaaccatcttccagggacagcctcttctgcgtgttaaccatcttccagggacagcccctgctcctggtatcaaagcagagactgaacttccaggtgctgagttgcagctggttggttgcttggctttcagtccacttaatttaaaaaggataacgattatctgcagtagaatgcaaataaaattgcagatgcatttgcttactatttgtagaattttggccctctctggaatatgtatcacttagtgattctcttctgcaaaaaagaaaacaaaaaagtagataaatcagaagctgaggcactcacaagaaagccacccagtggctgcaggtgccagcagggccaagcatggacatctgggctatgagtcagtcttccaggcgtcaaggtccagggccttcaagagccccaggtctgacagggatgcccacagcccactggctgtggagtatcttcatatcactcttgcaagcaacatagaatgtctgtcatgcaaaacagagcatgtcggaaagttctggggctcacaggatcaatggaacctccagtatcccgcttgataaatacgcaggatgcacgggcacttccgggagcagcagcagccctagtgatggggaaggggttggggtggggtagcggggcagggcgtacagaagccagcagcagctgtcaggggttgtggggggggggggggggggcgtggcactcgggagccagcagcagccctggcgatgggtatgtgggagcaggctggcgcctgggccgcaggtgctgtgccctctgtcaggttgcccagcgctgcaggcaggtcactgccagagcttatgccattggttctcccctcacagaaaggccagtctccaaaaaagaatgaccagcactcattttagggaggttgagagtctttaaaaacatgagtcggagactttgaagggacaagggctggtgactcgcctgtcctcacgcatgtctgtgtccgtgtctttatgcatgtctgtgttcacgtgtgtctaggcatgtctgttcacatgtgtctatgcatgtctgttcacatctgtgcatgtctgttcatttgtgtctttatgcatgtccatgggtgtctaggcatgtgtgttcacgtgtctaggcatgtgttcacatgtgtctttatgcatgtctgttcacgtgtctgtgcatatctgttcatgtgtgtatgcatgtctgttcatgtgtgcctaggcatatctgttcatgtgtgtctttatgcatgtctgtgttcgtgtgtctttatgcatgtctgttcatgtgtgtctatgtctgcgttcacatgtctgcatgtttgtgttcacgtgtctgcatgtgttcacatgtgtctttgtgcatgtgtgttcacgtgtctttatgcatgtctgtgttcacatgtatgcatgtctttgtctaggcatgtttgtgttcacgtgtctttatgcatgcctgttcatgcatgcatgccttcatgtctgtcttcacctgtgtatgcctgttttcgtgtttgtgttgatgtgtgtgccttcatgtgtgtctgttttcaccttcgtgttcatgtgtgtcagccaagtggtggcaggaaatcacgttctctagtgaagtctgctcagtcttgctacgtgaactgtattttcacctaggcatttaaagtatttttttctctttaaaactgtcactgtcctgttatattttgtgttttcttttctcccgatgttagttttagagtagaaaaatattggggaaataggggcttgtggtgcctaaactcatcagacattttttaaaggacaaattgcaaggcgaaaaccaggaaactgtttcctggctacaagtatcccctaaatctcctgccatctgactctgttaccatctctagaatgtagatgatagacttgattttcttaaagctacgttgtgaaatgtttattgaactgaaaaacataatttttagctttgtaactacaaagtactatttggataccctgatattttagtaatgaaaatgcaaaaatcatataaaacaatgaaacaataattccagaaaagataaaatacccccttgtcaccacaaccatcttctagtttttgaaagtatccaagctcgaagttagctgggagaaaaatcaaagaagacgtgtccgcagggagaagggtgctgtctgatgcccactgggtgctgatggtgcctggatgagtgacagcggagaaaacgtcagcacagccctgagccaaagtggatccgaagtgagcacttcccactgctcggaaaagtcagacccagagttccataatcccgcatgtaagagaacgcaagataaactgtgtcattttatctaaaaagagggataaaattttgcaattctctaactacagagtagtttcgagatgaaaatcacgtgacccagaccatgagagttaggtagcatcgaatagcaaaccaagtttcctgtttaatttcacccaaccacgtgcgttttacagtgtgttctgttttgtggtgaattagatgatgagaagttggttttggcaaaggaggtgcagcgggaagatggcagaggaggggcctccccacggggtcccccccagttccagcccataacctcccctggaaatagaaaggtggccaaggcttatgagaaagagtttgtaaaaaagtttatatagtgtgatcccgtttttggtaacaaaaaattaagtatctgtaaatagtatattcagtgcaaaaaaaaaaaaaaaactgcgctgcacagggtgggtgaggcagtaaagatgggcagctcactttccgtgctgtgcagcttgtaaaatgggctgtttttagtgggcatgcattgctcctgttagagaaaaggaagaatattacattaaatcaactcataacttaatatattggctgcttttacattgtatcttttcctattaaaaatcgcaatctcacttatctgttgtgtttttgaaagtctgtgtcacgctaaacatcgaaaaaggtacatgcacatttttcactgaatttcccctcgcggtgcgtgtttcctgaaaatattatttctgctgaaatgagttcacaagcttaactgctcctgtcctttaaagggcatttttaccagtactgtgaatttattagttcattctgctgctgtgaaaaagagtggcccagagaggaaagaaagcagaggagatgttctgtgttctgtgtgcgttgtgtggctgccccggcaccttcatcagggctgatttacgtccatctaaaagagaaacctttggtggtgaatggtgattcaagaccagagtagctgccctgtttaaaaaaaaaaaaaaaaagacacttcctcggggttctggctgccagttcagaagggaagaccccccctcccaaccccactctcaaacaggcttcctggtaacttcgcattttgtctggaaccggaatgcgtgttcccaaagaagcaacgttgtgcaggtgcttcgacgccagcacagggaacgtcgtgtgtgggatgagcaccacctcattcttgctctgtgccggctccgtcgggggccgaggtgggcctgggtccttctccctgccggctccgtcgggggccgaggtgggcctgggtccttctccctgccggctctgtcgggggccgaggtcggcctgggtccccatctcgctgctctcgcgcctgctttgtcatgtgggcagggcttcaccttgaggattcctcgtctgtagatgagaatcacagcagttagctacgtcagaggcccgtgtgagcattgagtgggttcatacacacacagagcttgaaagcacgcctggtacatagtaagaattcaacaaatgttaccgccgttacatgactgcaggcgtgttttgtgtgtggtccgttgcatagaaatgctgtgtaaagattgctggggaggaggggcctgcagcttaactctttcttctctaaatgtgccgttgttgctaagctgaggaatactacattggagatcgcccgtataagataaaaaaaatgaaagaccttgttgactcacttgcttaagggattcagcaaatgatgagcggcactgaagctgtgcaggtgcagtgtggctctctgttaagccctagaactggaggctgtgaggcttgttcactacttgatgtgtttgttttgtgtgaatgtcccaagcctggcctggctctgcttgtggtcaggagtagcaaactgcagatgtgttcatgaaatttataggagctgctacttcaaggtgttatgcgggcaaggcttatggaatgctttccagaggctggaaatgctatgacaagtcagtggtgcaaatggttcaatggaagccatagtgtacattcctcgtgaggccacattgcaaggtctggcctgcttctttcctttttgttggtgtgtttgcattgttataaaggaatgtgtgagactgggtaatctataaggaaaagaggtttattttggctcacagttctgtaggctgtaagagaagcatggctccagcatctactcagctcctggtgaggcctcaggaagcttatgatcatggcagaaggcaaagtgggagcctgcatgtcacatggtgagagattgagcgagcaagagagagagagaggaggtgcccagctctattctaaacaactagatcccacgtgaactcataaagtgagaactctcgtgttactgcgagaacaggcccacctgcattgttggacgtcacatttcaacgtgagatctgcaggcaacaaaacatccagactctgttgtcctttagttttattttgtttcccttttgcacgtcatcgtggtattgtatacacaggtacgtattttgctccttccatatctccaagagaggactctgcctccttacattcctggagatcactgagatggtccctcctggaatccatattcttcatgagacacacaaagctgtttggtcttgaacaccatttcacatgggaactgagtttggaagttgatgaatgggcggatacctttattagccattttttaatgtactgatattgattattaaggtggatgttttttaaaccccctcgaattctgcctatggggactgtttcttcccttcctcacctcatctacctacttgggatttttacttcttagcaaggtgttgatggagataaatatcatctaagtttctcaataatacagggaacacaaattggaccaacaaatggtgttttactgaacaaattgggaagcattttaagtgttggcaagagtgcagagatgggcactgctgagcagcttggcgctgtggtcagatgcacagattctgaagccagactgagattggcgctggctccactccacagcagtggctttgggtagcactcagccctcctcgcccctgcccctgtctgctaaacagggagggtcatggtgctgcacccatctccacagggttgctgtgcagaataggtcattaaatatataaccacaacacaatacagccagtgtgaggtgcttttctagtagatgagaaaataatactcctgttctgttagtgggaatgcaaagtatgttattttgggaggatatttaggtcttcttaaaaatttaagtatatgtgctttgtgatgctccattttctttctaggtatgtatattacagatacatttccagctgtataaaaattgaatgaaagaaaatatatgatcttatatttgtattactaaacactgtgtgtaacaaaccagctgaattcagtggtgcacacacctacacagatgcacacccacacacagacacatggaaagatctgcagatatgtttagtgaagagagtgagttttagaatgttggggtgatcagatccaacaccaggttgttggggtgacaaagtatggtggagtcaaaggaatgagaaaagacagtttgagagagaaattggatccggggggctattgcgagtatggaggctgcgaaggccctgagctctggaagcccagactatttattggtgatcaaacaaagaaacaggtgttgagaatgtggggcttgaaagggcaagcgcatgatcttacagctgtgacggtttagcattttctttgaagcatgtggaacatattctgcttgagataatggagagcaggttcttttaactcaggatacaatcgaccctgggagagcaaggagccagcaagtctagacacattccagagccacaagccctggattctatccaagccacgagggattttatgccctgggcttagtttatggtgtgtcagggcagccttccaccctttagcacagagcttggtgttccaaagaccacaaggggttttagaccgtggaccccagacatgttctgagactcttacattatgtcagacctgcaagccctgccgcagcttctcccaacactcagcttttctgccaacatagaataagcatcatcttgattctgcttttcttttaaaaatcaatgtattggtatacatacatattttatacttaactgcatatctaggagtctaaactttgacattaaaaaatctgtatgtggttatttgtggggcataggattggagcagaaacagggactttgccttttgactgtgatgtttgccttgttcatactaagaatgtgctgacgttggttgtgctgtttgcttctaagtttttataaaaagaagagagcagtagactgattcactcagtgtcctgggatcagaggcaaagaccagggaggggcgggcactcaggtcagcaggggctatgctctgggtctgagtcctgccgagccccaccacccacttgggcagtgaagtcaacctttctgtgcccgaatcttctcatctgaaagtgaggaataatagccataggcttatggtgagttttaagcgagtccctatgcatgaaagagtcagaaccatttggcacacggagggtacccctggggcactggtttgccatctggagggggaggcatcagcaccaccaggtcagaagttaaggggtggccccaaacaccacgtctgtggggaggtggggctgtgaggctgccagtgtgtcaggagtacccgcgcttctgtgcctgcctgtgtgccgggagctcccgcgcttctgtgcccacctgtgtgtcgggagcacccgtgcttctgtgcccgcctgtgtgttgggacctcctgcgcttctgtgcctggctgtgtgtcgggacctcctgcgcttctgtgcctggctgtatgccagtgtcttgcacatctgcaaggaaagaatcccggggccgtgcgttttctccgactagcaagggaatctatcaaatatgaataaatgtacagtggaaggttaaattaatgaaggttaacgtggctaatatgaacatattcagcctcctggaactatcattgtataagcataactgaaaagttcctatagcaaacacaatttgtaatcttaacatattcaattattaaatgtgcaggtcttatttctcgttaactgtgtttaaacatagaaaagaggatcttggccaggcacagtagctcacgcctgtaattccaacaccttgggaagccgaggagggcagatcactcgaggtcaggagttcgaggccagcctggcccacatggtgaaaccccgtctctactaatagcaaaaaaattaactggctgtggtggcggcgcctgtagtcccagctattcaggaggctgaggcaggagaatggcttgaatccgggaggcagaggttgcagcgagccaagatcacgccattgcactgcagcctgggtgacagagtgaaactgtgtctcaaaaaaaaaaaaaaaaaaaggaaagggggtttttgtgattgagacaataaaacatacgtttttgggccctgagataactttttcccttccggcccttgcccggcaggtcagtgttctcaatcttggctagcctagcattttgctttcatgtggcttttaaaaacaaaaataagtgtaccttaaatttttatcactaagatagcgtattccggctctcgtaacaaagtaccacacactgagtggtttaaacaacagaaacttgtctcacttctggaggctggagttggagaccccaaggtgtcacagggctgggcgtctggacgtgctgagggggcccaccccaggcctgaccgcagcctccctcgggtgctgctcagctcagcccaggcctcaccccagcctccctcgggtgctgctcagctcagcccaggcctcaccccagcctccctcgggtgctgctctgctcagcgatccgccctgggcctcaccccagccttgggtgctcagctatcctggatgggtacctgtcactccagtctctgcctccatcgtcacgtgagcttctccctgtgtcaggacctctcttttctcttacaaggacagagtaattggatttagggtccattctaacccagtatgacctcatcttaacctggtcataagatggccctggcttacggtggctcaacttcaatttccgcctttacaatgggtttatcaagttgtaagtccaggggcatctgtgtctgaacagcccctgcatccaaataagctcacagatacaaggggtgatcttttgcggggacacgattcaacccacagcagatgctgaagctcacagtgcctgacttccacgctgatctttgtagaggactcttgtagggtgaggggatggtgcagggtgaggggatggtgcagggtgaggggatggtgcagggtgaggggatggtggcaggaccactgacaacacctgtgttttcattttgaagttttgatttgtttggggtctctaggaattaaaggccaggaggataatggaaagcccggggatctgagctcgccctatctaggtagttccgtgtgggttttcttatttggggagacttttcttttatatctggttagctctatcctttttgattcttacatctagaataattctttttccagagtctttcatgcttttttcaatacaccagttacttcattcaaatgagatctccttttccaaatattaacttttatgtttccccatttatgtcttcagtttcattataaaccataatattttaaagttaaacagctaacttatagtccagcttttaggtctgaagtgcgttaaagatttataaatggaaaattacagaaacaatgtgtacctaaattgtggtgactcacttagataaccgttgaggaattgttagttttcaggaatgtaatccgtgatcttagattttaacttatttgttcgcaaattcagtcagcagctattcattgctagacattttccagggctgggatgcagcagtgagcaaaacaaactgtggccgctcttgggagagttgggtctgagggaggaggtcgcacaggtagtcagaggtgtgtgctgtggggtgggcacactgggtggggggtgttttctgaggggacaagaagtcccctggagacagggagagggccgtgtggacgtctgccggaggaacgtcctgggtagcagcgagaaccagcacagaagccccaaggcgggagcaagctggggtgtccggcagaggaggtggggtgggccccagcgtggtgaacgtgtgcgcagtggtcttctgaaaactgccttatgcggacccgtcttctcctgacccacaatgcattctacagcttgcctgccacccaaatagttttccttagaacttggcagccacaatggcacagcgtaaatcttattttagattcttataaaattgggcatacgcccaggcagtctgcatctgaattgaggctggacagtcaggatttccatcattgctgttcagtggttttgtctgcattcttggagtggatgcaccaccctccagacatttgcaaaactagaagagcagaccgtggagtgagcaggagccgggaggaaagagagagctggtctgtgcagggcctggagggaggggagagagagctggtctgtgcagggcctgcatagagggggcaggagaggagctgcgttggtagtttacgggtgttcttgggattccctgggaatgtagaggcggaagcagtagactcgctgccagctgttcataaacagaacgagcatcccctaatgcagccacatgggcagccagcactgtgcctggggtgccagcactgtgcccagaggtgcccagcctgccgcatgtgtgctgactgcacatctgtgattgtgatggcttatctgctcctgcatattcaagttaaaaactgtcattacaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggaggtgagtgtgggtcgcgagctgcacagattaaccagttattaaatgcttttctaacacatgtcaccaaagcctgcgttcccacgttcccgcgttcccgtggtgtgccctcaggctgagagcctcactcccagtcttctgaagtctttgttaggcttcagacatttgaggcagtgttccctctcctggtagacgatcaagaagatggggaagggcagctttgcacactgggacctcaggctgctcttccctggaaggcttcggggccagtgcagggtccacactggtgcctgggcagcttcccttccctcccccagaggacgtgcccatctgtcaccctaaggcactagccagagtgggaacagccaagctcggcttccgccaaggcagacacatgtgaaaatcaaggaatgtgagtttgtgtgaccatgaaacctgttttcagcagtagagacctttttccaagtctcagaagccttttccacagatgcatgaggaagcgcccagctgcagggcccgccgtgcctccccaccagccccacgaggagcgcccaggcacctcccaggagccgctttaccattcttagggtgcacacgcttggcgctcaactcatggggtcacaggcagcatcagcccctggctgtttggccccagaaagggaacccgtctcttttctcagctgggaatcctggagcctgtgtctcctgctgagccctccaggcatggggtgtgggctcaagcccagcagggtagccatgcctgtgcgagcagtgctgccgccttcagcagcaggtgcagggcgccaggtcaggtgggcctcagcagggaccctcgccccatggagtctcacagaggcagacccctcatgccccttcatggtgagctgcgctagggccaggcactccagaagctgtctcgcctttctgttcggcctgtttggcataaaagaaatgaaggcagcccgtggcttccctcctcctcactactccctgattccctgcggacgccctccagcatccccgcagctctgcctctgcctgcagccctctagcccctgtgtccagcccactccctgcctcccagctgtggccaggcccccctggctccatttctttaatatttaattttcaaataaatggaactgcatggtgaaatcttcaaaaggttctgaaggacacaatgaaaatgctcctttgtgactgtgagaacaaccgcgggcttcccaggcccctgtcagaggcacctggggctgtgcagcagtgagagcaaccgcgggcttcccgggcccccgtcggaggcacctggggctgtgcagcagtgagagcaaccgcgggcttcccgggcccccgtcggaggcacctggggctgtgcagcagtgagagcaaccgcgggcttcccgggcccccgtcggaggcacctggggctgtgcagcagtgagagcaaccgcgggcttcccgggcccccgtcggaggcacctggggctgtgcagcagtgagagcaaccgcgggcttcccgggcccccgtcggaggcacctggggctgtgcggcagtgagagcaaccgcgggcttcccgggcccccgtcggaggcacctggggctgtggaacagaagcctgcacccccaccccgtgtgtgtcctctgccctgggttccggggttttctcacgtcatgatggagtactgcgtacatacgcatgttttatcctgagggtcctttgtcagcgcgtaacgagctccgcggtgttctcaaggcagcacagtgctaccttgtgggggcactaagtttatttgagcccccccgtttggtgaatttccctcttttgctgctgcagtgagtgaccccctcgtgtctaatggaaacagttctagaagtgggagttgtgtttcaaagagaactgccgatgtgatttttgtgattgtcttttcgaaggttgtgaagctgtaccctgccgagcggtaagcagcagcacttctttctccactccttacccaccgtgttacctgacttttgtttttaccaatctgatgggtgaagaatctttcagtgtaaatttaatgtgaactttttttttttttttttctgagacggagtctcgctgtcgcccaggctggagtgcagtggcgcgatctcggttcaccgcaggctctgcctcccgggttcacgccattctcctgcctccgcctcccgaggagctgggactacaggcgcccgccactgcgcccggctacttttttgtatttttagtagagacggggtttcaccatgttagccaggatggtctcgatctcctgaccttgtgatccgcccgcctcggcctcccaaagtactgggattacaggcgtgagccaccgcgtccggccttaatgtgaatctttcttcctgtgagtttaacttatgtttccactgttctgtactccagcccagcgggtgccggctgttttaggctctttctaaacagctcagctgtcactaatgcacactccacccttctgaagcctgaggctcttggctccctaatcagatttgtggattgcagttggggggtatgtaggatgttgttgggcaaagcatgaaagtgttggtggcacagaccagtgagaacttatcagcattgaaccgtgtgcaaagcgctccagtggtgttctcggaagggctcaccttgcacggagtgtgaaatcgaagattcagatttccataagacattagaggcttgatttgcagaggtcaagttgcaccacgttgctgatgtctggtgtggcaggtggtcctgatgttagttctgaggttcctccccatatctaaatggcagatgatgtcacgcccctaaatacaacttgcgcattaacattaaagcaattgaaatatttattgatgtttcaactatgaaatttgacatgttgctgcaacaggaaaactcatggctctttagggaaaatgagtgcctggctgactaccatccgtgcagttttgctccagaccccattcctgttcactggtgtcgttcatattcgcgtcttccctgtttcctttattctccccacctgccccctctcacactgcatgtgctttcctgtttgcttttagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtaggtggaggagagtcttaccatgggcaccatctgtggctccgtctccaaagagcccttgccaggtgcatagtgatagacgtggaatgtaagatccattttagcaagacgtgtttatatgaatgaaaacgatggcactttaccactttttatcgcttttgataaatttgttttatcagcattgttctgaccttataaccagtgtttaaaagaataagcatgctttaaaaaggatcctttttgttacttttctcacttttactgtgaaaagtggatcattattgaacgtgcacttgtgtgcgtgaagggccttgcctggggaagccaagtggagcccctttacagccccttggcctgggctacacgtggccaggtacgaaccctcgcctggggaagccaactagagcccctttacggctcctcggcctgggctagatgtggccaggtatgaacctgtgagaactcgagcacacgtgtatgtaacgatctcagtggcacaagcaagtatgcatgtggtgtacacagatgcgtgtgtaatgtgcgtgcatggggcgtgtgcacagatgtgctgtgtaatgaagggctcagacacacgttcagtgctgcaactcagaactcttatctttttaccaagtaggtcctggccttagaagtagcacaacatttaagttatatgtaagaaaatataaattgtttggggatacatttcctaaatgtttagaacttttggttgttgttgagacagggtcttgctctgtcactcaggctggagggcagtggcacgttcacagctcactgcagcttcaaactcctgggctcaagccatcttcctgcctcagcctccgagtcactgggagtacaggcgtgtgccaccacacctgaataattaaaaaaaaaattcttgtgtacatatggggtctcatgctgttgtccaggctgatctcaaactcctggcctcaagcaatcctcccatcttagcctcctaaagtgccgggattacaggcatgagccactgttgctggtctaaatgttgagaactttggatgtggctgaacagatgttacagtacctgtctatgatagctttcttgagtgtgaattcaactttctaaaatatccctcgaaactgagctggatacaaatctaaataaaaactccatctccgtttctctggtttatctgcaagggtggaggaaaaaagagggttagagtttgaactgatctgatttgcttccttaatatttttcttttcagcatacttccaacaagggcaaataacattttatgaatgaagagagattactttaaaactaacagacgttgtttaaaatgtaccttgactcttcactcgtcttttacattgtggttttgtaaaccaagtaatcagttactgctgattggcctcctgtgagacttctgggtgttatctgttcagggttcagaggcaggaggctccagcaggtgagtggaggtgcaggaacggatggggtcctgctgaggtgggcaggaagtgcttttctgcctcgaagactgttggccaccagcggtcactgtgacctcggccctagggcagggttgctggggtgaaaggcagagcttaagcaaagcaggtgccgtgctcccaggagtagcggcgaggattaaaaccagctgaccacatgaacagtggcctgatggatgctgtttcccccaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggtcagtggcgttctgcaaatcaagcatatggtttccggtcggccatattttttatgtggttttgaagggttgaaagttgcacagtttccttaaatgtattgtgtctccgtttcctcttccatgttattgaagcaactggactctgacctctgagatttaatccagttctgaatgtccaagattttatagaaattccctgagctccataaatatatttccattgaacttcccctctaagtataatagaaatatgcattagaaaacttatttctgataaataactgcacaaattaaagatccagatatccatcgtggagcgggttggagagacccaaggacaatggttcagtcacagacttgtgtgagtgcagacgctcgccacctccccgctctaccagttttcttctccctgccttgcctggtgcacagtggaggctccgtgatgaaataagttgccacggttcctgagtttttgccaatctggaggaagtcataaagtgttttagagccttttttcagtttggaagctgatgggagcaggaagtagatacctggatatgatgttgctgcctttgaattatctttacagctacaatctcttttactggaggtgactgtgctgtgctgacagtataaggcacatacacttagcagaaaatcactagttctgaaacggcaaatttctactgatttggagaccgttaacttcacgggtgcaaactcgagctgtgaagggtgtgactccctaaatttcagcaggtctgatcattgcgcatttgcccctctgtaccgaaaggcgcaacctggtcaccagagcccgcgggtgctgtgtgtggcctccgtggggatcagggtgaccttgcctcggcagcatccctgggcgcctcccacagttcttcccgtactgatgagtgtggggaaattcggaagtacagcggccgttttgaagtcgtagttggagctgtgtcactcactagtgatggttatggagcccctgatggcggagggagggctgcatgagcgtccccggcgcgtgctcaccatgctcctgtgtccccgcaggatagccgtgttctcggtgaccgtgctgcacgacgagaggatcgtgatcgtggctgagcagaggcctgactccacggaagaggacagtttccagtggatgagccgtgtgctgcaggttgccctccctcgccctgggcactggtcccctgtgtcttgtttctggcctccttacttcattcagatcatggtgtgaccagctgttgctttgcccatggggtggccctttttcccttcccttcatttgatcaggaactacatcaagtgtccagaaactagctcagcagatcgagggtgtagggaccaggaatttgcacagctggttcctaccggacaccttggggaggtcgaagtaagctttttgtttgatcttgagaacatgttatcttttctccaaagttccttttttactgtgtatggtcttccacaagccctgggtaacattattcagctttggtgagtttagtaggaaaatcctttctcttaccttggcatttttatgctgggaacagtgcttatactgcacagacttctgtgtattgtggatcatattttgcataatataaatacgtactgtttatacttcctcttataacatgatttcctctttattaactttctaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccaggtatgtgcaccacttgggcagcttgtgaggtgcgggagttcccttggggctgcacggcactgggaggtgcgggagttcacccagggctgcttgcaggaagctgatgcttgcgggaaagaagtggttaccccaagaaaatagaatgggtgggggcaacttggattctggtcttctggctgtaaatgccttgcttttattctctgtaggctcaggggtgttagtgtggtcgtcagcacgtaacttactggctctgttctcccgtagcaaaagctcattctcctgaaggacacggccacggtgctctcactttctaagcacattgggttcacacgtatggttgctctttcatttctgacctacttctaatttttttcttatgttgcagatttccttaaatattcctcctccatttcttttttttttcccccacaccattgttctcatggtctctggtgtttgattggcacagtttgtttccgccccctcccacacacggctgttctcatggtctctggtgtttgattggcacagttttccccccacactgttgttctcgcggtccctggtttttatgattgacacggggaatgtggagttgcagggaacagtatccatttcaccacattctgtgggtgcgtggccttctgttgggagccgctcaagccatgggcatcgtccctcagggagtgctctgaaagggtggaaaacgctgcctctgtctgccgcctcgggacgtaaacagccttgtgaaggacacggaggcagttgctctccccaggctgtttctgtagtatgaagatttataatggtgtcagcgctctccagggtatcctcattgtaaactccgaagtgacctgatcctctctccccactgtttgattgtcagacactctcaacccagcaaccccagtgacccacggtcccagctgggaagtagttcagtagctggtggagacagggttcagacaagtgtttatggaaggaggaggatcctttgcaaatacaaagctgtaatgactccatagctacagggctcggctcacctgagccaaatgtcgagaagcccagtgaccgggaaaacccaggcgagagagagcagccagcagcctcacgccgaggtcaggaaaacccagtggggagacagagccagcaacctcacactgcggtcaggagtgtgacctcctgcagaaagccctcttccttaggagtttagctggggaatagtggcccaggagattggaaatctttttactctaataatgtacttcattaaatgaagcttcatgtgattgataacttgaaagaaagaaaatagtatatatatatttagtgtctcatctgtttttgctaaactgagaggttacataattttgtgtctttaaaaagctttttaacaaatattaactggcagagctgaggccctacgtctctgctgagggcctgatacgcagcttagcagacgtcccctgccccggggccccagcttcgaaccacagagaagggaattgggctggatgatttctaaggccccttcgaataaacatttaaaatgaccctgacaggtgagtagccattattggaagccaaagcaaacattcgttgaggccatttgtgggtgacagtgttctgagatgctggaaacagagacagcctattgacacccaaattgcctttcttactgcatgaattcatatttactcagttaatggcactgtgtaccctcagattatcttatttgagcacaaaagtattaagagacctttaactcagcagctgagctggcaaaaatattacagagttacaaaacaaggtacaattccacagctttaaaggtccctgggaatattgcccccgaatagcaggaagagtctgctgaggccagagcctggcacctgggaagggcttgcctcccacttgggatttgtgtgtctcgctgctgtctttgagataaaactcccgccctgtgccctgagcgaattcgccaagcattgcatggtaggatatttgataataccagcgatgcggctgccgacttgcagatgggtgaatccattaatgggagcgggaagagaaaagagacatgagcctcaaatacacacgttttgggattcctctcaactctgtagcttaaatggcgaggctgtgatataccctgggggcatttgggacatgcccacctctcttcaacaggggacactgtcagctgctgccaagaacagactttgagagtgaggtgcagctagaaggcctctgcctcccaggagcagtcgggaaaacaggccctagtctgcatggggaggcattcaaggtcccaaacttccattcagaggatgcacgtggagatgagggaacgtgctacgtcttcatgtagcaaacgggcacaaaataaggctccacaaaaagcctgatctctcctcaaaagctcgctttccctaccccagtctgaattcttaaaaacattacgggaaaccttggaacccatttaggccagtttccaagttgacttcttagaagagccgtctcgtcttgcccagcatcggtcaccaaggagaaggctcagagcttcatcagccaggcgcagtggctcacgcctgtggtcccagcaatgcgggaggccaggatgggagaatcagtggagcccaggacttcgagaccagcctgggcaacatagtcagattctgtctcaaaaaaaatctgttaaagatgcttcattcagaagacgcttctatctggtagagatagaggatgcgcagcgggtgaatgagggtctcccgggtgttgtgttctgagatcgtgcaggggctcccaggtgtttggagatcacagaggggcaattgttcccaccacggggcagctcccttccttccagagcctgacaaattcttttgctaaatgtgaaaaggctattcctcttccatacttcattaagaactaagaaaagaaattcagtctgttcacaactacgacgtgaaaattcaaaaatgatttgccgagtgtaggaggcatcttactgttacacagagtccagactcgaggctcctacacgtcgcctagaacccaaggcaccggcaggcagcagcccagacatctgctcatagaccgttctcctccagatttcaatcctggctgaagtgccgtgccttctcctgcgcagctgtgataagtggaatcgtttctggcagcctgcatttgaaaaggatggccgtgcatctgtagagagccggtggccctgctctccctgggggccggctagaggacgtcaggccctgactgccttgttctggtgccaccatttccgtgagctttttgggaagccgagggacatcggttgtcatggtgatgggctcatccgaagccttgttctgtgccactgccccgtcagctgcatctgggcacgtgtgtctgtttttgacacggctatgagcaacctgcttagccatagccctgcttgtgcagtaactaatgcagcatgtggcctggcttagaaacctgttacttgacctttatcgggaatttaagaatttgatttaatagtagccttcaaaccaaggattaggcataaattgatcatatcattgttattttacctgcaattcttttggtaaacattcttttactctccctgcttcctctgctcctccccctgcccatcccccatccctctgccccctccaatcccccgtcccccacctcccacccccgtcccccacctcccacccccgtcccccacctcccatcccccatcccccgtcccccacctcccacccccgtcccccacctcccatcccccgtcccccacctcccatcccccgtcccccacctcccacccccgtcccccacctcccatcccccgtcccccacctcccacccccgtcccccacctcccacccccccttcttccccactttccccagttggtagtcatctcatcgctcatggataagcgatgactttatgacagcccttggtttattcttccacacctcactgtgggcctgacagaacctaagaccttttcagtcagtataacataccgagaagcgactctatcctgtcccgtccacagtatcactctctgactccaccccacgacatctgtatgtgaaatgtccactgtctgtttgtccacagccagctctcaggtgtgtggaccccagagaactcgaacagacgggagccacaggtctctgcagtgagacaaatcgtggcttttaattctgtgtgtgtcttccgttttattttttacaatcatggctgtgagtgccggcacacggggctctcacattaactggaaagtcaggcgtgggcttggagggcctccagggagcttcagggatgataaaaacatcgtttctgaagaacctgaccaaggcttgttacactcccccttcacaatcatttgatttcgttgaatctctgttcttagaaggtttattcaaagccaggtctttccagaagttttccgagagtaaggtctttaccaaagtgggaggtctagtctgaaggaatttctcttttgtttcctcatggccatgtctctgtttctttctagaaatcggccctgcctctgtgatggtggggaacctggtctctgggaagagaatcgcccaggccagtggcagagacctgggtcagatcgaagataacgaccaggcacgcaaggtaggagctgggtccctgagtctccccgaccgtccccgacttttccgactgtccccgaccatctgcgaccatccccgacagtacccgactgtcccctaccttccctgacagtccgcgacagtgtctgactgtccgcaaccgtccccgacagtccccgactttcccgacagtctccgatgtcgcgcgctggtggtggaccaccactgcagatcttcctttattctacctgtcctctcctgcaagagaccatataatttcataagaaaaatgtgtttataggagatacaaagtttcagaaaatgtcacagcgatgcagaaatcggtgaggggtgtccagtcccacgactcgcaggaccgaggcaaatgtctggcagtccttgtcccgcgcacggtcccctgaactactcctttctagtttccccaccagcccggattcaaagcccaccctgcccacagcagcttgcagcaaggcttctgtcctgtgctctgtggactctaagaagcagttcaaaacccaggttagggggccaggcctcctaacagtggcgttagaagccgtgggagaaactcccgaggcccagactttgcacattgtgccgtgtgcgtccacggtccccattagaaccgttcggccttcctgtttcccacagccaaaagtgtgcccttgtgtgtggcccattaggaaatggggcaaaatcagcaccgtgaaatgttgatgaaacggatgaaaccttatctgtgggtttttctgtaccctgatgtgaaataaggctgccccttttactgtggaccagctcagtagcacacatgtggtttgtttaatttgtggcttcatgccatcagggtattgccattctagaaacctaaatttattagatcccgctttttaaaaccagatagatctgattctctcactgtagccaccaaaatccgctttgcatcttctggaagccccaggagaagggatttctgtgcaggctgctcctgcctatgagggaaatggttcccatccttgggcagactttcagaaaacttctcacaccagggtgcagcaccagccctttgctttgtgaccctgactcgggtgctgtgaacctaagtccctgcaggaacaaagctgtgggcacttgcttgtcctgtggtcgtgtgtgacggggattttcccagcatgcatgtcttcaactccctgcagagaagcatgcggttttaagacccaaagcactcagcctctatgggtttgagtatccaggttgccccacctcagcccgcacagcctgatccaaccgcacagcctgatcctcatgcccgtgctctgttccagttcctgttcctctcagaggtcttgcagtggagagcacagaccaccccggaccacatcctctacacgctgctcaactgtcgggtgaggcgcggagctggccttccctggctactggcctcaaggggcctagcctggttcctgggagcgctcctgcttctttctttgaatccttttgcttcagtcttatgggaattctttttatgttttgctattttgactgagacttttgtacctagggattgtttttaaacgtaaccatttgtgcagttatttacacctatttgtgtgtacagatattttagcaacctatttacaatatttctcccccaaaatgagtaatgatatctgcaagagagaaatcgtaagtctatgagatatttgcatttttattttgattactaaactagtttttgttttgttttgtgttttgaggcagtctcgctctgttgcccaggctagagttcagtggcacgatctccgctcactgcaacctccacctccctggttgaagcaattctcgtgcatcagcctccgggtagctgggactacaagtgcccaccaccacatctggctaatttttgtatttttagtatttagagatggggtttcaccatgttggcgaggatggtcttgaattcctggccttgagtgatccacctgccttggcctcccaaagtgctgggattacaggcgtgagtcaccacaccgagccctaaaccacttttttatacaccagaagttatgtttattgcagactcaggaatgaaaatcatttccactttgtaattaaatttcctgtttacactttacatgagaaaactacactcatcaaatattgttccaccgtagtacttaagagtaaggcattaaataaacaagctaatactattaacaagaaaaattaaatgcaaaaatcttaatatgcttgttactactttttaccatggaaataaagcttgaaaaatggaagaaaaatgtaagtcttcttgacaagtataggtacttgcaactcttcaaaaagtcatggctgtttagaattgctgagtatcaaaatcttagtgtgcgaagcagcagattgaagacaaaaggaaatgccagcagcatcacgaaattattccccgactctctggtttgagtttcagttatcagaccattctctgcacgtggcttagttcataggaacaacctctcctcctcctctgccagagaagcgcgtgtcgtcttgacgttgtcacggatgctgagttgatcccagccattggtcgttcactgtatctgctcaagactgtttcccaggaagaggctttaaaaccaggaaggcccgtttctgccaccaccttctggccctcgttcgctggtgctgtgacggagcccctgccccacgctgagagctcaggtgtgggggccggagatcttgaggactggagttgctgtgggtccctgtatctgaaatgcccaccttccacttttcatctttctccactggacccttcctcagcctgtgaatatggatgataccccctttgctaacccgatcgccaggttcgccggccttgggtgctgtcttgatttcctgcccatctctgcttgtctgactttgtcctctcccagtagtgtttctcctgtaaactgcctgtgacttctcgttcctctttccctgtggtcttggcagttctctagagatttccagtatcatctccaacgtggtgacctaaatctgcagcactaactccagcctccttcggcaccccagatcccttctgctgaaagtgcttcctccctcccctaatttcctcacagaggtggctacccctccgcaagctgcaagcagtcaggggcagagtcagctctcagtctccctgaatctctgccttgatgttgcctgacacgctgctcccatgtgtgggggttgcacaagcatgtgtccagtaatctagaggtattgatgggcagctcaagaagtagcagacccccatatacgcaaagattcagacatgatttgggtacgttcatgggcaacatgtaccatcaggaggaggaaaatagagctgttccagctgtgcctgatttggggaagatccctcagattgctgggtggtgccatggtcctgggcttggcatctggtctatctggccctgtggacagcccagtgtccctgaacacctgtggtcacctgcatagctggatgctggatcttcagggaaaatgtatttcccggaaatgattccggttctctaaaaagggctttattaggatcaactgcaaatccgatgggggccagatgtagggatcagagccatgagtgatttaccttaggactgtgtggaaggcatggcctgaggatgtcttttccttggaggtgtgagctgtttccaaggctcgctggacacagaggcaggcacgcttgagctattgcttgtgttattttgcgccaagcatcagatcaggcatgggtccttcgctcctctgctgcctcgtatgcacactgaagagatgctgggcctggaccaaggtagcagcatcgtcctcacggcattcatagtgtctttccccacctaaatcagcttccctgttcagcaccgtccagcggaaactcagtacacgccacatacagaatcatgcattttctaaaagcaagattttaaaaaggaagaagaaacatgaaattcgttccagtgatgaatcactccacacaccataagtgtccgttcagcacgtacaccagccccccagccgctgcttccatcaaggatgcacgtttctgctgatgatgaatttggcccggtcttgctggccgtgtagtcacaagctcatttaaagtggtggaggccaggcaccatggctcacgcctgcaatcccagcactttgggtggatcagttgaggtcgggagtttgagaccagcctggccaacatggtgaaaccccgtctctactaaaatacaaaaaaaaatagctgggtgttttggcacatgcctgtaatcccagctacttgggaggctggaagcacgagagtcgcttgaacccgggaagcagaggttgcagtgagccaagatcatgccactgcactccaacctgggcaacagagcaagactctatctcgaaaaaaattaaatggttgaaccaatgggtttgtagccaactcttttgaccttttttaacttataccttctttagaattttaaaatataaatttagtttggctttttcttcttgggttttttttcccccaagttgtttgatttaatgtgaaacgttaaaatggtcccaagtttacagaaactgacagtgaatgtgtgtccttagacaagggcagactctttgtgtttccctgtgtgcccctccggtcatgctgcctcccagcacttctgtgggggaaaagccagccctcatttctctgatgaaatggttttacctagaaccttcttcttagctggtgggtttcaggacggaaaccccagtgaatgttgatgaggatgccagagaatgacgactgtcacctgcggtgaatggttgttgctttatgggacactcgccgagaatgcatcacattcttaacacggagttcatgggaaaatggaaagtgcaagcaaaagttactggcatttctcctggggtagaggctgcattaggattcctggggagcaaggctgaggaacagtgtcacgtgtgtggagttgccgtgtggtgtagctgtgtcccgttcaaccacacggggtggggaaaggtggcaaggaagaagggacactgctcagtcgctgcaggtgcctgggactgccagcctgcaacgtgagccaggagcgactgtccctcccagccaacggtggggtccagtgttcactcacctcgtcctttccaggcaagaaaggcgcccacctggtgtgacccatggccctgcctggccatggagcgaggggtgtctgctcatgtccgaccggctgtgaaatcgtgtgcctgtctccagcacagcactatctcaaggggctttttaagaacttaatttaaatcaccctgtgagctggctttgggacctaacacctgagaagggcaccgtcctcgtggagcgtgcctggaagctttgctgtttgtttttatgtcagccctgaaagacatcaaccagcattgagaaaattgtgtttcacagggttatcaaagataaaggacagcatgcatgttacactcatgctttgcaagtacctacaggtggggatttctgtgcaccagaatcaaaacattttcaaagacactcttggctgctggctgtgtctcatctgagcctctcaaatctcaggacccagaatgtgggcaaaccacaggctttgtcatctgacagcaaagcgggtgtttgataggaaatcagcttcagctctccagagatggggaagaaacagttccacaagccgaacaaaccagactgggcactgctgctgcaggcaggcctggcatgagaatggactgtgggggtcggggcctccctcagcggggcgggggctgagctgattctgccagggctcttctctgagacgcgtccatgctcacagcgatgggtggtgtgctggttttccttgttgggagacctgcccctggagtcggggtggacttgaatgggtcccatcagcacccagcctggccgtgctgggtgtctctgtcccatgttcacttgaagagctcagaggacgttggcggcaaggagccggtgggctggttgctgtgaacaggtggcaaggagcccctctaagagtaaatgctcagaggaacagtccagtttcaaaggcccccaaatctgtcttctcagcaggatttcccggactccagccctgcgttccttgttgtctctgcccatctctgctgccacctgctcttgggctcttctactttaaatcagtttctgttttctaattttttaggtgtcctctaagtggggaaataatcaaggaaaatgtgtgggatgagaaggttgaattcagagaaatgtaagctaatcctctccatggaggagaccagccacaggcggcaggaagggtctgaagacccaccgggcagtgacgtgggccgcctccccgcagccctggtcctggccctggcgcagaggtcctcagggagagtatactttccccacagacctcgctgcgctcatcggctgtcttgtggacgttttggtagaggtcagggtcaggtgttcacatcttgatgcttcctgagacattatcttccactcaccgtgccccgccatgtgtttctgacacgggcccttcgagctgggaggctgacgtgcttttcccagcatcgccgatgaatagccccagatactgttcgtccgtgcggcgtccttttggttgcactaactcggctacccgcaagcccctctgggcctctctccctgcgccttcactctgaatcgcagtgtctggtccccgacagccatctcgggctcgctgtgcactctgtccccaatctctgaatcacagcgtccggtcccgacagccttgccaggcccgccgcgcgctccatccctacactcatgcattcatctttgtagctgtgactcacataagaattcctgggctgggcatgatggctcacacctgtaatcccagcactctgggaggccaaggcgggcggatcatgaggtcaggagttcaagaccatcctggccaacatagtgaaacccccatttctactaaaaatacaaaaattagttgggcgtgttggtgtgcatctgtagtcccagctgcccaggaggctgaggcaggagaacgggagaattgcttgaatccggaaggcggaggttgccgtgagctgagatcgcgccactgcactccagcctggcgacagagcgagaccccatctcaaaaaaaaaaaaaaaaaaaaaaaaattcctgagcccgggtgttcagtcactcttcggctctgcagtcttcctgaccccatggactgcagtccagttgcccactgcttgagggaagatcctcaccctgttaatagctgtgagacagaatctgatcacaaagaagaggttgttaaatgactgtagaagccgtcttcacatctgagagtgctgcaaaggaactaggactgtaaagtgtgtcctcaggaaaagcttgtttcggttagttacgtgcttataatttgtaatttattcacatttgtctttatggcttaaataggccaagatgggaagatcacttgaggccacgagtttgagaccagcttgggcaatgtagggagaccccatctctatgagagaatttttttttaaaattagccagtcatgatggtggcacctgtagtcccagctacttggggctgaggcagcagaattgcttgagcccagcaggtccaggctgcagtgagcagtgatcatgccactgcactccagcctgggagacagagaccctgtctcaaaaaacagcgaatcccacactcttgcgatgtttcttggtatatatcttgcaactcaccttccctcacaaccctcgtgtaaggtattttcctgcacaaatatgttttctatttgtttgtacattaaagtctatgtgaaaatgcgtttgatagttcttttcattcctgtagggtgtgtttgtttattttgcttttgttttttgctttctgacttccttgatttttgatgtggtctttctaaataaaattttttaattagtcttccgatgtgcaggtgtactaggaattcccactgcccacgacaatgacacaagtcccagaattgccagggttttttgttctaccgttttttaattcacgtaatcattttttaaaatattgcttgttactctaaatatatctagatgtttctttggtctgcactgcttacctagttggaagaaaatggagttgacctctaacgtatatgtagttttgggggaggctaaaaacgttctaaaattgactgtcatgttggttgcacaggtctgtgcttgttctaaaaaccagtgatgtatgctttgcgccagtgagttgtatgacgcgtgcgcgctctctgcaagctgctctgctgaaggaatcttatgtgcttgtccctgtgatcggcccgcagggtgcgatagcgaactcgctgacctgcgtgcagctgcacaagagagctgagaagatcgccgtgatgctgatggagaggggccaccttcaggacggcgaccacgtggccttggtctaccccccaggtacaggcgcagggtgggcttcccctgagagatggcaagccggtcagccgcggtgcgaggaggtcccttacacccgctggtgcctgagccgagggtcgcgtcatggctgggagtctgcactgtatccagctggatgctaaccagcccgtttgtgtctggctacgaccactcacaggcaccagccgcatgtgctactgtgagaggcgtcaataaagtgatgctttcaatgacttttatatccaaatttgtgttattagatacctcaggtaattcacttaatagtacctaaatcttgactaaattcacagttacaaaggtgggtaattccttagcaaaatgatgtagacattaaacctccaggctgcctcgtcacctcatgtctgaaaggacaggtaaatgacagtgaccgccaaagctgacaaaacccgccaggatgacggaggctgtgagaagctcagctgctcgtttccctgttgaacttgccccagacaagcattgatgctgacagggagagtgtgcactcagcagcgtggtctgcttcaatgatgatgtttctctccttgtgtaggaatagacctgatagcagcgttttatggttgcctgtacgcaggctgtgtgccaataaccgtccgtcccccgcacccacagaacatcgcgacgacgttgcctaccgtcaagatgattgtggaggtaacatgcctgggaatgtcggggcctccacctgcctggagctgagtgtggagcttgcaacgcgcagactctgacatctcttggggcagctgctggctgtggaagccggggtgtgtctggagtcaaacggtcaggacagggtctctacctgcagggagcctagagtctaggtctagaagcgagatgtaaacgtgtgtggaggcagaggctggatggtagcctctgcagggtcttccctggagaaaacggctcccaagagagggcatcaccaccattcctcgggcttcctcacgaacccagctgagcagaccgaccacgggaagaggcagggctttttccaaagccctctcctcaagatgtggaagtttcctgctcctttttgaaagtatagatctgttttccttcgtctacagctggaggagtttgagaggattcagctatattttcctcgttgaaggaggaagtacaggggagaacagtgtgggcagagaatgcacctgtcctacccacacctgagtcccttttggcatggtcctggagacctgcacagtggccactcctagaaagtgtggcgacgcgtctgggtgcgtgtggggtttccaggagagctatgcgcgacgcgtctggggtttccgggagagctatgcgcgacgcatctgggtgtgtgtgacgtttccaggagagctatgcgcgacgcgtctgggtgagtgtggggtttccgggagagctatgcgcgacgcgtctgggtgcgtgtggggtttccgggagagctatgcgcgacgcgtctgggtgcgtgtggggtttccaggagagctatgcgcgatgtgtctgggtgagtgtggggtttccgggagaactatgcgcgatgtgtctgggttgggtgtatgtagggtttccgggagaactatgcgcgatgtgtctgggttgggtgcgtgtggggtttccgggagagctatgcgcgatgtgtctgggtgagtgtggggtttccgggagaactatgcgcgatgtgtctgggttgggtgtatgtagggtttccgggagaactatgcgcgatgtgtctgggtgcgtgtggggtttccgggagagctatgcgcgatgtgtctgggttgggtgcgtgtggggtttccgggagaactatgcgcaatgtgtccgggtgagtgtggggtttccgggagaactatgcgcgatgtgtctgggtgcgtgtgacgtttccgggagaactatgcgcgatgtgtccgggtgcgtgtgacgtttccgggagaactatgcgcgatgtgtctgggttgggtgtgtgtgacgtttccgggagaactatacgcgatatgtctgggttgggtgagtgtggggttcccgggagaactatgcgtgatgtgtctgggttgggtgcgtgtggggtttccgggagaactatgcacgatgtgtctgggttgggtgcgtgtggggtttccgggagaactatgcgcgatgtgtccgggtgagtgtggggtttccgggagaactatgcgcgatgtgtccgggtgagtgtggggtttccgggagaactatgcgcgatgtgtccgggtgagtgtggggtttccgggagaactatgcgcgatgtgtccgggtgcgtgtgacgtttccgggagaactacgcgcgatgtgtccgggtgcgtgtgacgtttccgggagaactacgcgcgatgtgtccgggtgcgtgtgacgtttccgggagaactacgcgcgatgtgtccgggtgcgtgtgacgtttccgggagaactacgcgtgatgtgtctgggtgcgtgtgacgtttccgggagaactacgcgcgatgtgtccgggtgcgtgtgacgtttccgggagaactacgcgcgatgtgtccgggtgcgtgtgacgtttccgggagaactatgcgtgatgtgtctgggtgtgtgtgacgtttccgggagaactatgcgcggtgtgtctgggttgggtgtgtgtgacgtttccgggagaactatacgcgatatgtctgggttgggtgagtgtggggttcccgggagaactatgcgcggtgtgtctgggttgggtgagtgtggggtttccaggagaactatgcgcgatgtgtctgggttgggtgagtgtggggtttccgggagaactatgcgcgatgtgtctgggtgcgtgtggggtttccgggagaactatgcgcgatgtgtctgggttgggtgtgtgtgacgtttccgggagaactatacgcgatatgtctgggttgggtgtgtgtgacgtttccgggagaactatacgcgatatgtctgggttgggtgagtgtggggtttccgggagaactatgcgcgatgtgtctgggtgtgtgtgacgtttccgggagaactatgcgcgatgtgtctgggttgggtgtgtgtgacgtttccaggagaactatacgcgatatgtctgggttgggtgagtgtggggttcccgggagaactatgcgcggtgtgtctgggttgggtgagtgtggggttcctgggagaactatgcgcggtgtgtctgggtgagtgtgacgtttccgggagaactatacgtgatgtgtctgggttgggtgtatgtagggttcccgggagaactatgcgcgatgtgtctgggttgggtgagtgtggggtttccgggagaactatgcgtggtgtgtctgggtgagtgtgacgtttccgggagaactatacgtgatgtgtctgggttgggtgtatgtagggttcccgggagaactatgcgcgatgtgtctgggttgggtgagtgtggggtttccgggagaactatgcgcggtgtgtctgggtgagtgtgacgtttccgggagaactatacgtgatgtgtctgggttgggtgtatgtagggttcccgggagaactatgcgcgatgtgtctgggttgggtgagtgtggggtttccgggagaactatgcgcggtgtgtctgggtgagtgtgacgtttccgggagaactatacgtgatgtgtctgggttgggtgtatgtagggttcccgggagaactatgcgcgatgtgtctgggttgggtgagtgtggggtttccgggagaactatgcgcagtgtgtctgggttgggggtgtggggggtttccgggagaactatgcgcggtgtgtctgggatgggtgtttgtggggtttccgggagaactgtgcgcgatgtgcctgggtgtgtgtgacgtttccgggagaactgtgcgcgatgtgtctgggtgtgtgtgtgtggggtttccaggagaacagatctaatggtgtgagcagtgagctcttttctgcacatgtcacaacgctgtggatgcactgggcccaggaagtgcagatgcagcagcttcaggccgcatgccctgcccccgtgcctccacaactagactcctagctctgtcctaccttagccagcaggagggctcggtaacctcatctgcccgttaaagctacatggttttagtgtatgtagtaagcaggagacccgtgtgaagtgagcacgctttcatctgggtccacgttcatggctccattctcgctctctgatgccaggtgagtcgctctgcctgtctgatgacgacacagctgatctgtaagttgctgcggtccagggaggcggcggcggctgtggacgtcaggacgtggcccctcatcctggacacaggttggtgctttagctgcagaaggtggtttgctcacggccttgctcaggctggatctgctgatagtcatgttcctctccagatgatttgccaaagaagcggcctgcccagatctgcaaaccttgcaacccagacactcttgcatatctcgacttcagcgtgtccacaactgggatgctagctggcgtaaaggtgaggggggtggctgcgggcggtggccatggaggcaactgcggagcgtgctggaggtggcaggtcacgtgctggctctcagcgcctctcgtgtagtcagactgagatgtggaaagaggtatacatacgtgtttcattcacggtatgacacgtatgaccatttccatccttaaccaggctgactgattctgtccaaatgccccaagtatgtttttatgtgaacactgtctcagctgacagtagaacactgcgaatgtttttctcttgctggttctcaaatccgaacgctctgtgataaatttctgcacactgcactttctagcgttttaacctgggctctattagaaatcatcatgaccctctcagctcagatgccgcccttgccgaggtgccgtgcaaacccccccccgccccgcccccgccccacccttggggacttcgcagccttgtgtgccgtctgcccccatctgtgggtctgacgggtgagctggctttacctcgcacagttctcacgctctgtccacctcttagtagaactgaggtggaataccaaagtagctacaatatgaaataaaataatttttcaaaagcttttgaaaagaaatgttttcagatcaagatgatttacttactgtggtctgaagttagctgtgaccctcccactgtcatagccagaagagaagcagctgcttccagtcataccgtttcatggcccgcttatagtctcagcgtctgacgtagagtagaccatcagaacgttcctggctgcttttctttaagtggtgtcaattcctgtttctctgctgaagtcccgcaaaggccccgctggctttgtgacccacagccagggtgttgggagcagcctctcttacaccccatacacggttgtccatgccctcgtctgtgaattcccactggatcctgagggcagggctgtgtcttactcttcggttcatctccagcgcttaacacagtgtctgatcacaagctctcggtatttagtatttgctaagctgaagaactgaattctccacctagaaatagtgctttgcacagagcagcagttcagggcaggcttgctctagttgctgatctgagtgggtgggtaattttaggaggcagggtttgactaactcctaatccagggaggcaggagtctggatggatgttgtataaattcagtctcatttctcctttaaacaaaaatttgccttaaaagcaagctaaaaagaattatttacattttacattttataataattctacgttcccctgtatgaatatagtaaaacagttacgaaaccttctcccaggcagaacttccaatagtgatggaacgttttacagtgggaggactcccacctccaagttctctcacctcttgctggagtgatgaatgaatgatggggagccaggcatttggatttccccagttattacaaggctctgtgctggtccctttacagtttagctctggtgacattctacttcagatcaacttgtgacatgtttttttgtttgagatggagtcttgctctgttgcccaggctggagtgcagtggtgcgatctcagctcactgcaacctccgccctcttggttcaagcgattctcctgcctcagcctcctgagtagctgggactacaggcatgcgccaccacccctagctaattttttgtatgtttagtagagatggggtttcactgtgttagccaggatgttctcgatctcctgaccttgtgatctgcccgcctcggcctcccaaagtgctgggatcacaggcgtgagccaccttgcccagccgtgacgtgttttaaaaccgcaaaaatcagaccattttgtatgctgctttgacttcctttttcctctgaggtttgtttggctagaaagcttctgtgagaaaattgatcttattaatatattttattgtatttcaaaataattgacattacacacagactgtagggggactattacagggattagggaagaggaagatgcggaagctcttcactgtctggtcatgatgggatgattggattttagccaccatctccatgcaggatggtggaagatagtgaagggccctggagtgtaggaggacctgggctctaactcctagctctaacttatgtcacaggcagcaaaatctttaacttctgtgagccttcactttctgatcattaagacagctgagccacccagcaggtcttgctggccacatgctgcacagcagaggctatgtccagccgtggagatagccgtgaataagacagggcctcgaccagcagaggaatgcaccgtggtgcctcccctacctgtgggacggtgtgttagagagagggtcacacgaggccaggcgcggtgtctcgtgcctgtaatcccagcactttgggaggccgaggcgggtggatcacgaggtcaggagatcgagaccatcctgcctaacatggggaaaccctgtctctactaaaaatacaaaaaattagccgggcgtggtggcgggcgcctgtaaccccagctccttgggaggctgaggcaggagaatggtgtgaacctgggaggcggagtttgcagtgagcggagatcgcaccactgcactccagcctgggcgacagggcaagactccatctcaaaaaaaaaaaaagagagagagtgggttacacgagaaccccttcctccatgacttgctgttcaaacgcactatttcaatagctagagttgctaggtcctggaggaccaacagttctgagtgaggtttactcattgaaaatgagaactccagtgaaaatatcagccactcacattccccagacacaacatagcccagcttggtgacagttgtcgccagtcctaaaaacagctttgggcctttggggccaggtatcgtgcatttgttgttcttttgggttttgttctctaaaatttattgaagagacagggtctcactccgttgtccaggctggagtgcagtggtaatcatagctcactgcagccgggaactcctgggctcaagtgaccatcccaccttggcctcctgaagtgttttgattacaggtatgagccactgcaccaggccagcatacatttcatttggccttattgtcttaaagatgtctttgggtgtcaggccccacgcatttaatgcggctttattgtcttgtaggtatccttgggtatgaagtcccatgcattcagtgcagccccgtattgtcccgggtgtctgagggtgtcaggcccgatgcgttcaacacagccttgcgttcagtgcagccccgtattgtcccgggtttctgagggtgtcaggtccgatgcgttcaaaacagccttgcgttcagtgcagccccgtattgtcccgggtgtctgagggtgtcaggtccgatgcgttcaacacagccttgcgttccctgcagccccgtattgtcccgggtgtctgagggtgtcaggtccgatgcgtttaacacagccttgtattttgcagatgtctcacgcagccaccagtgccttctgccgttccattaagctgcagtgtgaactttacccctctagagaagtggccatctgcctggacccttactgtggactgggatttgtcctctggtgcctctgcaggtaagatgcctctctatatctttacattaaaaaaaatcatgcaccttcctctccagaccttagacccagccaggcaacctaagcactgcccccacacccccactcctgccagaggaggcctggggcttacccgtgtccctctacttctcctggtggacttggctctcggggaaagcagcacctggggtgactttgactttctgcagcagggaaggagcattttggagagccgtctgttgcggacctttatttctgacaatcagaagactcccaggctccaggcttggttcttatgcctgtaaaacctggcgatggtgctgggcctgggttctcgctgggccagcaggcattgcaggctgtcacctccctcaggcttcaccccagctgttactgcggggcttaggctgggcaagcccagaggtgagtccacgagggctgagcgttccctggggtgcggcactctacccagcagccggctcggagcctggcttacagcaggtgctcagcaagtatttatgggatgaatgaatgaccagaaaaacttatggatgtttcttggcttttttgtctgattatacatacatgttcattgtagaaattatagaaaatatgaagaagaaaataaagccatcaacaatcatagcacctgataaagagtgttaccaataaatacccactattagcattgggcatatagttttcagagttcattttctaatggagcgttttcaagcaagtaagcatagagcatgtccagtaataaacacccgtgaccatcatccagcttcacatttcagcattttagcagttttgtattatccgcctgctttcccccctttttttttaaatgggtattttaaagctaacacaaacataaaaataatttcactcataaatcttctttacacattttatgaataaatatatgttaatatatttataaaactgagacgctacagtatgaaattggttatgattttctcaaaatttatagtggatcttttatctttttttttttttgagacagtcttgctctgtcacccaggctgaagtgcagtgccacaatctcagctcactgcaacctctgcctcctgggttccagcgattctcatgtctcagcctcccgagtagctgggattagaggtgcctgccaccacgccctgctaatttttgtatttttagtagagacaaggtttcaccatgttggccaggctggtcttgaactcctgacctcaagtgatctgcccgcctcgccctcgtgcgccaccgcacccagtcagatttttttctcctgtcaacactcttctggaacaaatatttttaatgtgtgactaatatttaatagtattaagttgtattaaaatgtaattctgtatttttgaaaaataccgatattctaattaggacaattcagctttttgagaaagcagataaaactgaataaatgaaatatttaatgatttttgcctcaatccaaaatgccataacattgtgagtaaatttttttttcttggaaaatcgctcagaacatggcctcaggtatatgcgccaagctgaacggcagaggtctgttctgaacaacggcccttgtagggtgaccgtatttcatttggcaaagtataccagtaaaactgaagccagccgatggaagcctcctgcctgcaggcttaccaagcctggctccccatggaaaccagagagaagatgtttgttgcagggaaagtaagttctccgtgtgaacccacaataacaatacactctttaagggtttgtccaggttgcgatgaaatttgacaagcatctttcctgcaaaatgttactaactcagaagtcacaagatcacagtattctgttgattgcccttgcaacagtcaaaataaatatagccatgaatcttcccattaaaaaagaaaaaaatctctatagaaacagatcccaatggacttgcttttaaaaaacaaaaaaagcacttgggtcctagatccacaatgactaatacataagttaaaaataataatgacttccctttcccatgcagttcagcaggtctgggaagagaatcaggcagaagaggccctgggggtgtaaatttgaggacgcctcgacctcaggctgtgctcctaagagtgtagcagggtggggagtgtgtcttggtgggggcagccgcgcagggtgcccaagcccacgtcggaggaggggagtccacagaggggtgtcctggcgtgggctgtgggagccaggcagggtgcattgtgggagccaggcagggtgcagggtgcaggtggcgtgggctgtgggagccaggcagggtgcagggtgcaggtggggtgggctgtgggagccaggcagggtgcagcgtgcagcgtgcaggtggcgtgggctgtgggagccaggcagggtgcagcgtgcaggtggcgtgggcagtgccagccaggcagggtgcagcgtgggggagtcagagcttgttctaagaatcggcagcagccgagggagatcggctccgtgtggggaattagaaatcagtgcggccaggcgttagtcatgggggtacgttccaaatgggcgatttcattatgtaaacatggagtttgcttgcacagacttggctggtacagcctgacacacccagtccgcagtcctgtgcagcgtgttagtgcactgaatgctgtgggcagcggtaacgtgatggtaagtggtcgtgtgtcgagacatatttaaacacagaaaaggtacagtaaaaagatggtatagaaggtgggaaaaaaaaaaaaaaactgtgtagggcatttcccatgactggagctggcaggagtggaggttgcccaggtgagttggcgagttggtgagtaagcggcacctgaacgtgaggccaggacacgactgcacactattgtggcctctgtaaataccagacactttggctacgccaagtttgtcaaaaatatttttagttcttcagtaataaattaaccttcgcttactgtaactttttaaccttaacgttttaatttgtaacatttttgactcatctataaaaacacttagcttataacacaaacacattatacaactatacaaaaataatttatctcctttataagctgctttctattaaattttaaaaaacatttgaagcttttgttaaaaactaatatatacacgcatacacatcagcctaggcctccacagcacacacacagcttcctaggcctctacaacacacacacacgcacacacacacacgactgtctaggcctccacagcacacacatacacatcagcctaggcctccacaacacacacacacagcttcctaggcctctacaacacacgtgcacacacatcaacctaggcctccacaacacacacacacagctgcgtaggcctccacgacacacgtgcacacacacagctgcctaggccttcacagaacacacacacacatcagcctagtcctccacaacacacacacacatcagcctaggcctccacaacacacacacagctgcctaggcctccacaacacacacgcgtacacacaccggcctacgcctccacaacacacgtgcgcacacacacacagctgcctaggcctccacagaacacacacacacacatcagcctaggcctccacagcacacacacagcttcctaggcctctacaacacacacgcacgcacacacacacagactgtctaggcctccacagcacacacatacacatcagcttaggcctccacaacacacacgcacacacaatcagcctaggcctccacaacacacacacacagctacgtaggcctccacgacacacacacagctgcctaggcctccacaacacacacgcgcgcacacacctgcctaggcctccacaacacacgtgcacacacacacacagctgcctaggcctccacagaacacacacacacatcagcctaggcctccacaacacacacacaccggcctaggcctccaccacacacacttgcacacacagacagctgcctaggcctccaccacacgcatgcacacatcagcctaggcctccacaacacacacacacacacagctgcctaggcctccacaacacacacacgcacacacacaccagtctaggcctccacaacacacacacacacacacacacaccagtctaggcctccacaacacacacacacacacacacagctgcctaggcctccacaacacacacacacacagctgcctaggcctccacaacacacacacacgcgcacacaccagtctaggcctccacaacacacacacacacacacacacacacctgcctaggcctccacaacacgcgcacacacaccagtctaggcctccacaacacacacacacacagctgcctaggcctccacagggccagggtgttcagtgtcactgttttcccctccacctcttgtcccactggagggccttcagggacaggacgcagacggagccatgatctcctaggataacaataccttctcctggaagaccctcctgaaggacccactgaggctgttttacaatttactttcttttttataagtaggaggatgctgtaaaataacaaagtacagtaaattcataaaccagtaacagttgtttgtcatcatggttaaagtattaagttgtgtacataattgtatatgctcatcaaaaacctaatccaccgtgcccaagtaggcttcatctctaagatgctaggtatcatatgcaaataaaaaaatgtgattcatcgtgtaaacagaactgaagacatgattgtatgtgctgtgcttttatatgactggcagcacaggtttgtttagaccagttaccaccaccaacacaagtaacgtggtgtgcttcagcatctctaggcagtagaaatttttcagcttcgttacaggctcatgagaccaccattgtacacggacccatccttgaccaaagcatcgctatcctgggacctcagggatgctgatttttaaatttttttttagagatggcgtcttgccatgttgcccaggctggttttgaactcctgggctcaagctatcctcccacctcagcctcccaaagtgttggaattataggcatgaaccaccacacctagcctacaaaaacattttttttttagttagccgggtgtagtggtgtgcgcctgtggtcccaactacttgggaggctgaggtggaggatcacttgagcctgggtggttgaggttgcagtaagctgagatcacgccactgcactcaagcctgggtgacagagcgagaccctgtctcaagaataaagattgcaacaggttgtaacactttgagtaaaataggaaattttccaactattcagatacacagatgaacaaatggaaagcttgatgagaagtgaggatttctatagtagccatccacgaaatagttaaaggaaagagagtcttcatggtggaaaagcctgaaccagctggtccaggcaaacctcagtgatggtgaagcctgtagcacacagcgggtgggatgaagagagccgcatccgcgatactcctgccgaagatgcctgtcctggatctccccatgtggaagcaccagcccccaagttaggggactgattggacaatgcacctgcctagaatcttcccaaagcctggtgtcgtgagagtcacggaaacatccagaaactcgctctgggcagcgggaagctgagagccgaccactttcttgcagtgtgcctgtgcaaactgggtaattggggatggctagagaaacttgaacagggtctgagctgggacaggaggaatgcgttggttttctgattttgatggcttaggtgtttatggaggaaaatagacttgtttgttggaaatcccccctgaagtgtctgggattacgcatcaggtcagtgattcaccattagataatccaaggagagagaattattttaaacgtacttgtacattttctataactttgtgattgtttgaaagttaagtaacacaaataatttgtgtcctcatcctaaagctttcttctgtcatagaggattgtttatctgagacatatgagtataatggtattgtttcaaaatattttttaagattacacctgtttttaaaaattgtgtcagatagcctgtattcatgtattggaagattcaatattattaaaatggtagttctccccacattgctttataggttcaatgtaattcctaccaaaatcttggcaggctattttttgggggttttttggggcagaaattgataatatcctgaagtaaatataaaggacccacaatagtgaaagcagttttaaaataggttaacaaaattggagaattcagaacttctcattcctgatttcaaaaatattgcaaagctgcaataaccagaacaatgtactggcattgagatagagtgattatatatatgagaaacagaattgagagtccagaaataaacccttatatttatggtcaaataattttttaatagagttacccgagcaattcaatgaagaaaagtttttccaacaacagatgctgggaaattcggacattcacatgaaaaggaaaaaagattaaaccttgactcaacgtcatatacctaagttagttcaagtggatcatagatcttaatgtaagagcaaaaattataaaaattttagaaaacacaggagtaaattttcataatcttggttaggcacagagttcatcaaaggtatactacataaatactgataaactggactggaacaaaatttaaaacttttgtatatcaaaagacagaattaagtagaaagacaagccacagtctgggaaaaaatatttgcaaattataaatctcatgaagcacttctaagcacctatgtaataaattttttctttttttttttttttttttttgagacagtcttgctctgtcacccgggctggagtgcagtagcttgatctcagcttactgccacctctgcctccaaggttcaagtgattctcctgcctcagcctcccaagtagctggaagtacaggcatgcaccaccacacctggctattttttttgtatttttagtagagacagtgttttgccatgttggccaggctggtcttgaactccttacctcaagtaatctgcccgcttcagcctcccaaagtgctgggattacaggcgtgagccactgcacccagcctatgtaataaacactcaaaactcagaaacaagcaacataaacacgggcaagagatctgaatagatatctcaccagaagaagacatacaaatggccaataaggacgtgaaaagatacctagcgttaattagggaaatgcaaattaaaaccacagtgagataccacttcacacccactagaatgctgtcaccgaaaacacaggaaataaagttggagagctcgtgttttctgacttcaaaacttacactgcaaagcaacagtaaccaagaaggtggaaaaacgaattctcatacattgatagtgggaatgtaaaatggggaagccactgtttggcatgatcttaattaagcagacttgctgcattgactcagcagctgcactcctaggagaaaggaaagcgaacatccactcagagacttggtgtaagttccctggaacctcggtcaacacaaggaaacaatccaggtatccgctagcaggtgactgaacaggtgacgcctgccacgtccacatggtgggtgcttctgcacaggatgagctcagaagcacctgctgagggagggaagtgtggctgtgtggtaggcagtgtccagaaaaggcaaatttgtaaacaaagtagaatgatgactggggctagggctggaaatgggactgactgcagatggacacgggatccctttcaggtgatgggaatgttctagagtagtgaccattttacaactcttcaattttattaaaagccattctgtgcttaaaatgagtgaaacttagggtatgcaaagtatacctaaataaagccgacgggtgttttaaaaagaataggccgggtgcggtggctcatgcaggtaatcccagcactttgggaggctgaggtgggtggatcacttgaggtcaggagtttgagaccagcctggccaacatgatgaaacctcgtctctgctaaaaatacaaaaattagcctggcgtggtggcacacgcctgtcatcccagctactcaggagcatgaggcaggagaatcacttgaacccaggaggcagaggttgcattgagccaagaatgcaccactgcactccaacctgggcgacggagtgagactctgtctcaacaataaaaaataataaagtgcttcattgcagtaactcaagtgtgtagggagaccctgggctggatggcatgcctgctggcagacagggtatgacccaggacccccaggtgagatgaacctgtcttgttgaattcccaagttaggagagttttcagttgttggtatattttgtcaggttagtaatctgaaatcatcaaattgctaatgtgcgaatgtgtattacttaccaaaatgtctatttttattctttttgaagttaagatctgaagaacagctcaggttcccaacattctcagagaataatgtcttgagaataagcaacctgctcttaagtaggtttgtcttgtccatagcagaatttattgccagtgccaaaaatcaattttggctaatacagcaattaatcaaaatttgctgtattgagtgaggtaagggcaattaggaaatcatgagttgggttttctatttgtttctgctgtcaagatttgtgttttcttaatgttgatttcttatttatggtgatgaggagggaggtgaaactatatttagttttcacaagtatatttgaaattctctggccaggaattcacactgggttcccaagcccgttgtgtgctgacaattctgacagagcaaatcattaatgctgatgtgtatttttgaggaagccacttccagggacacttagaaatggttaaaatgactttgggtgtccgaggcaggaggattgcttgaacctaggcgttcaagaccagcttgggcaacatagtgagaccccatctccacaaaaaaagttttaagttagccagtcatggtggtatgtgcctctagtctctagtcccagtcatggtggtacgtgcctctagtcccagatacttgggaagtgggaggatcacttgagcccatgaggtcagggctacagtgagctgtgatcacaccactgcactctagcctgggtgacaaagtaagactctgtctcagaaaaaaagaaaagaagtggttaatatggtaaatgttatgttacatatgttttaccacagtaaaatttttaaaactaagatgaaatggccagtttacagcagagtaaaaattcgaggcctgatattcaccccttatgtgcctaaccctgttctcaaagtattaaacccttggaaaggtcactatttgctagaaagtcgtccctcggtgtccacggaggagataggttccgggaccactgcagaaagcaaagagcgaggatgctcaagtccctgatataaaatggcatcatacgagcacatcacctatgcacttcctctctcatgttttaaataatttctggattacttgtaatacctaacacaatgtaaatgctgtgtgaatagttgtactatgttgtttagtcactaatgataagaaaatctacaagttaggtatagatgcagattttttcatgaatatctttgattcatggttgaagccaggggtgaggaacccacagacacagagggctatgtgtccttttgaaaagaataaatcaagctttggaataagaatgaggaaagaaatggaaaattgcccaaaaacgcctttgtcacatttgccgaagagtagtttttcatactaagggtcccgtttgaaataaattttgttagccaacctaacttccttacatttctttagttggattctcttataaacaattatgaaaatttttagatgagattggctacattaaagaactggctttagtattatagcatagtagttaacaaggcctaactcgttaatcatagtgctgtttcactgataaaattttgcgtaggcctcttatggcagctcatgcctataatcctagcactttgggaggctaagataggaggagtacttgaagccaggagtttgagaccagcctgggcaacaatacgaaaccgtatctacaaaaaaaaaaaaaaaaaaaattagccaggcatagtgttgtgcatctgtagtcccagctactcagggactgaggtgggaggatggcctcagcttgaaaggcagaggttataatgaacccagatcacaccactgcactccagtctgggtgacagagtgagaccctgtctcaaaaaaaaaaaaaaaaaattgtgtaggttgggcatggtggctcatgcctgtaatcccaacactttgggaggccaggcacatcttacatggccacagcaggaacaagagaggattgcttgagccccgaagttcaagatgagcctaggcaacatagaccctaccactgaaaaaaaaaaaaaacaagcatggtggtgcacacctgtggtcctactgactcaggagaggcaggagaattgctggagcccaggagtttgaggtgacaggtagctatgattacaccaccctactctagcctgggcaacagaacgttcccgttaattaaattgtaaatcttagaacgtgatttatctaggatattttattttaatgtatggtatctattgtgaattcatagtagtaaacaaaattaaaaccattaaaaatgtagttttgacaagttgttaaatccacacttaccccatcaattgataaaatatgtaatctatcactttttcatttctctaaatctgttctctagtatgaaggtaaaattaaagaatcgttatttttctctatttcttctgtttggtaattcgttgggatcctttttagtaaaaatctgatcttaaaaagattgagtgactaactttaattaccataattgtctttttttcaccctggctgtcagttttctaaaccaggtataggcctgctctttattaaattgctgtttggtaaatattttaggttctgtggtctctgaccactcagctcaaagccactggagacaatatttaaacaaatgagtggtggtggccctgttccaataaaactttatttacaaaaacaggaagtgtctgtggtttgccagctcctgttctgaagctggactttttttttttaaaccgaaatttgatccctgtgttttctactaagaaagaggatccagtttgctgatgtcgcaggtctgagagacatcacagcatcacagcgtttagtagtcttaaatgtgtgttcaaagtggtaggaactgccccatgattctgtagtacgtatttgcttttcagaaggctttcgtgaacatggttgcagtttgcagcgttggctttactgtgcccttctacagatggcagcacgggctgttccaagtcctccttttccttggagtcagtgctgccctgagccctccagccttgctgagctccagccttgctgagctcccgccctgacagcctcttctttctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggtaagcagctcccttggcagctcagtgccctgtgagcccacagggactcctttctaagaaggcacatctgtgatggggtgaagttaaaacagtcctccaaaacaaagcctgggtttaatctaacgtcacctgaagcttacaaactgcctttatatgaaaatctttttaacgtgaatatttccccacgaccacagacagtaacgaaccagaatgtaaaatattttcaatgcctgtcattccactgggtctacttgaaagatcctaaatttgattttttgttgggtggattcagtgttctgaagtgttcagtgttcagaagatcttaggtgatgttaactttatttgatactggtgtttaagaaggtaggtttgaatttagccgctcacttttattttccctggagaccctgatttctgggtctggaccctaagctcaattcattttacagttcagttaacagtgttgtgtttcattttttaataattgctattatgtaagaataatagtatttccctccatttaaaccaaggacattttgatacgtatatcttcatggtaaattaagtagtccttagctccaagtaactaggagggaataatcatctgaccagttttgataaaatttcaactgactttgtactctttggatgtgtgtatgtctttgtatatacatggattgtgtttgtgtttctgtcatctacacagagatcaataacggaacagtacatttatctgtcctgcattgttttcctaatgcataaagcttggacaggaaagcaaaatgcaagataactttatgtaacataagtaattgtgcaatcattttaagtttttatataggaaaaagttagcactattcatgttcatctatattgtattagaaagtgagtacattttcatgaccttcctgttggcacatatataaataaccagaataaaatcatgacatagttgagggtcagtatgcaatttacgtattcatttcatccttacaatagctctctgaaataggagcccttattgtctccattttaaagctgaggaaacttatgtcatagagaaattaagcaacctttccaggttcttaggctgaacgaacctggagccaaatttagaatctttggcttcagacctgctgttgcagctgcatgctgctttacctctcagacgtgcgcgcgtgtgaatatgtaatttgtgtcacccagacttgagtttttcctgtttaactctgtgtgtacagtcgtgtctgtacactgagcacgaatgtcaaagccagctcgagctgtgcgtcctccttgctcaggacccttgtcggttgtccgtgtgccgaggctgccttgaaagggttcgcagggcctgacggttggggttttggtggccgcccccttagcagctctgggttccactccaagacgcagacattcacggctcgccttcacattcacaagccattcctgtcgctcccttactttccctctgctcggcccaggtagtgccacagagtgagctgagcttaactccttgaattcctgtatgactttttctgttgtgctcggctgactgaatttggtgtggaaactgagatgttgttaatcttttgcttactgtggaaacagacacgcttgagaatgagaagaaattcttggcgtaatgggacataaatggagcactgtctatgaagtcatccaaaaattttagttttatattcctatatattaaaatgtaggttttcaggctgggtgtggtggtacatgtctgcagtcccagctacttgggagaccacaaggtgggagggtcacttgagccgaggagttcaactccagcctgggcagcatagcaagatcccatctcttttacatgtagatttttcccgttcctctccagtgtgtgttctggtacatccatgcccagaagaatgtatcagatggctctcttttcccgaacggcctttcatcgtctcagccaggaagttgcttttcctcaacctttttcctcataacagttcttgctgtggctccaggtggttgtttgagacgtgtttgtaattccattcttaatcatttgaatagttgtgtgaatgttttttcaccaactcctggtttgttatattgaagaagtggacacaggtggccctggaaatgcatagctgtgttgagttttccaatgtttacgtggggatctgtgggaaggagtctctggctcactccaagctcgacacgtgggggctgactcggtttctctgtcatcatctccaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcaggtgagattcggcgacatcacagtgctgagtgggaagtgtggctcccggggtgggtacagcacagactggctccactcgtctccctcggctgatgcttagctacatccagaagagatctttcagtcacacgcatgcggttggtgcagatctctgtttctttaaactacagtctacgttcgtatccattattcataacaagcattcataggacttactctgtcctggaacattttaacttttgtgacaggggtagcagtttgtccagacctctgctgttcgactttttaaagattagatactagacagatgaagaaaccagtccctcgaagtacttagtcccacgcgtgtagacgatcgctgtaggaagaacttaatgacattgagcaggttctgggatttgctgctgcaatggcattttagaaaccgcaaagccgcacttctgggaaacaggcgtaagtgaagcagctctagcaagacagccttgcattaacagtggctgacaagctgcaggcagagctgcggatttccttcctggaagaataagggcttccctctcagcaggtgctggtgaggcaaacggttggtgtgcatccctccacctccctctccccaccccctatcctacttgtgatcccagagtgattgcttaaggttgctgctgggtgagcctccgaaggctccctctgcccttttcacgcctgtctaggtgcttggagttagccactaggtcagaggagggaacctcctctcttcccgagatcacttcagaaaaagtagctgcaaaaagcttttcttgatttttcttttacttttttgagacagggtatcactctgtcacccaggctggagtgcagtggcgtcatggctcactgcagcctcaaccccctgccccccgctcccaggctcaagcaaccctcccacctcagcctcccacgtggctgggactacaggtgcacaccaccacgcctggctaatttttaaattttttgtggagacggggtttcaccatgtcgcccaggctggtcttgaactcctcagcttaacaatctgtctgccctggcctcccaaagtgctgggattacagacgtgagccactgcacccggccttttttttaattttcataaacgtggtgttccttgcttctgtcttgcttctcttttaattattataatagctccatctttaagaaattataaattaccaaatttctctcaagagtcagttaaaccttgtcctatgattaaaataatacccttttctaagaggtcatctgaagaattagatttatctcaccaaactagttcttaaaatattgaagttttctctgcctattcacctttttctgttcctcataaatgtttatcgccatctatcccattaggagaaataggaaatgcagaagtctgcttcttaagttcagcaatagtgtgatgtctcacttgtctccatccaccagtgacagggacccccgggcaagaggaaatcagtgatttgtgagagatggcactggccatggcgaggctgctgcttctggctttgtctcttaaaatgtcaaggtggcgctgaagggagagagcagagagtaacccgtcgcatcgtgccctccagcaggtgacagagttcagcgtgtggtgtaaaattggcctcttgtagagtacatacatttattttcctctttactttttcatttatttccatccacctggatccaaaatgttttttttttgtttgtttgtttttgagatggagtatcactctgttgcccaggctggagtgcattgccgtgatctgggctcactgcaagctccacctgctgggttcacgccattctcctgcctcagcttccccagcatctgggactacaggtgctcgccaccaagcgcagctaattttttgtatttttagtagagatggggtttcaccgtgttagccagcatggttttgatctcctgacctcatgatccgccttcctttgcctcctaaagtgctgggattacaggcatgagccaccacgcccagccccaaaatgttttaagatggtttacaaggaaggagtacgctcagtaggagaagataaaatacgtgaaaaaagaaccaaaacatggagatgaaagaaaaacagcgcaggaaagggacagaatgaagaacagagttggcgtgctggtgttttccacaaggcttctgaagcgtgccaccgtccttacctcggcaccagggcggggcctgacacgtggtggatattgaatgaatgtgcgccgtgggagtgttgagcacggttctgtattcttaataggaaatggcaatatgttcttgtgcagaagacaattctgtcaatatgaccgctaaatcaaaattcagtattctaatcatgggtcatggcgttattttgcaatcttggcagcatctttaagcatttttgtccatgttcagttttctacttgacctatccctaactcctttcggtcagcatttccttgtctgcatagtattggaaaatagttggaagtatccaagtgtctaccagcagagagaaattaaatttatgtacaaagcaatgcgagctcacctccccttcccagaatctttgagggcaggtgtgcttcggaattaggtttctggctttgtgagaggtgatgtggcacagatgccatgcatgatgccacagctcagtatcacatgtgccagtgttcctgcagcaaggaagggtgggggccccagacttgaaggggctcatgtcagcctatgtcaaattttactacaaagaaacttatgacaaagtttgtgccatcatcaaacatttctcacagtcagtgagttggacggtaggcatgtagataattttttcaggaagtgactcattttagtaaaagcgagcagtgagaggatagagtgccacgaacacggggaggcgttctgggggagggcagtcaggaacgcttcagcagagcacagtgaaagggcggagtcgtgcgggcgagagtccagcgaaggcagccgtaagtgcagaggctacaggcagagctggtctttggaaacactcattttctagaatctgcaaaattaaaaaaacctgatggtgatagaaacaagcagagtggagaagcccaggatccagcggcagaaaccacctctcgctccctggctctccatagagcccagcacacaggacatgcctggtacattaaatgtacggaccacactgctcatgagtcctaataaggaaagcctgaaatgtttctgaattttctatacattgaatttatttttctttataaaagaatattttagaaaacaaaatcagaaaatacactttagcttataaataacagtcataaacccatctaccctgagataatcacaattaatcatttgatgtaaaaaatcaaaaacacaaaaaattaagacactgccagaattccaaaccttgtacctaaatatttaaagatgttgaaaaatgtagctttcagtttgaagcagcagcatcgtgagtgagtgtggaaacgggggtgtctgctctcagactgactgcgttctaacaacgctggtctctcgctggagccccgcacccccgactgactgttctaacagcgccggtctctcgccggagccccgcacccccgactgactgttctaacagcgccggtctctcgctggagccccgcacccccgactgactgttctaacagcgccggtctctcgctggagccccgcacccccgactgactgttctaacaacgccggtctctcgccggagccccgcacccccgactgactgttctaacaacgccggtctctcgccggacccccgcacccccgactgactgttctaacaacactggtctctcactggagccccgcacccccgactgactgttctaacagcgccggtctctcgccggagccccgcacccccgactgactgttctaacagcgccggtctctcgccggagccccgcacccccgactgactgttctaacaacactggtctctcgccggagccccgcacccccgactgactgttctaacagcgccggtctctcactggagccccgcacccccgactgactgttctaacaacactggtctctcgccggagccccgcacccccgactgactgttctaacagcgccggtctctcgccggagccccgcacccccgactgactgttctaacagcgccggtctctcgccggagccccgcacccccgactgactgttctaacaacactggtctctcgccggagccccgcacccccgactgactgttctaacagcgccggtctctcgctggagccccgcacccccgactgactgttctaacaacactggtctctcgccggagccccgcacccccgactgactgttctaacagcgccggtctctcgccggagccccgcacccccgacggactgttctaacagcgccggtctctcgccggagccccgcacccccgactgactgttctaacaacactggtctctcgccggagccccgcacccccgactgactgttctaacagcgccggtctctcgccggacccccgcacccccgactgactgttctaacagcgccggtctctcgccggagccccgcacccccgactgactgttctaacaacactggtctctcgccggagccccgcacccccgactgactgttctaacagcgccggtctctcgccggagccccgcacccccgacggactgttctaacagcgccggtctctcgccggagccccgcacccccgacggactgttctaacagcgccggtctctcgccggagccccgcacccccgacggactgttctaacagcgccggtctctcgccggagccccgcacccccgacggactgttctaacagcgccggtctctcgccggagccccgcacccccgacggactgttctaacagcgccggtctctcgccggagccccgcacccccgacggactgttctaacagcgccggtctctcgccggagccccgcacccccgacggactgttctaacagcgccggtctctcgccggagccccgcacccccgacggactgttctaacagcgccggtctctcgccggagccccgcacccccgacggactgttctaacagcgccggtctctcgccggagccccgcacccccgactgactgttctaacagcgccggtctctcgccggagccccgcacccccgactgactgttctaacagcgccggtctctcgccggagccccgcacccccgactgactgttctaacagcgccggtctctcgccggagccccgcacccccgactgactgttctaacagcgccggtctctcgccggagccccgcacccccgactgactgttctaacagcgccggtctctcgccggagccccgcacccccgactgactgttctaacagcgccggtctctcgctggagccccgcacccccgactgactgttctaacagcgccggtctctcgctggagcccccgcaggccttccctgactgtgcactctggtgggggacgcctgatggagagagggaagagttttatctccaggagatagggagcaaactcagcaaagaacattgtccaaaagagagagggagcctcacccgtgtgcagcagggcttaggatgtgtcaagggcatcacggtcagagggggtcctggtcttcggggaaggctgagctgcacagttcatgagtgttatgactgcaggatttcaaggcctcaccggtgctcctgagcagtgctgcatcctcaagggcgaagccgcatgcagtttttccagtgctgacttggcgcctggacaagcactttttagaacatacctgacacaggaaacattacaggtgtacagagacacattgggtgtttgtttttactttgcaaaaatcggctctatcagtggcactctggtcctcccaccatccagccccaagcgtctgcctccccttcgtgcagttgttcctaagccactttctcatgcagtctttcctgcttcataacccggacactgtgctcggcctggatggactctcctctgccctcatcctgctccgcccgggtcccctccatggggccttctcgaactctgtcagctgcggtgctctctttcctctgaattgccagtgtactttgttcctcctccttcacactttccagctgctttttaattatttatcaccatgtccatgtcgcttctgctctgtgagtagctgttttacagaacacagttttttctttgttgttgttagtgtttgtagagacagggtctcactatgttgcctaggctggtcttgaactcctggcctcaagtgaccctcccacctcagcctcccaaagcactgggattacaggcgtgagccaccacactcagctaagagcatggctttatgaaagaatctccctccctgagtgtccagtgccatctcacatcatcacagtcacttctggatgttggatacattttgtcaaagtactgatacttgatttttttttttttttttgagacggagtcttgctcttgtcatccaggctggagtgtaatggcatgatctcggctcactgcaacctctgcctcctgggttcaagtgattctcctgcctcagcctcccaagtagctggtattacaggcacctgccacctcgccgagctaatttttgtatatttagcagggacaggattttgccatgttggccaggctggtctcaaactcctgacctcgtgatcctcccacctcagcctgccaaagttgattcttttaagtgccaatctgtgtgtgtaaatacaattcacattagagaaattaaacatatccttacttgactagagtctagtctcccgtggaaaatgacttggcatgatgaattttctcaaaatgaacccctggtgtgaatcttcaccagctaaaagctcatatgccatctgtaactgttccttgcaaatgaaaacccagggtttactattcttcaaccttctaacagcattttcctctcaaataggaagtctggggcttgcaccttaagagtcattcacgctggaaaaatacattctttagtcattgcattggaccattggattcagacagcatctagttaggtcttcccatgctctttaagggaattcttagttgttttaagatgagagatgaaggccctgagaagtgaactttcctaattgacaaagctaggaggtaaaaacagaacaaaatttagaagtaaaagctatttgttactcttaggagtaacatttcccagtacctttagctggaaaaatgactttaaaagaatttcaatttactaaatttatgataaaagtggacattagaaagatcaaattatgacttctgtgtttaattagctttcacataaatttctcttagtattattagaaggtgtcacttattatttggaaatatatttctcacagccacaattactcttcaaaaatgtaagctggaaggtcttttgttgcattagatttagagatattgttcactgtaacagaaaaattgcatcctccttctagtagaagcagggaagaaaaacatgaggtcttctgttttccaaaagagaccgcggttgtttatttattaggaaaaaaacataaacagaaacttggatttctattatatagaaaaataactgatttatctgagagggcagctttattataagtagctttgtgtgggattaaatcaacagtaactattgcagtgacccttaaatcttgaaactcacacaatgaaagagaaatacagcccccctagtaatagaaggagtcatggattgttgaaagaagtgagccaggcgcggtggctcacgcctgtaatcccagcacttcaggaggctgaggcgggtggattatttgaggtcaggggttcgagaccagcttgcccaacatagtaagaccctgtctgtactaaaaattcaaaaattagcccggttcattggcacgcatctgtaatcccagctactcgggaggctgaggcaggggaattgcctgaacttgggaggtggaggttgcagtgagccgagatcgtgccactgtactctagtctgggtgacggagcaaacagagccagactctgtataaaaaaaaaaaagaaaaatgtggaaggctcaggagatgatgtaaatcttaattctcaaaataaatagttgtaataataagactttcattaacttgagctctcagtttccttgtccccctacactgcttttaggtgaaggaaataaataaggtgctgttggggattttgaaagcctcagggaatgagccaccgtcagcaggaactttatgccctttcctgctgacacacggcatcccagccacgctggggatcatggaaaccatattccaggtatcctgcacgtcagccagctttctgacctgtaagcaatggaaacctcctttggcagtttgaggcaccagtgagtggctctcagaaccaccaagggagtaggaccagcgttgggaacctgcctatgggaaccgcttgtgcagcagcttgttcttgtgaggacaccacaccttgaagtctgcactgctgaccttgttcctggacacgagacttccccaccagcatggcattccccaaacctggatcgtgtctggacaccttcactgccgacagcaagagcccgattggtttgtgctgtaaatggatgtgactggttgatcgtctccccacaccctagcttccaggaaggctgggaagggacttctggtatttttacttcctacagagccacaagggctctgtattcaaacaggactcaaaaagtggaggagttctcccgatacaggaggacggttgagatgtatggtgaccaaagtgtggcagcggtggctgctcccacccctccctttcgccatccagcatcactgtgttctcgtcctgcccttacgcatctccatagccccaggaagccaccgtgatgcagctgctgcttttacgtctactcaggcacttgcccttcatgcaaaggggagacaagccgaagcctctggaattaccatgaccgtcatcaaacccacgacttcctaggcgatgcctcctctttctctggttccatcactgatattctgtgatctacagatggaattgtaaaatttacaattgagggatgaagagagagaaaagaagaggaacattcgaattctaccagtgtttttggatgtctcacgtgccctaggcactgatggacactgcactgaacagataatcatgttggatctgcaaggtgctaagtgagtctttccatctgtctccaggaatgttggagtcaccgctggaagagtcttagggacccaggagatcatgatgagggtctgaggggtgtaactgcacagcttcaagtgttcgcctggctttcagcaagggattctctatcgcagtcacagaacatgcctggcttttagtctatgtcttgaaccaaaaagcaagaatctgagttcatcattcactcagtaagttcaacaaaaacagccgtgccgtgtcacgtctgggtgctttcatctgctctgtggcttggcagcccctaaactaaagccttcccacgccctctctctaaagtgtcagagcatggcgtccaggctgccagcctcatggtgctttccgcacagctactcagctctgctgtgccactcaaagcagaaacaggcaatatgtaaatgagcaggcattgccgtgcttcagtcaaactttacgaaagccagtgtttggctggtcctgatgaccagcttgctggtagacggcctgagctgagttcacactgtctgtggcccccaccccaccagtaatccattccagaacccccatttcctgacagtttgtcacctgcatcaatgcctgatgacaacatacagatccatccatttgatgccaaccatagaaacaagctcaatgtgatttttgcaaatttattttttaaatattttggaattccattttttattgagatgtagaagtcacaagagactcttgttccaaccataaccgtcggaacaatctggttaatacacagactcatcgtttctaagatccatcagagagctgaagactcaaatgtagatgaattacatttcttcctaggagaaaagagacctgtatgtggtttttcccatggcagaggagccaggagaaagaatttaccataaaaaatgataaagcaaaaagtttctgaactttttaaaaaacataaatggcagtatgttatttgcaaggtagatgagaatcccaggggagtcctaaaagtggatgcattttctctgaggcactctgaacctttagtgtgcaaaaggcaggggctcctgagggctgggaggtgagcaggaaagccgctggctcccgctcgagggtggcctggatcacccagcagagccctggctaccctccagggcagcccaaatcaccgtgggaactccactcacacttcaacaatggaggtgggatgagggcatagcacatccctctgcagcgcccttgcccttcaccatgtgtaacgtatttgccttccaaaggctgggagtgtggcagtggaatagaggaagctgggggtgagactgaagagagaatcacccagttacctaaagtgggtggaaggtctcctactgtttggaaagcagatctctcgccgtgaagcatagaagacatccagtgtcagtgttcaggcccagcatccggatcctgcccataggcttgtaaattcttttctgggggtaaatgttatttaatctttactgttcttttaaatacaatcttcgtttttcataaaacattgtgttatataatcaaaatttaaaagacctgcaaagaagcaagagaaatggactcatgttcatgagaggagatggccctagaaagagtcagtagaagagacatgctgcaattatcagagacttcgaaatagctgtgataggtgaggccagaaattcgttgaaaaggtgtacaacatctatgaagaggtggggggtattgcagaaagataaaaactatgagaaaaaacaaaatggaaatgctggaaatgaaaactagtattagaaataaaattcccatggtttaataggagactagatacagcagaggaaagactcattgaatgaacttgaagtctgaccaatagaaatgacctaagcataaaacaaggagaaaaggcatgaaaatacagtggaacagagtgtctgaggcccgtgggtctaacatacctgtagtgatcggagccccagaaggagcggtgagagaaaatggggcaagagaacaatttgaagacctatggccaggagtgaagggaagaatcaacacaaagattcaagaagctcagtcaactccaggcagagtaaatgagaagaatcacacccagatgctttgttgtccaaacaccgaaagtcagtggcagagtcaatcttaaagtccctgcagaaataaaactaagtagggggaagtaataaaaacaacactgagttctcatcagaagtgctggaagccagaatacagtggagtggtgcatgcaggctgctgaaagagctgtttcttctgcaggagatccttcagaatggaagagaaaagcagatacttagccaacctagagaatcgttcagcaaatacgtgtcacaagaaatagtaagaatgtctcaaggatgaaaataaatgatagcaaaatgaagcccaaatttttaagaagaaatgaagaatactgaaaagagtaaatacaagaaaacgttttagaatctgtcaatatgtagacatgtaaatatttttagtttgttttaaaagtattaactgtttaaaaatatgaacagctgaggtgttcgtagcatgtgtaggaataacagatgagacaacaggaagttgggccccggaaatgcactgctgcaagaatcttcattttcatagcacataacactgtgtgaagatagaatgcaataaatcattcaaaaaatacacagagggtaaagtgaaataccacaaatattctattcatgagaaaaggaggcaggaagggaggaacaaagaaagggacaagtaaagaaccaacagcaatcgcaccaataaggacgtgaaaagtaaatgaactgtggatgatgtgattgctgaggtcagaatgtctgtgtccccctccaaaacttctgtgttgaactataatccctaatgcagtagtataagacatgaggcctttagaaggtgattagatcatgagggtggagccctcacgaatgggacttccacccttataaaagaggcctaaaggaacatgttcatccactctgcaggtgcctcaatctgggacttgctagactccagagctgtgagtagccgttacctagtctaaggtatttcacagcaggcggagcagacgagcacagagggactcgtatcgccagacccagcctcgtcctgatgccttcccatgtgcaggagaggcaggcactggccacagaccatgggaaggacggcgtccagctgctgggtgatccggtgcagcacagggagggccaacctccctctcaggcttctttaaggaaatcctggctggtgccgagtttagaaagatgagttagcggtgacgagaccggggagggaagagcactctggaagctgagctgaagcccctgcaacttcagaggggtcaggaaagatgggaagaggccagggtggctagaaagggaggacgacggagggctgcaccaagcactggtccttttcccaagatcagtgggaaattgttacagggcttaaggcagggacctgtcatatttagctactggttttgaaaagatcactgggagtacatcattaaggcttctctaagccggtaacatttccacagcccccagattttaatgcaaatataaaaattcttctggaaataggagtacaaagaagtagtcaaattttgtgtcattttcctttccatttgaagagtgtcatttgcctggagacatacaacccaaaccttttctcgtcttctcagacttacctagtgtactacataagcccagtatcaggtctttggagtttgttcgttctttcacacatttctatttactatagccctatgtgcaagtaccaggttgtgctaatattatggtgtgtgaattgctgaatagtaaaatcaccagtcagcttaaatgctaaaattagtgctgttttgtgttttctgtgctgatatttggggtgtgagtctgtatatcttcacctgagatttaaatataactcatttgttcaataagcacttaatacctaattgatataatacttctgtgtcagtaagaaagttattttttggtatatacatttgtccctcaatgggggacaggtttccagactccctgtggatacctaagtctgcagatgctcaggtccctgctggaaaatggcgcagcatttgcatagaacccatgcacatcctccgtgtactttaaatcatctctaatgacttgtgatgccgaatacgatgtaaatgctgtgtaaatagttgtactgtatcattcagagaattatgacaacaagtctgtgcctgttcaggtgcagttttttcgaatatttgggattcaaggttggttaaatctaaacatgcgaaactcacagatatggaaggctgactgcttaacatttttattatataactggattttaatgtgaatccttttttctcgttcatataacttggaatttcaaaaatgctttatctttgtttctgaatgagctttagttggaatgggttaatgctgtttgtctgtgggtcctttattgcaagtatttgatccttaaatactgaggggcactcttttgcattagggatctccgtatttaagggaacactggctagcattctttggcaatatgaagattttgttaaatactccctcaatatgtatcttgaaatttcagactttttacctcaggggttttataatttggaagcagctatatcttacctctttatctccttcatgtattcttctctattaatgcttaggcctacttggcttcaggtgctgtgttgcctcctccacgtggtacaagataggaaatgaggtacttagccgtgtacattttttcctgagataccaccttgacccattataacaatttctgaactaggataatttagagagaatgttgacttatttttatttttgttccagttaatatttaggtttcaaggaatcatgaaggaaagaaattatttaaatcattgcattcagctcaaatatattcagtaaaggtccactatgtgtttggagcatacacacctttattggcgagttactttatttattcatgctctgcctctctttttcaaacataagggtgctgagagagaagagtagccataattaccctagagaagtaacagagaagagtggaatcgtgattttcttttaaaatcttgaaccattgcttattttcatagacttggctctgttgtgagtggtggcagtttttccattgggctttgtgaccaaatttgagcctgaagaaaaccacttaactccgtttccactgctgcagctgctgtctctagtgtctgcctgttgccgtcatggggttgtgggtgggtgccgggccgtacacacaaagcacaggtgtgcatcagtccaggcgcctgtgaaaaatcttctactctttgtactttttgggaatatttgggaaagacagctaagtgacatagggaaaaataccttgcatccaaggagcttgcccaagttgatttctggaattgtccagcagctggggtagattatttaatgcgggtagcaggcagggaccacagccatggatgacgaggaggagaagaaaacagaagttggtgtctctgtttggggaacagcaacagagcacatttgctggggtggaaactcctcctgaggctgccgagcagaccgtgtgagagcccagcgctggattctttcaggcttcagatgcatgttggcctctccctttgcctcattgtgtaggtggatagagctagtgccctacttgcaggtgtaaaagctcacaggctctcctttgttcctggaatcagaaccttggaactacctcaacagatttagcaaatgaaacttgcactcccgcgtccctcagaaagaaagagcaccgtgagtgacacggtgcagtgccaccatttaccttctgtgtccctgcgccgtggttagtcacctgctacaccctcttctgttgctccgtggatatgttgacatctttaaaacatttcttttagccttgtacagtggttaattttaatgatttccatatttgatgttgtttttgatcttcttttcattttgtttcctgcttttcgcattctcctccccacccctccctcttctccatcccatttttcactgtcgggtcgtatgtgtctgtgtgtgttgtgtgtgttggtttctgttgtctggtgttctctcctctcttctcgtcctcacccttctgctgctgtagcctcacaggctgtggaccctggccgagcaggtaggggactttcctgtccatcacacccgtgcctccctgcccagccccgctgccttgcccgcatccagccgtgggacagactagcagttgagtgcagagattggccgggggtctgcaggccctgtgatcatgggtgctgccggccgggcaatgtcacgttcaggcctcacgcgtagccgacgctgtcttcccggggtgcgcggtcagtggttcatttgccagtttggttcatctctgttgtacttaattcttcacctgttttccatttacttatttttaattgaccctccatggctgtattttgcattactcactgtgggccggttctctgctcagcgctggtctgtggggcggctttgctgagcagccgggggtagagctgtcactgggagcgtccgccgggaggctgactcgcatgtgctgttctttttccctgtctcagtggtgagataccagggcccagggttattgagtactatggtatgttttcatgacattgtcttttttttttcttatatataagcaatataagaaaattttgtgcctttagtacaaaaattggaattctctcctgaagaattttagtgtaattcttcaaatgaattctgaagggctcccttattttttggcaaatttattgtaggtttagtctttttccaaccaaggtattgtactgccttccccaaaaatgagtgtacaattttggtttgtaatgcagccttcgtgatgctgctcttctgtgtacagaggtcactggtcagaagtcagcatggtgtaatttttcaagcaatttatggtgccaagaaaagatttctggacccctgtgtaaaatcaacagcccagtggaatggctcagaccacaaagtcctgcccagctctccaggataaaatgccccttccctgacctgtgtcttggccggaaatgccctcctcaggccagagagccagagccccagcagagcccggaggagcaagatgctcccctcacctcttcctccctggcctgtccatccatatcacacatctgcttcactgtcctgggccctcaaaatacaccttttgttaaaggtggatgcatgtggtaaaaatttctccgcacagatgcttcatatccttccaacctgcttttgcagcgccgtcttggcagttttcagccttcctttttttggcacagtgcgtggctttgtctcctttctttcctatttttatatattggcggtcaagctgtgtgaatccagtattatcctaataagatattccttctggaatttaggttatcacactgaaagttagcaggtgccttgagaggttgctggtctaagtgtttttagttttatttttcactttaagattttacaaaagaaatgtttcctaactagtagaagcacagaccccaatctccctccatgtaaacttgagttaaccactctgttgttgcttgcagggaacctcaggacctgacccaaccactgtctacgtggacatgagagccctgagacacgacaggtactgtacacttctgggttttttctttttttcctttttttgttttgttctgcggccttgcatgcaggtctccatctagaagaagaggtgcacacgatgtttatctgcccagagtgtaactgtctcatgagtgaagtggtggagttaggcattggcttgaactttgcaattgaaaactctggccaggcatggtggctcacgcctgtaatcccaggtatttgggaggctgaggtaggcggatcacctgaggtcaggagttcgagaccagcctgggcaacatggtaaagccccgtctccactaaaaattacccaggtttggtggcgggcacttgtcatcccagctctttgggaggctgagtcaggagaattgcttgaaactgggaggcagaggttacagtgagctgagattgcacctctgcattccagcctgggtgacagagtgagatcccgtctcaaaaaaaaaaaaaaaagaaactctgttgcaggacagcagtggcaggtgtgatagcaggagtatggccagagctgctttatctgaccatctcactggaaggcaggcactcggttcttttccttcctattttatgcaccattttgcccccgtcgtagaatgtcagcatcctgcccacatttctttacatgaatggaaatgttttgtcaagatgcttgaaataggggttaggggtcaggttaccttctctatgtggcctcctaagcgccccctgagaagaaaagtggagttcttggtgagagtgtgaggactccagaaagcaggcatggggttgagcaggatgagaagccctttagaggaatctctgcccgccaaggaggacccactaagatgccagagaggaaggaaagaaggcgtcatttttactgcagacttcccccgttgaaacagatcatcttccacttggtgactgtagaggtgcccgttcattgttgcttaggtgaagtgcgtgggacatggtgccttcccttatcgccgtcagcagccgctccgtgacctgttgctgtgtgtgcctgtgcccccagggatgtctgacatgcctggaggcattttcgatcagcacaagttgggcagtggctcagctggcatctggtggggggagaccaggggtgtcccaacagcctgcatgggacggccagtggctgagagctcacacgccagggccaggagccacgcccgccctgacggttcacactcgtagatgcatgcctggccctgtggctcttccatcaggccctctggtcgacagaaccactggctgcacagttataaaatcacagaagagtggtggccacgtaggagccctcaggaggccctgcaggctgagggccagaggcaacgcctgcccccaaggccaccagctgccagggacaaagttcagtctggaacacttagaaaaatcagaaatgtagttttagattaggtaacttgtttctgggcatacagttttctaaataatcacttctgggcattaaaacaaattcacctgactccccataagaattctttggaaaataactcataattatataacttcctgaaggagtgagcagtagctcatcaataacacatgtatgcagttctgtctgtggcctggccctcaaagcgtaaccttttccctgactaggctgctagctgctttggaaagcatctgaaatggaagtgagagtacataggaacaggagctggcggtgcagttcactttcccacacaccactgcatgcctctggtcggcacccacgccgctgaccgtcgctgctagctggcctaggctctcacccttgagcagtgccgaggggagctcctcggatgccagacatcttcatgagactcagacctggcattttacatacaaagaaggaaagcaaagtctggctgtaaagtgacttcctttcaccgggccccgcccaggcacccccaaagcctccctgctgccctccagatggaccgtgtgctgggccccgcccaggcacccctgaaccctccctgctgccctccagatggaccatgtgctgggccccgcccaggcacccccaaagcctccctgctgccctccagatggaccgtgtgccgggccccgcccaggcacccccaaagcctccctgctgccctccagagggaccgtgtgccgggccccgcccaggcacccctgaaccctccctgctgccctccagatggactgtgtgccgggccccgcccaggcacccctgaaccctccctgctgccctccagatggaccgtgtgccgctctttctcccgtgccctcgggtgggacaccacgctgcccttccctcccggcttctggggctgctctcactcttctcattcctttctgtttttttctccgcgatgttctctctttgacctttctaaccaggtctgtctgtggtcccctccgtctggctgggccccttctcccttacccccccactgcagagaatctcagcggcgtcccagtcttgctctccgatgccctcaccacccactcacagtccgcagcccccagcccacctccaaggagtgtggccccaggggccttttctccagtcctccaagccagccccaaagccctctccttccttaaacctcccttaaatattcctaggtaaaaatgtcatccagctttaatctccagcatcactttcaacctttaccagcatgtaatatgcctggtgctgcagccactggcagggggctctgggtcacacaggtcagaagtcagctcctctgggacgaggtattacactctgtaacctcagtttccctcttgccttagtctgtttccatttctgtaaaggaacacctgaggctggtgatttataaagaaaagaagtgtatttggcacacagttctgcaggctgtacaggaagtgtggtgcctgcatctgcctctggtcaggcttcagggagcttcactcatggtggagggaaagaggggccacaagtgcagagatcacgtggtgggaggaggggacagactgtttttagccaccggctctcccgggagctggtagagcaagaacctgctcacccccagggaaggcctgcatctatcatgacggatctgcctgcatgactccgacttctccattaggccccacctccaaccctgggaatcacatttcagcaggagctctgggggtgctcagaacaggtgcagtaaagccagtcttcccaggcacctgtgaggacaaagtaaaggaatgctgtgaagagccagactggggcagatgctgtcactatgagctccggcagctggatggtgacagaggactcacctcttctgatccaccggcccagggctgctgaccacagagggtgagaaagtcgacagtccaaggccagcagtcgggaggcagtgaaatgagagccactaaaagcactgatcttatttctttcttgttactcttcctataaaaatgggatggtggttttctcacttgatctgcattaggctctgtcacaggattaattactgttcctgttgctttaatggcacactcacttgcgagctccaaggcacctgcccaattatcgtctaattactctggagaaggttagcttattggtatgcacatgcaatttccttgagagagaatatgaatgtgcacacgcacaagaaagacggcctacagaggaagaccaccattgtgaaagtcagttgtcgaacaggggtattagccatttctgcttggttttctgcccctgtttctgatgccctttttattcttggagccatggtgggtgggacctgcctgcatctgtgacaggtcaccatggagagcatttctgcatcatagagtgaggggacacactctccctgcttctggaacagattacagtcccacatgtgcaggaaggaaatgatgaaattgtgttgagactatttgcaagtgactgttcaattttaaaatatttgttacagtgtaattcatttaaaatgaaatcataagtctctcaatgacttccaatttggtctttccatgaatacttgagtttttcagactttagataggaaaaaaatataatatatatatatatatatatatttgtctgcatttgaagatgcggttttaaggctgggaatgggctcacaccggtaatcccagtgctttgggaggccaaggcaggagaatcactggagcccaagaggtttgagggcagcctgggcaacatagcgagactccatctctacaacattttttaaaaatgaactaggtgtggtggcatgtgcctatagtcctagctacttaaaaagctgaggtgggaggactgcttgatcctgagagttagaggctacagtaagccatgatcacaccgctgcactccagcctgggcaatggagcaagaccttgtctcaaaagaaaaaggaacagttttagcaattttttacatcttaagaacattacattggtgtaaagtcctagaatgaaaactttcttagcttcctccgggcttgtaacctgaagtcataactaaagggtattaccagaaaagcatagatactaaattaattcctactcattggttagcccaagtatcaagatcctgagagcaggggccacagaatagaagtacatcagtaaacttgagacttagcagcagaatggagggagtgaagatagagacaaagacaaacagcttaacaggagcctttcacccgatcaggtccttgtgtgtgtgtctcagtgcatgtgtgagtgtgctgtgcatacatgcatgtgtgttttgcaagtgtgtgaatagtgtctgcacatgtgaatatgagtttgtacatgtgcgagcttgcctgtgtcatgtgttgcatgggtgagtgtgatgtgggtacaagtataagtgcatatatgcatgagagtatgagtttgtgcaagtgtgttgtgtatatatgctgttgtgtgttacaagtgtacgtgtgtgcaatactgcatgtgtttcaactgcacatgcatgtgcatgagtgtagtgtgtgctgcaagtatagacacgtgcatatatgtgtcatgagtgtgttgcaagtatgttgcagttgtgtgactttcaaatgtgtacacatttatggctttgcacgtgtcgtgtgtgtgcatacaaatatgtagcagatatttgtgcacacgagtacatgcaagtatgagtgtgcatgtgtgtgttgcatgggtgggtgcctgtatgtggtacaagtatatgagggtttgcaagaatgcaagtgcactcccatgtgcatgtgtgtgcaagtgtgagtttgcatgtgtgagtgtagtgtactgttttatgtgtgtgtaagtatgttacatgtgtacgtgtgtgcatgcagatgagtttgtgctagtgtgtgggctatgtgagtattgtgtgtgtgttgcatgtgcacatgcacactgagtcttagtattgccttgtattttgtatgtggagttgttacaagtatacacacatgcatatatgtggaagtgtgtgtgtgtgtgtgtgcattcgtgtgcatacatacatgtgtacatgagaaggatttgctgggagggggccagagttctccagctggtctttagtcccttcatcatggcctgtggtcttagcagactgagagctgggctgtctgtggagctcgtgtccctttgctgaattagtcatgtgctgcatagtgctgtttctgtcaatgacagaccacagtggtccccaagacagtgtcccctaaatgagagtggttccgtaagactgtaatgaagctgaaaaattcctgtgaaatggagtttattgatgttgtggccatcataatgcaatgcgttatgtgtttgtggcaatgctagtataaacctctgctgccagttgtataaacgtatagcatgtaggatcatacacagtacgtgcataatactggactgtgataatagacacctgtgaagccggtttatgtacttacctttaatgtcgttatcttagagcatattctctatacttaacaataaaaaagttaactgtaagacagcctcagcaggtccttcaggaggaatccagcagaaagcatggttcccacagaagatgacggctctgtgcatgtcattgccctaaagaccctccagttggacaagatgtggaggtggaagccagtgatttcagtgatcctgaccccgtggaggcccagattaatgtgtgtctgtgtattagtttataacaaaaaaaaaagtttaaaaagtaaaaaactttcggccaggcgcggcggctcatgcctataatcccagcactttgggaggctgaggcgggcagatcacctgaggtcgggagttcgagaccagcctgaccaacatggaggaaccccgtctctactaaaaatacaaaatcagccgggcgtggtggcgcatgcctgtaatcccagctactagggaggctgaggcaggagaatcgcttgaacctgggaagcagaggttgtggtgagccaagatcgcgccactgcactccagtctggtcaacaagagcaaaactctgtctcaaaaaaagaaaaaaaaaaagtaaaaaacttttaatagaaaacttgatataaagataaattatttttgtacagctgtacaatatgttttaatctgtttttataagtgagtcaaaaagctttaaggaatttacaacatagaaagttacagtaaatgtaggttaatttatttaacaagggaattttcttatagatttagtgtagcttacgagtacagtgtttatgaatctacagccacgtgcggtgatgacttagctcacaagtgcagtgttgatcaatctacagcctcatgcagtgatgtcttagctcgcgagtagtttttacaaagtctacagccgcacgtggatgatgtcttagcttacgagtacagtgtttaagaatctaccgccacgtgtggtgatgtcttggctcacgagtacagtgtttatgaagtctacagccgcgtgcggtgatgtcttagcttacaagtacggtgtttacaaatctacagtcgcgtgcagtgttgtcttagctcacaagtacggtgtttacgaacctacagacacatgcgatgtctgacctcacgagtatggtgtttacgaatctacagccgtgtgaggtgatgtcttagcttacaagtacagtgtttacagagtctacagccacgtgcagtgatgttgtagccctttgtgtgaacttaccactcacccagagcagcttcccgtcctacaagctctgtttatgggtaagttccctatatgggtgcaccattttttatcttttcacagcatgttttactgtgccttttctatgtttagatacacaaatattgttgtattacaattgtatgtagtcacatgttgtccaggtgtgcagcccgggagcacttggccgtaccatacagcataggagcgtaggaggctaccccatcccagtgtgtgtaggtccactctgtggtgtttgcgtgatgacacaatggactgacagctcatttctcaggatgttgccttgtcgttaagtacatgactgtactttttacctccagcttctcagtgtttcatatgatcctcaggtgactgtcccagcagtgtacccaggagcctcaccctcactcccccgtcccttgggtaccagagctgagcctcagggtggtttggctgcaatgaatttaacaggtgcttggattaagctcaggacccattgtctggcctcagatctatcactttctggccatgtgatcctgcacacgttgccttcttgtattttactttctctgcctgtgaaatggcaaaagcagtgccactcctagagtcattaggaggattcttggtatgcgtcaggtgcttgggacaatgctggccagctgtaagtctcagtacaattatctgatacagttatacctttacatggatatacaattatgtgtatgtagtcatgcaaatgccttttttcttattagtttatagtttttcctttatttctgctctggctgtcttcaggcatgaacccaacttgagatgatcatcgggtaagggacagtagggctttcacaattccttaaatagaacttgcagtctacttgaaaacttgcagtctacttgaaaaccagtgggaaaaccgaatgaaaaataaaagaattcactttcacaccatgtcacttgtggtatttggacacaatctcctgcgaggctttgccgtcctcctggtgtctggtttgcactgctcccacttctcttgcctcccgactctccagacatcccctggccaggtgtgtgtgtgaaaggagagcagtcatggagcactgtggccaccctgcaagcgggcgaggacgcggttaccagaggcgggctcccgggtcctgcccctccaaggtgtgttttcaggagatggaagaggcaggcttgttgccatatttttgtctctccttttttagaattaccatccatatcccagagagactgtgtccatgtttaaactcattaatatttttagtctttacatcccattctctaatttcttctttcactttgccgtgtcagtgtaacgttaaaccttttagggcctcagtttatctcctaaatgagacaagcagcgaatgagcagttcccacccactgtgacccgctgcagctgccttttctcctgaccccctccaccttccccagaccccaaccatctaccgtctgcttaaggcccttgggctgaccagcatcccctccctctgacatcaccagcgtttccttgtctctgaagtcgtttctctgcatgtaaacatgacgtgataaatgctgtctaaaaacaaaaaccctcctttgacccttttcacccgcggccaccccacggccctctctcctgacagctgaacacctcagagggtctgggttcatctcctgctggctcatgagagacaaagccccatgtctccacggttccctggtggcacccggcaaggccacctacgaccccaccctaatgttccacgctcagtgccagtggatgctgctgagcctaccctcctgctggaaacttgctcttctctttggctttagggactacacactgatagttcttttgttgaaataaacagaaaagcttatttttctgtttaataaaagatgtcttttatgatttaataaaaagatacttttcaagtcctttctgtggagaaggagttgcccggctgcttagagcgagttccggtttctccacacgctcagggccgcccctggatccggtttctccacacgctcagggccgcccctgggttccggcttctccacacgctcagggccgcccctgggttccggcttctccacacgctcagggccgcgcctgggttccggcttctccacacgctcagggccgcgcctgggttccggcttctccacacgctcagggccgcgcctgggttccggcttctccacacgctcagggccgcgcctgggttccggcttctccacacgctcagggccgtgcctggtttccggtttctccacacacgcagggctgctcctggttctggtttctccacgcacttaatattgtcctcattaaatctctactctccatccctcttttctcggcccctggtacccaccattctactttgtctatgaatttgactactctaggtaggtacctcatgtaagttgagtcctgtggtatttgtcttttcgtgactggctgatgttacctagcataatgtcctcaaggttgatcgatgttgtagcattgtgtcaaaatcttcctttttaagattgaataatatttccttgtacgtatataccacacttggctcatccattgtctgccgatgttcacttgggttgcttccacctttgggctgctgtgaacatgggtttatagatactgttcaagacctggtttcagttcttctgggtatatactcagaagtggaattgctgaaccatacattagttctatttatatttctggaggaactgccatactgttttccacagccgctgcattgttttaccttcccgccagcagtgcacgtgggtctggtttctccgtgtgctcaccaacagtaggtgttttctatttttttgagagtagttatcctaatgggtgtgagatggtatctcgttgtggctttggtgtgcgttttcctagtgatggtcttgtcgaacatcttctcttgctcactggctatttgtataccttctttagagaaatgactattcaagtttttccacactttttagctggagtggtttctttgtttggtttgcatttagttttttttggctattgaattgtaagagtcccttacacattctggatattagccccttaacagatatgtgatttgcaaatcttgctttcatttcctgggttgcgttttcactccgctgattctgttcattgtgtcctttgatgaacagaagcttttaattttgatgtccagtttatcctctttgttttctgcatatacttttggtgtggtagccaagaaataaatgacatatccaacacatgactgttcctttaacagtctacagttttatctcttacatttatgtcattgatccactttgaattaaataattttaaatattttttaaaggcagggacactattcttcaaaaatgtcaacgtcatgaagataaaaaagactttggaaatcttcccaattaaggcaagccaaagaaatgacaacaaaatattaagcctgatgctagggtgagccctgcactcaaggcggagctgtagggacattactggagtaatgggaagaattggaagagaggctatagattaaatattggatcaatattaaaattactgaaactgataactgttctgtaagatagtattcctattctcaggaaatccacacttaccttgatgtatttaacttatcctcaaatggttcagaaaaaactgtgtgtgcacattgtgtaagatggggtgggcagtgcaaagtataaagcagatggaacataatattaacaagcagtgaacctgggtgttagaagtgttctttatactgttttcattcttgcaagcttactatcattttgaaattaatttgaaaaaatttttacacatgctcataaacatatcaaatctataattatttttcaagtctttctagtcttactcaaaaagggaaagttgatccacattagtcacacttcatggtggaaagtgacggaaaccaagttggaccatttcagcaagcgaagattgaagtaggagagaggtgcctgaggaactggagggttgggtggaggtgcagcccagtgacagggagggtctggaagcaaagcccagaagatcctcaggagtccccttgtcaccttgcttctctgccctgtgcacacttctgtgcagatggatcagctctctgtgctcattccacctgggagaatgctgcagccccacggtcattagacctcctctgtcagacggctgcccatcacaagctaatgggcctgaggcatgggcttggtcacccagaggcaggaggctgtgccctccatgaggccagcagtgtcgcatctcaaaagccaagaagagagcacacaccctctcctctctggcatgggctgagcagagcgatgcctccagagagggcatgtggaagggacggggaaaacctgcaaacgtgacccagctaagtgcgaggtcaccatcagtgatgagcaggggggctttgatatgacgccatgggaagggcgctcatctctaaagcccttttccaaaatgcctgtgatccgtgtctacccatgaacaatgttagacaagtcccaaccaaagggcagcctacaaaacacctcaccagtcccctcaaaaccgtcaaggtcagcaaaacagggacatttctgagagactgtcacagtccataggaactcagggagacgtgacggccaattgtcatgtggaatcctgggtaggatcctgggacaggaaggggatattagggggaaatgaggaaggctgagtaaaggatagatttaaatcgtctcactgttggcttactaattctaactaatgttggatatgtgcgcattctgagactggggcatattgtagggcagtgtgggagctctaccatcctgctcaatttttcttaaatctgaaactcctaaaaagtgtatttttaactttttataaaattaacacataattgtgcaactcatagggtatatgtttcaatacatataacatgtagttagcagatcgggatattagatcgggagcgtgcatcatttctttgggaatgtttggtatcttcctcctagctatttgaatgataaattactgttagttatagtcatcctgcggtggtacagaacactggaacgtattcttcccagccagctgtgattttgtttcctttaacaaatctctccccatccctcccttcccagcctccagtatgcactgttctactttgtatttctatgaaatcatctttctttagcttccacatatgagtgagaacgtgtagtatttaactttctattcctggcttatttcactttatttagtgtcctgcgcttccgtccatcttgctgcagatgacaggatttcattctctgttatggctgaatcctattcaatgttatataccacaccttccatatccattcatctgctgttggactcctgggtggattcatatcttgggtattgtgaatcaggctgcagtaaacagaggagtgcaaatgtctctccagtacactgatgatttcatttcctttggataggcgcccagtagtgggattgttggatcgtatggtagttctgttcgtagtttggtgtgtgtgtgtgtgtgtgtgtgtgtgtgtgtgtatgtggtggggtgggggggggttggttttgttttgttttgttttgtttttgagacagtctcactctgttacccaggctggagtgcagtggcatgatctcggctcactgcaacctctgcctccccggttcaagtgattctcctgcctcagcctcctgagtagctgggactacaggccactacgcccagttaattttttttttattattatactttaagttctagggtacatgtgcacaacgtgcaggtttgttacatatgtatacatgtgccacgttggtatgctgcacccattaactcgtcatttacattaggtatatctcctaatgctatccctcccccctccccccaccccacaacaggcctcagtgtgtgatgttccccttcctgtgtccaagtgttctcattgttcaattcccacctatgagtgagagcatgttgtgtttggttttctgtccttgtgatagtttgctgagaatgatggtttctaccttcctccatgttcctacaaagaacatgaactcatccttttttatggctgcatagtgttccatggtgtatatgtgccacattttcttaatccagtctatcattgatgggcatttgggttggttccaagtctttgctattgtgaatagtgccgcaatgaacatacgtgtggatgtgtctttatagcagcatgatttataatcctttgggtatatacccagtaatgggatggctgtgtcaaatggtatttctagttctagatccttgaggaattgccacaatgtctttcacaatggttgaactagtttacagtcccaccaacagtgtaaaagtgtccctgtttctccataccctctccagcacctgttgtttcctgactttttaatgattgccattctaactggtgtgagatggtatctcattgtggttttgatttgcatttctctgattacagcttatacaaaaattaattcaagatggattaaagacttaatgttagacctaaaaccataaaaaccctagaaggaaacctaggcaatatcattcaggacataggcatgggcaaggacttcatgtctaaaacaccaaaagcaatggcaacaaaagccagaattggcaaatgggatctaattaaactaaagagcttctgcacagcaaaagaaactaccatcagagcaaacaggcaacctacagaatgggagaaaatttttgcaatcaacccatttgacaaagggctaatatccagaatctacaaagaacttaaacaaatttacaagaaagagtcaaacaaccccatcaaaaagtgggcgaaggatatgaacagacacttctcaaaagaagacatttatgcagccaaaaaacacatgaaaaaatgcttatcatcacgtctagctaatttttgtatttttttagtagagatggggtttcaccatataggccaggctggtctcgaactcctgaccttgtgatcagcccacctcggcctcccaagggtatgtgtgttttaaggagccttcatactgctctccatagtggctgtattagtttacattcctaccaacagtgtataagagttcccttctctctgtatcctcaccagcatttgatattttttgtctttttgataatagccttctttttttttttttttttttttttttttttttttttttttttttttttttttttttttttgagatggagtctcgttctttcgcccaggtgggactgcagtggcgctatctcggctcactgcaagctccgcctcccgggttcatgccattctcctgcctcagcctcctgagtagctgggattacaggcgcccgccaccgcacccggctaatttttggtatttttaatagagacggggtttcactgtgttagccaagatggtgtcaatctcctgacctcgtgatccacccacctcggcctcccaaagtgctgggattacaggcgtaagccaccgcgcccggccaataatagccatctaactggaatgagatgatatctcattgtagttttgacttttgcctccctagtaacaataagtataagcagctgagccgtccttgctgctgctctgcctgtggagtagccattcttttatttctttattttcctaatagacttgctttcacttaagaaaaaaaaaagacttccacttctctgatgatttgtgatgttgagcatttttcatgtattttctggacatttatttcttttgagaaatgtctggatcatttgcccattttttaatcagttttctttttgttttttgggtttttctttgctgttgagttgtttgagttccttatatatcctgaatattaatcccctgtctggtgagtagtttgcaaatgtattcttttattctgtaggttgttttttcactttgtttcctttgctgtgcagaagcttttaagttatttataatcctatttgcttatttttgcttttgtggcctgtgcttttgaggtcttattcagtaagtatttttttaaaaacgaaggagttcccaaaaataaattttttttttaattcgatgcaagtgaatgtcatggaaactttatgaatggacataaattgataaacaatttatcccactctttgccacagaaacgttaatgcatttttttcttctcttttttttttttctttttttagatggggtatcactctgtcacccaggctggagtgcagtggcatgatcccagctcactgtgacctctgcctcacaaactcagttgatactcccacgtagttgggactgcgggtacacaccaccacaccttgctcatttttgcattttttgtagagatggggtctcgccacattgcctaggctggtctcaaactcctgggctcaagtgatcctcctgcctcagcctccccaagtgctaatgttacatgcacccagcatattgatgcacccagagtattgatgcatgtgattagggtcttaggtagcaggggtctgtgctcgggattagcgttcagaaatcgagcacctctgaaacttggaacccatctggccttggaagaagatggaagagggcagtttgggctgcaaggtcggctcagtccacacctgcaaatggtgtcttttatgggaagaaaacacagagctctcttccacccgagggagagaaaagggaaaaggatggacagaagagtttggattggagagggttaagtttacaattttataaatgaaaaaagtacacaaagtatgctttggtacttcatttgtgcaatgcggttaggttagatgaaaacattcctctgttttctctcgttgctcattttttgggtgattggtatctgtttctggacttccctgatccagatcttcttccccttagccttttgtggtggccaccgtgggccgtctcatgcagtgtctgtagcttttgttagggcttgagtcctgggaggacctcctgtagaaataatagtgcatttgtttttggttttgtttgtggttttggatgtgtgaacatgatgcctgttatttttaagcactgttgttccttgtgattttaatgctcttatgtgcttcactggttgcaaagtaagtggcaagatattaaaatcccaactttgacagtaacacttgcctcatcctctgtgtaccttagctgccaggaagctgcagactagactcagtcacagcatctctgttaattaacttgaagtttttgagtatttaatttcccctctatctttggggatttttaaaagcttattgttcagatggtcttattatattgggtattttaaatgcttcaaattaattttggaagaaggtgtagtttaaaatattaagtaaaagttttggttgttttttcagcggcacattcataaatgccatcctcacacggtgagcgtggctgtgctgcagctcagctttccatgaccgggtttccctgcgtcctgtttgctccccttgaaatgccacagagttggcactgaggacagcaccagctccgtctgcatctggtctgtcacgctggtttttgagattgaaggtgctgaggatgctggacccttcaggtcatgagtgaccatcaggccagtgctgagtagtggtgtgggcaggcagggtgggctcccagtggatgctctgctgacatctgcatcagatgccccaccccagggcattggtcaggggctccagctgcactggtccgaagcagttgtctttctggcgggggcagtgctgccgtatgccggcgcacttctgttggggtagagaatgctatttgtttcttggttgttttgacgtctccagagctggggtgctgatggattctctgccagctagcgggtgctgccagggggtggtggtcctaggcagagggcagctgtgctcatccgcctttgcatggctcagacaaggctccttgcccctgggtgagaatctcagttggaggaagaaagagtctcttctgtagctttgcagggaaggattagtgagaagttcaaccatggctctctttagacaaatgatgaaaaacctgattatctcagcagcaccttcccacctgttcccaggaggccagacgtgtgatgccaggaggcacgaatgaagaatgaagacctcacagacctcttgtgacagccatgcattcgttccccactcggttgcacggcgccatcagggcttcagccttccgagacgtcgcttctagcaaaacaggttgctaagtttgagtccatttgagggcagttcaaggacagggcaagttagaggctagtagcaagttccctcatgtcaactctctatctctgcttttctagcaaaagtccgaacttcaagtccacttgacagcgtaggatgaaaagacagtttattccccgcaagtccaagatttatactggactggagaagaaataaggggtgagacagaggccaggctggaagagtttattcagacacacagttaaattgtaaccttgatgtgaaagtaggtgcactgtttaaaaccaactttcacctagggaagggtgtcagcagtaatggttcgtggagccgatttgggcagcagtaatgcacgttggaggcagcaagaaaagtggcacaaagttccggatctggagctgacaggtttcctcagccctgagttgtctaaagctgactttgcagtgtgacctgagcggcaggtgctctcacagaaggtgagctctgctggacgccagcctcggcacaatggctcttggaagatgagagtcttcttacagcatgacttggtccttttggtggctcagtcacacttcccgcaggagagggccagcctggctgagcctgtatttctccctcccccatggagtcctcctgctcccctctggctcccggagtccacagacctctgcatctccctccagcagcccacctctcgtgtgccaggcaacgccttggtgttaaccttacaacctggttctaactgagaagtgttaataaccccagctacttataactcacgcaccacaagcacttcagattcatagctcatttaatttgcccaaacctggagatgtctgcatatgatccccagtttgagaaagtcagcaccgagcagcacactttgacccgggtcttaactcagcccactctgtaactgtggagaacactacttttgagaacaaccaagatcacctggtttcatttctatgagttctttgcacatggagggaatcagccctctgatgtgtatgttacaaatatatctcctagttctttaggaagacatctcttctgcccttagatacggggtagcttttttcctctcttggctgtgtggatattgttccccttggtgtagaagaaggaattcctgtgtggcatttgctagcaggatatttagctttttcatccagcaccgacctgagtgatttagcaccctgtgcctgttttcatacaaaacacacctttttcacatgaaccagagagggaattcttgatgatcttccgtgttttcaacacttcagacaaggttctcagctgagattccgtcttgcttcgcttcctgaggcttaggatcaatatgggggcagaggctggagagagtgaaggacatacggccggagggtgaggcactggccagcacacacctgcccagagcctcacctgtcttgttttcctccatgcccccttagtggctgggcacaggccaaggtaaaaacacacagggatggagataaggaagatctgggaatgctgcacagcctgggccctgcctggcagagccctggggcatttgcccatcacttttataactccagagccttgtttcctgagtgacccccttaccctgtctgaagtcatccctgtagcgacagctcccagagctgccaggtgcatctgattccggccagcgacaggatctcaaacgtcctaaagtagagatgactgaggattggccgcagaaatggagatggtgtgtcctaaacagccctcggttttggctgagtttcactccttggctggtcacctggcctttgtaggatgctgaggtgggggcctctgaccccctcctagttctttccctctcctcatcatctccaggtgcccctttctcaccgctgccccggccagcttggcctggcttctctactgctgtcttcatttggggtgaagcccacggttcgctggcttttgactccacttggccgctcagatcagggcacatctgcgggcctcctggcacggaggaaggagtcagcatcattgtcctggcatggccatgtcctgccgacatcccaagtatgtgcatgccacctctggctgtgagcttctccgtggtcagtgtccagaggagagcacatttgtgttgcaccgcaaattctaggtattctcatggcaagtcctgaattagcataatgctaccaggctcctaaaagttctttagtttcttgcaattctgtgttaaaacagccagttaaggcatttttggaggttagcgtcatcaagcctatcggcgtgttccgtaagagtttgaatcatgtgagctgtttggcagccctcatcagctgttggcatcaaggtttccatttaagacagacaccacagagttaatggttgtcatctgatctgaaatggctccagtaagtctttctccctcatcagactcctgctgatgcacacaggcaccctccccagcgtctcctctctgttctcccgcagaggagaaagtgctgctggccttccctgtttccgccacagaggatcctccccggcacgggtgcttctgtctgcagcaaccggagaagacacagcaggctggggggaggaattgtcctgtggcctcagtcactcaacagccagaggagatggtgcccctggctgcagacagccctaggtctggcaggagcagtgcagccacatgtctggcacgtggaggacgtcaggccggtgccacctaccacactgctgggtgcctcccactgtggcagcagaaacacccccattcccagaggggtgcgcaccctccgtggcctccctcgtgccacgcagagggctgtgctggactggtccctcagggcccggagacactcaggcttctttcttggtacctcctgccccttccctacccctcatcctccttcttggtacatctgtcagttacagaggaagactgctgtgtcgagtgcataagagtgggttcttggtgtgtttcaaatctcagtgagggctgggcatggtggctacacctgtaatcttggcagtttctgaggctgagacaggaggatcatctgagaccaggagcttgagaccagcctaagcaacatagtgagatctcctctctacagaaacttaaaagttatccagatgtggtagtacacacctgtagccctagcaactcaggaggctgaggtgggaggattgcttgaggccaggcggtcagactgcgatgagccatgattgtgccactgtactccaggttgagtgacagagcgagaccctgtctctttaaaaaaaaaaaaacatcactgggggatggtaggaagggtgtctcaggagcccacaggccccctgcccgcaccctgtccccaggtgggaggcatgtcgtcctgtgattcaccatcttcaagccttcaagcactttctcctttgctttattttgtttaaataaaaaaaattgccccttaggtgaatgaagagtgtgatggtccactaggcacctggtaaaaatgcaaaaccagtagtgaaggcctcaaaataaataatgcacctgggaggactgttagcgaagctctggttgtggcctgctgcgatgtccttggcagttcttaagattaaattatcattatgtattctttgaagtaagagtttcttttctgagtacctttgccgtcagggcccagcaattctctctgctcctgtggctgcgatgcacgcgctgtcttgggagggctctcggccgctgcacacctggccctgccttccacccgcaggacagccgtcggtgcttgaggaccaggcaacacagtcgtgggtgacccgcagctctttcaaggaaactctgtaatccgtgttcttttccttttctgaaaatgctaagtggactcatggttactttcagctcagagtcattttcccagttactttgcaggtttgagagatgcggcttcatctgccttctctgtggccctcgcttcgggttcagtttcctctgctgctgggctgctctttctgcagcttcgtccttgctgttggatgatgctcagaatcagctttcccggacagctgccaggctcgtgacctcgtgtgaattggtgaaggggaaaactggacagcaaacacatctaggaatattttctctttctgtttgcagagtccgcttagtggaaagaggatcccctcatagtctgcccctgatggaatcgggaaaggtaagtattataggaagaggcacgcatttctgtatccgttcgcttctgactgtatgggctttgaaattttaggaaatgtattttttagaatgttttttccaaaacaatttcttgaaagtaacatatcagtgagtatagaaactcaaaataacagtgttttaaacaagttagacttttttcctcaggtaaaagttaggaaataggcatctcctcctccatgaagccagcagaggccctggtgccttcagcctcgttctgcgcattggagcccaattaccaggggcccctcaggagctgaagcggctgcttccgctccagccatcatttccacattccagccagcaggaggagaaacagaaaaagaagagaacaaagcatgcagaccatagagaaggttcccaagctgtcctacactgaaattccattgatcagaatgtggtcacatggccacacctagctaaaggttgggaactattgagatatcaattctgaatatgtaaaggcctacctaaaaatcagggtatctattactatgaaagtagaaaagaatggttaacaagagacaaccagtagtttctgccacagtgggtgtgttttttgtttctgtttttgtttttttgtttttttactagaactaaagggcaagaaagatatttaaacacctaaataaagactcttttttttttttttttttccgtttcggccccagttgtcagattccttctccattgacataattctaagagcatctcatgttgcttctattataaagttgcctgcatggctgcaagttagaatgcttcacagagttggttccaacagtaggaatgtgctcaccatccatcctaacagtctggcggaccatagtcagcagcagaatccagagccctgaaatctcacttcagacttaagtgagatttaacagtgtgactattccaagacgttctgtgtttttaccataaaatgttttgcctttatctcaatcataaatgttagatgagctgatctgaggcaggctatattcaggatttccagaataaacctttgattccttatataagtggtatcagtggaatgtgagatatttctaaggtaaactttaagaaggaaattctggccagagccagtgtctcatgcctgtaatcccagcactttgtggggctgaggctggagggttgcttaaggctacagtaagctgtgatcatgccactccagcctgggtgacagaactagaccctgtctcaaaaaaaaaaagaaggaaatgcttagtactgacatctattacagtaaaagatgtttacctgcaggaaaaagttccccagtatcttgagttgaaaattcggtggagatgagctggagatccacacggacgttctaacgaaaacctgcagacttcaccagcagttgacccacaatctttcccttctggcaccaccagagcagctgcctactatatcattttgccaaaagcattttgggttatcttcgagtccatgcttacccctgaaaacgtcactatgtgactcccttccttcagcgattactgcaagcatcaccctccatccatgtgtgtgccatgatgtgagatgtaatattgactctatgtaaatatcttaaataacttcattgaaacaactgaaaattcccatttttcaaggtcaggctgtgttaaacattatatcatttaccatgtttttgttcaaacattattttcatgattttcaatagatttctcttagctttattgaggtatgactgacaatcaaaatgtttaattttgaggtcaccataacagcatacaatattgacagttacagtgagaatgtgattgtgaggctgtgattgtgaggctgtggttgtataatgggtcataactatgtggcatatagttttgatttaattgctttctaaacagtcttgaaaggaaatggcataaagatgagattgaggttggcttgtgtgtagtctctccctgtattcctcccattgacaagagacttttcctctcccaaatagatacttccaggggttcggattataattgccaacccagaaacaaaaggaccgctgggggactcacaccttggagaggtgagttgagtgtcctccgagatccaggttacttttctgttatgtatccttggcttgccttgacaccatcagaactgctcacatgccctccatctgccacacaccggtttgagctgagtgagttatgattgcctgggaaatagcgtgaggtaagctttatggctcaaatgagtccatgaaagctcacaattacaaaatggcacttccttagggaagtataatagattgtcctcaaataattctgaaaagatttaaacacataatgtgtatggactgagtttctttatttcttggctcttgagtttgctttccacgttcctgcttttattactgagaagtccttcaccaggaaagtggcagagacctccacaggaagtagtgtacaaacaacagcatcaggacacagtagccaagagatcatgtgtttatttcagatcagaaagcaaacagtggaacttgacacctttgcctcattgtgttcagaatgagcccgccctggctggctcttaactccctgccactgtgcccctccgcactggcgggatgcagctagagaaagacgcctcgtggagctgtgtggccttggtctcctctcttgacacctcatctcaagcaggccctggcactgctgggcgtccccagtccgagaggccacttgtctcatgcgtcctccttccgccgcattctctctggcactgagcttcctgcttctatgaggaagcagagggcactggagaagagcatgtctggagccagcctcctcccacggtggcagcacgtgtgccctccctccggttaccccggcctgccgtgccgttggacaaagccccatgtctggccaaggacaccctcactccccttatcacctgtcctgtcccatgaggcgccccccttcctgaatggctcccagcagcacatgtgggaggcgtgctaagaactggcatcttataaacagcaccagccctcctcctcctcagccctggacgcatccccagcacatgcaagagcacgtttctacacgcacgtgggtgaacacctgaccaatgagcaagccctccccagttctcacgtcccagcttgctttgcttcttgggccttgtgttttttttttttttttttggcccctcacttgacctctctcagtcacatacatgaaagatcagaactgcggagataaaattctgtgcagctctcacttaggagtttcctttaaatgtgttcctagaaacaaagctggaagcagagcctgcttctccggcacctggagggtgtcctcacgggtgctgcccgagacgtaggctgggccagggtcagaattctcttccctctgagggtggccagaactggcgaaatttccagggtgactttcttattaagaatgtgtgttttttccgctttatgaggttaattgagaaagttatataaattaaggaatgcactgtgatgctttgatgtatatacatattatgaaacagttaccacgaccgagttctattatccatcagctcacattgtgtgtgtgtgtgtgatgagaacatttaggatctattctgttatcaaatttcaattaagtgatatagtattattaactgtagtcaccgcactacattttctccccataacctgtttgccctctaactgagggtttgcacccttgcccgtcatctcccccttgccactctgaagtcccggctaaccaccgtttaccctccgcttctatgaactcagctttttagattccacatgagtgaggtggtgcagtatttgtccttctctgttctggcttctcactcagcacaacgtcttccaggtacatccatgctgttgcaaatggcagcatttcctccttttttatggctgagtaatattcagttgccttaatgagaattttctttgtgttagggaacagaggacggctgtcatttccctgatctgatggtgcactgtctctctcagtttcactttttcatttgttgtgcaggcagtgagtgcctgccatatgtgaggcactgctctggggacgtgggtgcagtactaaaccagtttctgacttcctggaacttgaccacttttcattgtcagtaaaataatggaaacagccaagcccagaatgtctccacagcaaacactccagagtctacaaggccctgcctctcctgacccttgctgtgtgggcacagctgcgtgggcatctgtggaacttcactggttttgcttttacccagccctgtccatggttctccgtaacccacgtggctatcgctttgactcaccatatcagtctttgcttacctatttccccaaatgtcagacatcaggcattttcgtttccggtttttggtgttatgtgccttcatcccttaggttttgtttttctgtgtgttgttttattgcaatatatgtccaaaagtattagctaaccaggtgaaatgagaaaagaaatctcaaagcttttcagcattgttcttgctctttagaaataatcattcgttaaagtgtaaggaatctagtgtgactttgttcatttgatgtgtatatttttaaaacctatttgttaaatcttcaactaatctgctttaattcagttccccatagggatgccttggctggttgcttggccacaaacttggtagactgcctttatttcagtatcctctgtgtgtctctcgagaaacccgaatgagattaacatcatcttggttattcagtccaaggaaacgtttactatcactgaatataatgtactgaattgtcaaagtagttgtagtctcatttccctggagataaaataatgtcatccacagtgacatttccctccgtttgcagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggaggtgagagtccaggctggcggcccccccccaacagatgggcagagaggttaggctcctgtagatacagaagcctttcccaaggtttacagcagccaaagccaggagggcacgtgtgctagctacaacccagtgtgaaaagaaccgagtttaagagcaagaggaaagcaaaatgcaaatgtgtccaacaagctgagctgtgcatcacataccctgtcctgtcctgagaaccaagagctgactgaaaaccggagaggggcatggctgctgagcatgggctgcagtgtcacccacagcaaagtgctcagagtctcagaccacagagtctcctcagcaagcctgaaggctgcctgctcccacggggtccatctgagacagaagctgtcccagtggctgcaggaacgtgcatgctgctgcttctaggactgggtctgcccctgtcagggaagaggaggccgcgaggctctcgggccctggtggccagctgtctctgcccatgcattcatcagagagtagggcctggtgctgctgatgctggtgcctggtgtggagcagccaggtggacagcattgcctttgccccatcagaggagagcagggtgaagccaggggtatttcatgacatggacatgtaaaagtgcacttgtatagttaattctttgcttattccagaatcctttctcacctccttagttctgctaaaaatagaggcaggacttggctgtttcacaacagtggcagttgaggttcctggtgagatcttgactcaccaaaacctcagggagatgagtttgcagacatcagtaaggcttccttacatacctctctaacatacctacaatggcctggcccaacaggctatgtttaggaatcatacagaaatatcctggcatgacatttgcattgtgggaaattatagactagtttgaggctactgcctgaggttcctggaagctgcaaaagctggtggcaatttatagtcctagagaaaggccaggaaagccacgtcccgctgagtcctggaagcagggataccctgaaggacgtgtccctgccacaggagaagaggcaaagctgctgtagggggcagaggccgagtcaatgtctccatctttctttgtctgatttaaattagaaaatacttatctctgtctacggccataccaccctgaacgcgcccaatctcgtctgatctcggaagctaagcagggtcgggcctggttagtacttggatgggagaaaatacttaactctgatgttattttatatgtcaatcatgcctttcaaattttccctaatatgcttactaccttataaaaatttaggacatatttccttattaaggaaagataggacctgaccacttgttgtcattgtcattattctgaggtttgcaagaaggatagaaataaatttcctggctctatgagctaaggaaatgttcatgaacaagagcaagagctatgctttcttttcccacttatacacagaattagtagcacagagaagcatgtgtgggatagagtcacagagctggtctgactgtggctgcactgtatcccgtgtgatcttgggcagacgaggcctcagccgatgggtccacggaactcagaccgctgggtgccgacttcgcccctcagttgctcccgatgaacatgcaatcaggcagttgactggatatcgaagctgagccaggaaagatcttctcccaaagcacaagtgtagagggcgcatggcggctttgcagccagcctgtggggtactggcacacgagccgagcacttgccaaggagctccgtggcagaaggaaacaaacgtccctggatccgtgagccccttcctttgcatccctgtctcacttgggggtcgtttttaatctttttttaagaaaagaaggaaacggcttgagcggcattatggggaagcttacgcaggctgtcattactccacagagcgccatgatgccctctacgtggtaggggcactggacgaagccatggagctgcggggcatgcggtaccacccaatcgacattgagacctcggtcatcagagcccataaaagcgttacggaatggtaagtcgtgagcttgcagcttgtacccaaatcaggagcagagtttgtgaagcattgagaatgtggagagcacggcggtggaggagagttttgttaaggtagggaagggggtgcgattcaacatttgactataaatctttatcttttggggttaaagcaacaaaagaacatgccacatgtagagttaatgtaccatatattacctgaaaacgatagacttctattgccgtgaaaactacttgacaacattttccaggaagccaaattgtttggtttttaatttacaaaatcatgatataggaagaaaacaaacctcacacatatgtaggcacagaaaatacttttatgactgttgacttgggaactggaagtaacatgagacatgggaaaacttcagtgagaaggagaggcagcgtttgtccagaccccagaagagacttccaaaggaagaattgcttgagttaaggctgacagtgacaaggtgtgtgcgtcgcacctgctgcctgggggcagactctgctctgggcccaggtgaggactctgaggctgggactttgtctttctctctggcccatttaatctgttgtgaagtgctgagtatgtcaatggtgctgccggagattcagcagtaggttcttctgaggtgtgggagtggattggatgctggagtgccgtaagttaagtcggccagggccggggagttttacaggcttgttcagtgcctttagattggcagtttggatgaaaagtgactcaacaccgttggctttagacttgttcattcccttgataacagaccgggtgctaactgaggggcacctggtgaaactggtctcagtctcaggtcagaaaccctgagggaggtatgttctgcactctcatgaacagctcttctgggttgaaaggatgggttctgagattgttccttcctcctcttagctagctgagatgcaataaaggctggtacttactgccatttgctgaatttgaacactaaggccttggcagaatttacaagatcaagtctgcatacctgtccgtgttcgtgtggctcaagttggctaagcccctactctcaaaagtcctcagattgtcgatttccttgacacttctctccttgagtatacagagaagacagaaactctaggaagactttggcccagaaactcggccagggcctaccttattttccgtctaaatagctacgaatatcagttacagccttccgtttttgtatttttaagaaaacaattttaattggcttgtgtgacctccctcaagcattttctgtctggtttcccgctaaaaggtgtgcatcgagggcctcgctggtgccctctgtgggcttctagaccgtggtgcttattctgtaacaaatgtcgctgctgttacctgccatgtgacccccaaactggatctgtccctcaccgggtcaggggctcacatgccccttgcccacacagtgtcctttgagtggacttttgaatgtttgagatgatccaggtacaaactgctttgctccaccttccctctcccagcctccctgcactgccccttggggccaccatcggctgctccatgctgagaaatgcggctgtgacacccagcgctgtggaatgggactctccatgttgccaaattcaagccaaacaaactttctcatttctcatcagttgttctcagcattaaatagcgtgcacagctcctgtaaaagctctgagagtcactggcaccaccccataggtccctggcagaggagatagtggagcaagcacaccctcggccagctctgttcctccagagagccaagctgattcctccggagagccaagcagatttggatactctaggactattccatacatttcaaatgccgtaataaaagtataccaaatgcgcctgagacgtctatatctgtgatatgacagattcacaatgtgggctcacatgggccatgtagagcaacattttaacatcaccaggagcagtatgacaggaattaagcgccagcacgtcctctgggaaacagctcttagcatgctccataggcatgcggcagtcacaaagcaaaatccaggagaactgttgagaatttccaggaaaattctccaattttccctttcaatttaacataggttggccatactgaataaaatatgcgtttttttcctaactgacttactctcccacttagaacaatagtgagtttcctaaaatatctcctgcctcaagctgggatagaacatgtttgtcaggtgcgtgagagcagatacgagcagccctggagcctggtctccatccagcccactctgcccgggaaccttctggcctcctcagccaagcagacctcaagtaccaggctctgtgaatgtcagggcccttaaacagttagttccaaaagccattaaatatcctttaaactgtaaagcaccgggtttttgcttctgccagttgggcagacttaatcctctggtgcctgtcctgctgaaagatgactcgatcccagataaaacatttctgagtgaatcttccatattccagaagacttttccctgcacatgggttagccatggctgtatggcagccagcccatgctcagtgctttagagagagttgttacaatgtccccacatctgcgttcaaggggctggctcagctggggcaagcagcttagctgggcacaggactggtggctcttctccacgtgtttcttatcctccggacccaagggccagcccaggtgtgtccccatccttgcaatggcacaggcacgccaggagaagcccccatatccagccctcctggagcctccaccggcattcatctccctaacacaggctgaccaggttccatgctgagcccaagccccaggactgggaaacacacccccactcaggcgcactgcacagacagaggagcaggcacccatgcccttggcctccgcacgcacggccctcagcagcagagctggactcgggtgcacagacagagaggagtaggcacccatgccctaggcgtccacacgcacggccctcagcagcagagctggactcgggcgcacagacaggagtaggcacccatgccctcggcgtccacacgcatggccctcagcagcagagctggactcggggccaccgcacagacagagaggagtaggcacccctgccctcggcctccgcacgcacggccctcagcagcagagctgggggtctggaagcaggaggcacagggctgccttgagggtacgaggctgatggcacactgcactgttcagtgagggcattggtcctccaggcagcagcaaagaggcagcactggaacacagactccgctggccaggtggagtgatgctgtgctagaaatgggaactcgggaagatggtgaaacagtcgcagaagccaccgagagagaaggctggtaggaaacaccgacaggtgctgtcgccaggaagtctgtatggggaacgattagtgggcggcagacggaggacgtggagaggccggaggagactgtcgggcagtgctcaggcaggtcagagagagccaagtggaactttgaaaccacggctattaaataaagcattaataaacatataatgatggctttcttttctgtcttttagtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagcagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgtt

SEQ ID NO: 37721 - DNA, 414175 bp, Homo sapiens; identical to SEQ ID NO: 37720

SEQ ID NO: 37722 - DNA, 2692 bp, Homo sapiens
gcgcagcttccccgagcgagaccaaaacaggtggaatccgggctggagccggagctccggcggcgcgggtggcggcacgtccctccaggtgggtggctctctgggtctggcgactcagcgctcctcagccttgccccctggtgcccgctcgcgactgtcatcgccccatcacttctcgttgcagacagtaccacaggcacctggagtaccggcatcggtcgctgtggcccccgagtgtccgtcagagcctaggggagcctgccctcccgcgcctcgtcggggcccggccaggcaccttggccgccggcgcacggacgcgggcacgagcactagatcacggtgagtggaagcgggcccgacgcggccctgcaggcccgacatccgccaggcaccagggctgggaggggtgaggggcgcgcgccgcagtgcggctgccctggcgtcgccgctgggggcagggcgcgcggggcttggggcctgcacgcttgccctggacgttggcacctttagctaacctgtctgctctgtcttgcaggctgctggacctcggcacgttgacaagatttctctggggtaccgcggaggattactttgaatttcggtggtcgcctgtggtctggcatatttagaacttaagtctattatttcgggcaccatgactttgaggcttttagaagactggtgcagggggatggacatgaaccctcggaaagcgctattgattgccggcatctcccagagctgcagtgtggcagaaatcgaggaggctctgcaggctggtttagctcccttgggggagtacagactgcttggaaggatgttcaggagggatgagaacaggaaagtagccttagtagggcttactgcggagactagtcacgccctggtccctaaggagataccgggaaaagggggtatctggagagtgatctttaagccccctgacccagataatacatttttaagcagattaaatgaatttttagcgggagagggcatgacagtgggtgagttgagcagagctcttggacatgaaaatggctccttagacccagagcagggcatgatcccggaaatgtgggcccctatgttggcacaggcattagaggctcttcagcctgccctgcaatgcttgaagtataaaaagctgagagtgttctcgggcagggagtctccagaaccaggagaagaagaatttggacgctggatgtttcatactactcagatgataaaggcgtggcaggtgccagatgtagagaagagaaggcgattgctagagagccttcgaggcccagcacttgatgttattcgtgtcctcaagataaacaatcctttaattactgtcgatgaatgtctgcaggctcttgaggaggtatttggggttacagataatcctagggagttgcaggtcaaatatctaaccacttaccagaaggatgaggaaaagttgtcggcttatgtactaaggctggagcctttgttacagaagctggtacagagaggagcaattgagagagatgctgtgaatcaggcccgcctagaccaagtcattgctggggcagtccacaaaacaattcgcagagagcttaatctgccagaggatggcccagcccctggtttcttgcagttattggtactaataaaggattatgaggcagctgaggaggaggaggcccttctccaggcaatattggaaggtaatttcacctgagtctcagggaaccacgaagggatatggcaatgagtagagcatgaaggtagaacagtctatatactcttgtgacacatacaatccctaccttgtgctgccaagtaactcatttttgtgcaattctcagtataagccctttgtcgtttctgtgcctatttaaagtctcctaaaggtgtaattgactaggaaggatgtagttctacactgccatttacctatttaaattcatccttgtgaatatctttgttgttgttgttgagacagagtctcgctctgtcacccaggctggagtgcagtggcgtgatcttggctcactgcatcctccgccttccaggtttaagctattctcctgcctcagttgcccgagtagctgggactacaggcatgtgccaccacgcccagctaagttttgcattatcagtagagacggggtttcaccatgttggccaggctagtttcgaactcctgacctcaagtgatccacctgcttcggcctctgaaagtgctgggattacaggcgtgagacactgcgcccagcctcatccctgtgaatttcttattgtacacaagttctttcactatctgtgtgcagtgctctgaggggacagacaaggcttgggtgtatatgccaaccagatctcattgaagtatcagcttgtttggtactaggtgcaagtgtagcatgtcacatgtgaccatgttggatcattgacaatttttaggtatgtactgacctacatttatgatgaagatcctgagcggaggttaagatattaagttattttccatatgaatcagaattatattgattctgtgcaatcaaaacaaaaggcagaatagaatgctgagattggttaagtttgcaatgaccatcttgaaccacagatttctgctatgtgtcatcaaaacatctagttctgagtaacattttcacgattgttataaaattataggtgtgaacttctaaaataaaggaatgct

SEQ ID NO: 37723 - DNA, 35248 bp, Homo sapiens
ctggcccgcactcggcggccgcggcgcgatggaggcgccggccgagctactggccgcgctgcctgcgctggccaccgcgctggcccttctgctcgcctggctactggtgcggcgtggggcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggtacgcaccggggccctcgcggccccctccccacccccggggctccggctgccgctgccgttccccgccgagccagggagcggggccgcggcctccagcccaggctgcccccaggaagcgcagaacccgcggcccgcaggaaatgcaggtcccgccatgctaagccgcagccccgcaaactcgccgccctcccccagaaagtgtggcgaggggcgagcccgaaggagtttgtttggaggtgttttgctctcccctcccctcggcctctcccagcccagggcgtgctccgcagctgctggctcccaggcctcgggaccagggcttggaattttgctcctcacccacttctgacccctcccgcccaccggttcccaaatccacgtgcctgtggcttatttccaggcctgccatgagagttatcttgatgtttaaaaagtaggactttcggggggcgagggaggaaagctggcttttctttttcagccaatttgaagtccagatttcagagtcagtgctgtggcgttttgtgaagcccgtgggctgggactgaaagaaaaggcacccgatcccagcagtcctttttattgtcgttttcaagctacacatctaacaccctcctacccccactcccccgggttgtaggtaagctgggcctggatggagtgaagatgcaggataaagccctcctggagcaccagtgagcaccccaaagcggccctccctgcctctgccccaggcctcccgccatgctgtccatcagctcggccttggccaccttgtcctgcctgtggatatctgagaggagtcggatttccctcatccactcatcccagcccctacactgtgtgcccatgttccctggagttcaccacgcttggccggtccaggccaccgccagggtctccgagtcggattgtaatcccttgttcttacccctgagctccttttcttggaagggaggagagccgggatgcgcattgtcagcgtgcctgcgtgtctgcgtgcccactctgtcctgtgctggacacaatggtttaccctggagagaagcccttcgggggaggaggaggcagccaggctgtgctcagaggcatttctctttgctgagtaagtgcgccagaccccctctgagcaggcgctttgcttgacaagtgggtgactaattgtgtcattagagaggattctaaccagccacatttaatggggtggagcaggggcaggccctgccgttcttgcttggggtgggcttccagacctcacgcggtgatggtggagggggcgcggtttggacatgtgctgatctgttgtgtttgctcccatatttgggattcctgcctccatcgaggtctcgcgggagcaggagaggcctttagacagttctggagccgtcatgcacactcagtcagtcctggccttacagggctggccctttatcacccacaccaggctctggactgaagtgcaaaatgtcctttagcggcgccctgtcttagctcaatcctgtggggcacagcgcttaaagaactttctacaaggctttcggctctcagcacatggtacctacaggaataggttcagtggtgtttaaatagggccactcgcataatttgccactgtctgggtgaatgcacgtcctctgaagctgaatgggtgctctgaaggacaaggcagtatgggggttcgcgtgccaggcagcccccatgacataggtgccagtgaggatgacttgaggcttgtgtctgtcctcccgctaaggcaccctccagagagaacccaccccacaggagaattcaattgaagtcagtgcccttcccctttgggttcaagtccccaggccttcctgagctggccaaagctcccccaaaactcctgcctgcaaacattaagccaggtgctgtggggacacagatattgtgtcatcccacccactcccagtggtggcattaacctaagaagctgcttagaaattgtcttgatgagcttcgagtcagtgacaagaaaaaaaagaaaggaaaacaaattgtcctgaagtggactccagcgtttccaagagcttccagtgctttcttctgatgatcacactgctggggcttggaggacagatagggagaaaggccccctggggaagataactcaaatcagggttgggaagtggggctatgccctctgccagcctccttctccctccgtccctaagcgaaccccaccaacagcgagggaggagggcaactccacctgctgttagctcggaagtcactgccctggggagcagcgtgtaactcacctctcccctccctcttcattttccattaactgcctcctttctaatccagtcctctcccttcccagggaggcctgggcgggctggggcagctgctgcctctgactacaaagctgattattgagaaggatctctcgccccgggaagcagccttcagctgctattggggatcgctcaggagcgtcccctagtgcacggtgccctctttggccaaggacaaagtagtggggaggggctactataggccgagaccctggaaatggaccaaagaaatggggatgagatcagtgcagctcttgcttccccagggcagcacaggccagggcagggaggctgaggagaagcggaatgatactgctagaacctcttttctctcctaaggattagcacagggtgggctgtgaggaagcattataggcaaggcctgttcacgcaaagaatcatgagccaacgaagtcaagaacaggagccggcctcttttcaggccaggactcagggctttcttggtgctcctgtgtaggttggggttttaggattgccaggcctcttacctaatggacttgtggattggagcaaggctggatggtcggattcccaaacattggtaattggcaaagcgtcaagggtcatttgaatagcactagagttaaatttcttgtctgtgccaggactcaagtatctcggtacttggggcctagctctgctcatagacagactagagcccgggcgcgatggctcacacctgtaatcccagcactttgggaggccgaggcaggaggatcacctgaggtcaggagttcgagaccaacctggccaacatggcgaaaccccgtctctactaaaaatacagaaattagccaggcatggtggcgtgcacgtcatcccatctactcaggaaactgaggcaggagaatcacttgaacccaggaggctgaggttgcagttgagccaagatcgtgccactgcacttcagcctgggcaacagaacgagactccatctcaaaaaaaaaaaaaaaaaaaaaaaaaaaaaaagagtagggacttcctgcaaggcagtgggccggtgtcatgaagcacacagagactcttctagatttaattgggatttaggagattaaagcaatatgacaaataaatacaatcttgatccttgattggattctccatcagagaagggagctataaaggacatactggagataattgagacattttttaaatgaatggctgtgttaggtaagcttattgaatcaacgctgaattttttgtgtacgataccggcagatggctgtgtaaacaatgtccttatccttaggaagatgcaggctgaaacattttgggatgacatgtcatgattcaaatagttacatgcacacacacacacagtgtgtgtgtgtatagagagagaatgcaaagatggcaaaatgttaaccattggtgaatctaggtgaagggtgtatggtattcattgtattattatttcaacttttctgtaggtttggaatttttcaaaagagaatgttggaacaaagaagccaacattcttctttgggaaatttcttgggaaaggggttggtttttcagacactctggaggtggtggtctgagtgggtagcacagccttcatctgtctgtcttaaccatgtgacttggccctggttcccctgaagtcaccctgctgtcaggtccacctgtgtcctctgccctcaccaacctgttcaccataggtgtgggctctggaagctacagagaccccagccttcccagaatgacccaggagcaggtgaacttccccatcatctctcctgcctttgtgatggcagtgtggtcctttttgatggcagtgtggtcctttttgatggcagtgtggtcctttttgatggcagtgtggtcctttgtgatggcagtgtgggcctctgtgacggcagcgtgggcctctgtgacggcagcgtgggcctctgtgatggcagagtgggcctctgtgatggcagcgtggtcctttgtgatggcagcgtgggcctctgtgacggcagcgtgggcctctgtgacggcagcgtgggcctctgtgatggcagagtgggcctctgtgacggcagagtgggcctttgtgatggcagcgtgggcctctgtgatggcagcgtgggcctctgtgacggcagcgtgggcctctgtgacggcagtgtggtcctttgtgatggcagcgtgggcctttgtgatggcagcgtgggcctttgtgatggcagtgtggtcctctgtgatggcagtgtggtcctttgtgatagcagagtgggccttcgtgatggcagtgtggtcctctgtgatggcagtgtgggcctttgtgatggcagtgtggtcctactttctgttctcttagcaaaatctcagaagccaagtagtggagggccaagtagatatttgccagttgtttatatcactttaggtccttgtctttaagcagcttaggctgatatatcaaaataccacagactgggttgcttaaacaacaggcattatttcctacacttttggaggctgggaagtccaagatggaggtgttggcagattctggttttggtgagggctctctttttggcctgcagacagccaccttcttgctgtactttcacatgccagagagagagggatgtctcttcctcttcttatcagggccctcatagcattgtagggactccaccatcgtgacctcgtctaaatctcacctcccaaagacccccacctccagataccatcacactgggggttaagacttcaacagatagatttgcaggggacacaaatatttagtccagaacaggcccagtgacttactggggaaaaaactagaaataatccaaatgttcattaattagcacattggattcattagcaaattagtatgaaataagtaaaaaggtagaacataaaatattgtattcacaataactataacgatatagagcaactgaatagaagatgccttggagggctgtaagtagagttccctgttcagtagttccagtgggtatttttttgtaaagttgtttgagtgcctaacttaatttttttccatatatgaaagaagtccaggggctttcctaatagataaactttgttctttcagagagaaagagccttggttacagactaatgtcagctagaattttctgcttagcaagaaggagtatgtttttaaagaatatgtcttgagaaaaaaagccacctagctttggagagctagaaatgaaatggtgagcatgcagacagtttcctttttgtagccccgctctttcccactcggctcaaaccacactgtgggaggagggagaccagcttgggcctctggtaaaccgtcttccagagaaatgccagatccctgatggttaggagtatttctggaacaacctgcgtttggccacactgggcttgccactgttaaggacagatgtatggaacaggatgaggaggtcaggttcagaagccccttctctaaggggacctcatgcagaactgtttccagcattcttttttttttttttttttttgagacggagttttgctcttgtcgcccaggagtgcagtggcgcaatctcagctcactgcaacctccacctcctgggttcaagcagtattcctgcctcagcctcccaaatagctgggattacagtcatgcaccactatgcttggctaatttttgtatttttagtagaggcggggtttcgccatgttggccagggtggtcttgaactcctggcctcaaatgatcagcctgcctcggcctcccaaagtgctgggattacaggcatgaaaaaaaaaaaagctggccgggcgcggtggctcacgactgtaaacctagcactttgggaggccgaggcgggcggatcacgaggtcaggagatcgagaccatcctggctaacacagtgaaaccccatctctactaaaaatacaaaaaattagccgggcgtggtggcgggcacctgtagtcccagctactcgagaggctgaggcaggaggatggcgtgaacccgggaggtggagcttgcagtgagctgagatcgcaccactgcactccagcctgggcgacagagtgagactccgtctcaaaaaaaaaaaaaaaaaaaaaaatctgaaggaagctggagggtgctgcagcagtcattctagtcattctattccctgctgcggggtggtagaagcaatgctatcttctttttctctttttttggagacagtctccctctgtcgcccaggctggagcgcagtggcacaatcttagctcaccgcaacctccgcctcccgggttcaagtgattcttctgcttgcctcagcctcctgagtagctgggattacaggtggccaccaccacgcccggctatgatgctgttttctggacacagggttacattggctaaaacaatgtctgcatgagatttgatggcccagagaaaacccattgcaggactcacggaagttgtttatcttcaaatgttgcctctgaattgccatagaacttacagaagtgattgtccactttccaggcatcagctccagttttttgtttttttcaatgtattcttttttttttgagctaggacctcagctggtccaatggtgttgggttatcagaacttgttaacattagtgtcactaaacttgatatacaaccccctactgctaaagttaactggctttaaaaaacaaaaaacaaaacagagtctcactttgtcgcccaggctggagtgcagtggcacaatctcagttcactgcaacctctgcctgctaggctcaagccatcctcctacctcagccgcccgagtagctgggaccacaggcacgcaccactatgcctggataagttttgtattttttgtagagatggagtttcgccatgttgcaggttggtctcaaactgctgagctcaagcagtctgccagccgctgcctcccaaaatgctgggattacaggtgcgagccactgtgcccaacccttcagctccagttttgtggcctgtgtatgtgtgtatttaatgttttcaagtgagaactccttgcgcacatttataacccgctgaccaacctgacctctgggtgagacaaccctggcagattctcagcaagggccttcttgtgtgatgtccttggtattcatcgtttttctcctggcctgattcttatttgctgaggactcagagtctgagataaatcttgctgttttgagacaaggtctggttctgtcacccaagctgcagtgcagtggtgcaatctcagctcactgcaacctccacctcctgggctcaagccatcctcccacttcaagagaagaaaatgcccccagcccagtggtgttctgctggagatcagcaggaaaccctactccatagtcaagtcagccgttagcctttcaggaagttcttcctatggtgaggcctcctcaagatatatatatatatatacgtatatatatatatttattttaagaggtagtctcgctctgtcaccctggctggagtgcagtggcgcgatcttggctcactgcaacctacccctcccaggttccagcgattctcttgcctcaggctcccaaatagttgggattacaggcacctaccaccacacccagctaatttttgtatttttagtagagatgaagtttcgcgtgttacaggccaggctggcctcaaactcctgccctcaagcaatgcattcgccttggcctcccaaagtactgggattacaggcataagccactgcgcccggccctcaagagattttaaaaactgaccacttgtcttcttcttcttcttcttcttttatttatttatttacttatttatttagagaaccaggctggggtgcattggcacaatcatagctcactgcagccttgacctcttgggctcaagggatcctcatgcctcggcctcctaagtagctgggactacaggtgcacaccaccacagccagctaattgttaaactttttgtagagatggtgtcttgctatgttgcctaggcctggtctcgaactcctggcctcaatccaacctcctgcctctgcctcctgaggctgtgtgattacagatgtgaattgctgtgcccagcccttatcttctattactatatttcaagctggtcatggtcaaaattgttcaacctggttttcccccataaaattaagtcactttcttcaaccctcttccatcagattttattcatctcttagttttcttctctgtcctatattttctctatctcaaaatgtagcacctagaattcgacctgatattccctgataggggttgcggagagtacagattgctgcccaagagtgttttgttgttattgttgttttccttttttgttttttaaatgaagcttttggtgtcctctaaatcctctttgtaggaacttgccagaaactgttaaatctgataggattgaatctggcatgctccagtcatctgagcaagagtttgtttagggcttgtgaatgtgcccttgatcgggatgtgaggttggaatgcaggacgatgcttttggtctggacattggaacgcagcagtcggccctgggcaggggttggggcccggatggggtcggctcctcgcaggaacagtgatcctgtctctccccagacaccccccacccacaacatactccctccttgtctgcggcttacccagcacactccctctgctctttgccctgctggaagagctcatgcccataatatcaactgcaggactcctggaccaggcctgccttgctgccttccagaacacacctgccgcccccatccccctgatcaatagctgatggtgcccacatctatacgcccagctctcgcctcccctgagctccctggcctgtgggttgtctacgtgcacctcagcccaacacgctgacaagtgcctcatttctgctgcccctccacccggcattcctcatctcatcccggatccacccccccgacgctcagctgctcagaccaaaagcccagacatgtccttgttgtccccgcctccctcacgccctgaagacctgctgtctgcaattctggtcacctctctccagagtgtgttccgagagcagccctccctcctctcatctttctggctcctgcttcggtggctgttcagtgacctcctcactggtctccctgtttcccgtcctccccacccctgccaggctcttccagcaaccagcatgaccttcctagcgcagagagcacaccccccggcccctgctcacagccctccgcgtgcaattccaaacttcccacagccccaggtccaggagcaccctgcctactcggcatctgctcccagccccccacagccacagactcctttctggtgcttagacctgccagccctgcgcccacatcaggaccctgcccagcacacccctccctgcctgagcctccgcgcagtcggtcctcacctctctcctctctatgtccttgcccccgtgagcagatgtaaagtcccccgcctgccgcccgcccactctctctctctctccagtgtatcatcacgtttggctttcttcatagcacttcatccggtctgaggtcatcttttatttcagtgtggcttgtctgccgcagtggaacgcctgttccggagagcagggcccttgcccgccacatcccagctcctgcaacaggcccgcacgcagtaggcacctgttgaataaatacgccacaatgccacaaaaagaaagaacagaaatcgctgtgggctcctgcctagaggcaggtcctgtctctttgtctcccacctggggcagcaggaaggtatcttgtttctgtccctgcccaggcctgtagcccagcgccctgcacagccgcctgcagttcttgccctcgtgctgttatgttatgccccagagaggaagactgctctgtaaggtagtgagtttcctgtgccagaagcgttcagacagagacgggataccagcagttcatccaagtttccatcagcgactgtttttccttaggcggaagccacactagatcagtggttttctaacattttctaaaacactggatcctggctgtgtccggtggctcacgcctgtaatcccagcactttgggaggctgaggcgagcagatcacctgaggtcaggagttcgagaccagcctggccaacgtggcaaaacccagtctgtactaaaaatacaaaaagccaggtgtggtggcgcatgcctgtaatccctacttgggactaatcagctacttgggaggctgaggcaggagaatcgcttgaacccaggaggtggaggttgcagtgagccgagattgtgccactgcactccaacctgggtgacagagtgagacccagtctcaaaagtaaataaataaaaaatgataataataaaacactggatcccttcttgcctcttcagtgtcttatggaagcccaggacataaagcaaaaacagagctgctctgggtggcagtctaggccccttttactctgtcccctcctccttgcagcagtctctgcaaacctagggtagaattaaagggcctccaaatcaggtcctatgaccctgggggacccctgcccagacagaggaaggagaggggtgtgtgcagaggtgaatgtggaaggacagatcacattcctgaggccatggtgcaaagagcaccccaagtcccagcccaccacccctacccagtggcaccctcggttcttagccatcgaggagagagacctcacccaatctgatggcaggagaatctggaagtagaacttggagaaacagagattattgaaattgaacaaggtcaggcaatgtaggcaggtggcatgggttttgagcaggaaacacattatgaagttggcatttgaagatgttcttaaagctggatgagggctgggtgtggtggcttctgcctgtaatcccagcactttgggaagttgaggcaggagaatggcttgaccccaggagtttgagaccactctgagcaacatagtgagacccaatctctacaaaaaataagaaaactagctgggtgttgtggcacactcctgtgatcccagctacttaggaggctgaggggggagggttgcttaagcccagggaggttgaggctgcagtgagccatgattgcaccactgcactccagcctgggctacagaatgagtccgtctccccaaaaaggatgaattggaggagagcagatgtaggtgccacctgaaggcattgaatggttgtagcaggagaacaaaggggtgaagccagaagcctgttggagtgaaggggagactctagaattcagaatagaaaggaagtcagggctgggcgcggtgactcacgcctgtaatcccagcactttgggaggctgaggtgggcggatcacttgaagtcaggagttcaagaccagcctggccaacatggtgaaaccctgtctactaaaaatacaaaaattagccggggatgctggcatgcacatgtaattccagctactcgggaggctgaggcagaagaatctcttgaacccgggaggcggaggttgcagtgagcagagatcccaccattgcatcccagcctgggcaacagagcaagactcttatctcaaaaaaaaaaaaaaaaaaaaaaaaaaacagaaaggaaggaagtcaggttggaatcaacattcccaggccatgttaaggtgtcagagatgctgtggctgccaagaaaaactggacaagtgagagggggacagtttgagacttgggttactaggttctggacagaagttcctgggacatgcctcatccagttgcaaatacggatttagagagtggagcctgcgtgtccccagcctggagctgtagtttggagggggagatggctgagttgttttgccgggtatggaggaacagaggtgacccctgccccagcctgccctccctgcccaccaccaagcccccggagctggcgccagctgggctttgctgctccccccccgcccattgcaaaagatgagcagctgattggctaatggagtccttctggaaggagtgagagcattgtcaggcactgtggaggcagccctgggcccggcccattctggggttggggggcctgggcaggccccttgtcgccttcctgttatctccatccttgcctgctgcaggcaggggagggacaggtgtccccttgggagttaggaacggcctgcctcctggagccgctgtcctctaaagtcattctggattagccagtgggattggtgcagtcacagcatgcggcagctctggtggccacagggccacaagagaccttctttgcactgccccacagcagaaccatctccttgggcagcagacacgcaggcagaaatctgtctctatcactctctctccctctgttagtgttctctctctctcccctccccccgccttatctatccctctcttctctcccctcccctctctccctctcccgacttcagcactttgcatcacgcttgaattagcttgaatcagccagggcagccataaatggcagcgtgcagcctgcagggcgtgagcttggttcactgtgtctcccagctactgcagcctggccgggcccctcagcttggcctccggggcaccctggtcctaggctcctagcactggggaggctgtcaggaggcacgtcccgtttgccttccccctcccgcctccacctcctccattggagggaaaagctgaattagaaaattatcccagaacatgacattaaaatgtggtctctattcagtcataaaatgctgagactctgatcagtgaagtgatggagcttgggctcagcccagcctgccctggggaccagccagggtgacgccagctgcctgtctcaattcactgtttccatgaaattgattgactttcatcagaaacatgatgtattcatttgccagggctgctataacaaaacaccacagaccgggcaccttcagcaacagacgtttcttttcccagagttctgcagactggagggccaagttcagggtgtccgcaggttcgggtcctcctaagccctgtctcgctggcttgcagttggccgccttctccgcctcctcacatggtctttcctctgtgcactcacaactctcatgtctctgtgtgtgtccgagtttcctcttataaggacagcagtccttgggttagggcccaccctaatggcttcattttaacttaatcacctctttaaaggccctgtttccaaatagagtcaggctgagaggtagttggggccaaggcttcagcatatgaattggggcgtggaacacagttcagcccatgagccgagtagcctgaacactcctgggaccaagggcatggacaggaactccgcggtgatgatggccttgggtgaggtttgagtcagcgctcgagcagctgctctgttccgtttcctttgagacctcaggaagaatcagctgcgtactctgttgggttcgtgccgcctccaggaaatgatcctggtcgcacccaccatggcacagctgcctgatggtggggaggactcagaccatgagaccctggagagattgcctttggctggccgcaccttcacggattcattcaacgctgagctgaaggccaggtgcctttagcatcgcagtttgggcctttatcatctctcccctgagctctgtaccctcttctcatagttcctcctgcctcttctcttgccccattgcaatcctcccacctcagcctcccaagtgcagctctcactctgtttgtccgtgtttatttttttcgtttaaaaaatttgtattgacacctgtttattttttatttttatttatttttttagaggcagggtctcccactgtcactcagttggagtacagtaacatcatcatagctcactgcagcctcaaactcctggactcaagcgatcctcccacctcagcctccgaagtatctggggctacaagcacatgccaccacccccggctaatttgttaattttttatagagatgggggtctcacttcattgcccaggttggtctcaaacccctggcatcaagcagccctcccaccatggcctcccaaagtactggcattacaggtgtgagccaccgcgcccagccttgtttatccctgtttgaaagtttcaggtggcttctcacttcctgaggaatgaaaccaaacgctttagtgtcctgtatatgatctctgtggttgcagaccctgcatttctgcacactgtttctttctttctttttttctttttgagatagagtcacgctctgtcacccaggctggagtgcagtggtgcgatctcggcttactgcaacctccgcctcctgggttcaagagattctcctccctcagcctcccaagtagctgggattacaggcacccgccaccacacctagctaatttttgtatttttttagtagagagggggtctcaccgtgttggccaagctggtcttgaactcctggcctcaaatgatccacctgccttaacctcccaaagtgctgggattacaggcataagccacaacacccagcctctgcacactatttctgactgtgtcacacccaccctgcaatcatacccaagtctgtagagccactggaagagccgaggtgttccgtgcctccatgcctttacatgggctgtgcactctgcccagatgcccttctctctacatctgcctggcaagcccatctcggacccagcgtggctttctcatccactctgaggccttctttgctccctgcagacacagctgagctccctttcctccaggcccccaccgtgcacactcctgaaaacatagctgcaaatttgattgtgccaaagcggaaggaaagatgggcgtgctatgagggaggcacgaaggtaaaatccttagtgccagctctctgttgagcacagccttagacgatggagctctggtatttcgcacaaggttttgctttatcccttcccatcccgttgcacacacacacacacacacacacacctgaagctaaagagccaccccttgcagaagggtttgtgtctttgtctccattgcactgtgtctgaaaccggcacttcttactactggagtcagcactttcacttttctgttgtgtccacacttttataaaatcagggcaaaatgcagtcaacactggtggttttattgttttattttgttttgttttgtttttgagacggagtttcgctcttgttgcccaggctggagtgcaatggcttgatcttggctcactgcaacccccacctcccgggttcaagcgattctcctgactcagcctcccaagtagctgggattacaggtgcctgccaccatgcccagctaattttttttattttttagtagacccagggtttcactatgttgtccaggctggtctcgaactgctgacctcaggtgatccacccacctcagcctcccaaagtgctgggattacaggcccccggcccccgttattttttaaaaaagtaaaacaccacagccagaagcagggaggctgaggcaggcagatcccttgggcccaggagttcaagcccagcctgggcaacatggcaaaacctcatctataccaaaaatacacaaattagccaagcctcgtggcccatgtctgtagtcccaggtactagggaagctgtggtaggaggattgacggagcctggaagggcaaggatgcagtgagccgagatcgcatcactctaccaacagcctgggtgacagtaagaccctgtctcaataataacaataataataattggaattcattcaattattattagtatattctttaaaagcctaacaagttacccagataaaagtgaggatgttatttccagtagaagcccaggtgtgaggccctgggatgcctctatgaggtgcagtttgataaccactcaaaaaaacattccatggctatccaacccttgacttcagcagagctgagatttgatgcaggcaaatttgagatgttcttggcctgcaaagtctgagtgtggtgagtggtggacaggagaggtgtcagtggatggcggacaccgtggtccaggggctgtgggagttggaatggagcggttctcaggcagggaaaggcagggtggaatggcctcaggacaagcacatggtaggggagggggctctccaacgagtctctccacccgggcccactctaggcagctcactgctctggtcccagagggtccttgtcccccaagcagaaattgggctcctgggcctatgcccccgcccatccagataagtagatggaagggggagggtttgaccgccccaactggggccacgggattcaagggacaacttccaaaagaacaggggatttctgcacagacaacaaaataaatggccaattgagcagtgttttcaagctttttttaattaggtgtcacaataagaaagaaattttaaattacatcctgtatataaagtcacacagctacaccagaagttttttgttgtgttgttgttttgttttcttttgtttgagacaggctttcactctttcacctaggctggagtgtagtggtgtgatctcggctcactgcagccttgacctcctgggctcaagtgatcctcccacctcagcctcagctgggactacaggcacatcccaccatgcccagctaatttttgtaatttttttgtagaaatgaggtttgacatgttgcccagggcggtctcaaactcctgggctcaagcagtccacttgcctcagcctcccaaagtgctgggattacaggcgtgagccacctcacctggccccagaagttttataaaccagtatctaactctaccacacacaaaacactgtttgtctttaatttctttttcttttttttttttttttttgagacagatctcaaaaaaaaatccagtctgttgcccaggctggattgcagtggcgtgatctcagctcattgcaacttccgcctcccagggtccaacgattctcctgcctcagcctcccaagtagctgaagcagtcgtgcaccaccacacccaactaatttttgtatttttagtagagacgggatttccccatgttggccagactggtctcgaactaatgacctcgtgatccatccgcctcggcctcccaaagtgctgggattacaggcatgagccaccgcgcccagccttgtcttttatttcattctgggatacaggggtgtccccagagtcttagtgcagttttaataaataacttcagatgtttaaatgtacaaacctacaaaacatcagttgaatatttacttatttaaatttcttttccacttagtttcctgacagtcaagtgctagattttttcattttaattctccgcatgtgctagtgtctggagggacaggcaggcaaaggacccctttcctgggctgaattgacctcccttgaggtcacgtgtgcacaaaatccagttctttggaacctggtgaagctggaatcaccagtgcaatcttttcccgtcactgaccaacagtcgataaaaggtttttcgaagtttgaacaactagagccatgtatagcactagagggggtactgtaagaatctgagtgagagatatcaaggtattttaaatgtaaataacctttcaaatgtcattttttggtacatttgtagtatctatacttctgaagttattaaagcctcaaacttcaccaagactttggtcgcccatttttttttttttttaacaatactagtaaggccttctcatttgctttcctgacccatcaatgggtcatgaccacagctttttaaaaatcagacttccaggccgggcgcggtggcccacacctgtaatcccagcagtttgggaggccgagacgggcggatcacctgaggtcgggagttcgagaccagcctgaccaacatggagaaaccccatctctactaaaaatacaaaattagccaggtgtggtggcacatgcccatagtcccagctactcgggaggctgaggcaggagagtcgcttgaacctgggaggtggaggctgcagtgaggcaagatcgtaccattgcactccaacctgggcaacaagagtgaaactgtctcaaaaaaaaaaaaagaaaaaatcagacttccaaagtcaagtacaattttttttttcttttggtgacagggtcttactcttgcccaggctggaatgcagtggcacccccatggcttactacagcctcaacctcttgggctcaagcgacgcacctgcctcggcctcccaatgtgctgtgattacaggtgtgagccactgtgcctggcccagaatctaaatgtgtaccagcctctctgtgctcaggagggcttgggcacgtcagctgatactgggtcctttggggatacggatctgccctggctcatggactcctcgccctggagtgcaattatttgtttgtctttcctactggaccacgagctccgtaaggcagggactgtgctcattgttgctgttgtttttcatttaatctttgtgtcctttgcacataataggagaactggcctcctgtctattcttgatattgggcttagttccggggccgtgccctgaataggtcagtgactgtttgcctgtcattaaagagagacatcaaccatgagaaaaaccaactgtttttctgtccatgcacacaacactccacagaacccttcacttctgataccaaatatgcagccagccccacccctgcaaccaacaccttctccagccacccagacaccaagtgggtgtcctcccgttcaactctgacattaactgcctggaatcagtgcagaccccacaggttagggcccagtcccacagactgccccctacttcaggggccaatcacaagtatcaggtcccctcgttccccacactttggtcctacttgcctacaaatcaagggttccatgaacccctcctcaagttgagtaatttgctacagcgtcttacggagctcagggaagcacttatgttaactggtttattagaaaggaagtgataaaggctacagatgaacagccagatggaggtacctaagtagagtaaggtccagtagggtcctgaatgcaggagcttccgtccccatggagttggggtacgctaccccctgcgcacgggaatgcattcagcagcctggaagctctccaaaccctatcgggatgttgacggaggcctcatcacataggcgtcatcgattcttaactcaatctccagctcctctccagtctctggaggaagctggggggtggtggggctgaaagttccaagctcctcattgcagcttgatctctctggtgatcagcccacccaggagttacctcattagaacaaaagacactcctgtcacccgggaaattccaacggacttaggagctctgtgccagggactgggatcaaaaccaaatgttagaacaaaacatgctgctagcacccctgtaacttaggaaattcaagggacttaggagctcagtgtcagggctgggcatggtggcatgcacctgtgatcccagctattccagaggctgaggcaggaggatcgcttgagccctggaggtcaagactgcagtgagccgtgattgcaccactgcactccagtctgggcaacagagcaagatcctgtctcaaaaaacaaacaaaataaaaactgtgtcaagaactgggggccgaaaccaaatatatatatatttaggatgttacattctttctacttttttttttccaagtgatccttctgcctcagccttctaagtaggtgggatcacaggtgcgtgccaccatgcacagctaatttttaaattttcagtagaggcgaggtgtgcactatgttgccaggctggtcttgaacttctgggctcaagcagccctcccacctcagcctcccaaagtgctgagattgcaggcatgagccaccacacctggcctcttactttttttttcttttttagaatatataagaaaataaataaagaaaaaatggggtctttggatctgactgtccaaagacaccattagcatttaaaaaatatatttagtcattcatgcatattaatggaaagtccaaattatactgaactctataagacggaaaggaaaagctgccccccaagctcctttcccaagaggtagccactgctgacagtttctcgtgggcccttccaaaaaacaaaccttttctctgcattttcgagcacatgcgtgcatttccactttgccatttacagcaagatgactgcgctgctcacgtggggctgctgcttgcatttttccctcgatttatcttgatgtacttttcatgtcagcacctatcaacgcctcctttttttttttttttctttttttaagatgcagtcttgctgtgtcactaggctggagtgcaatggcgcaatcttggcttactgcaacctccacctcccgggttcaagcgattctcctgcctcaacctcctgagtagctgggattaaaggcacctgccacaacactcggctaatttttttttgtatttttagtagagacggggttttgccatgttggccaggctggtctcgaattcccaacctcagctgatccacccacctaggcctcccaaaattctgggattacaggcgtgagcgaccgcacccggtccccagttctgtcttttcaactgcacgcggtcagagtcattatataaaaatcctgatggacatttctccagtctggagcagatccctagaagtgggtttgctgtgtcaaatggagcggctcctcttcctgcccccggaagaggcctgcccactccgacctcagccatagagatactttgctgtgcaaaatttgggaaacgtcaggacacacaggcaccacttcgccatagatagcactaagtctgtgtgtacaaagtgcccaacagggaagacgctgtgttgcctgcgcagctccccccaggcagcattttgtgtagtcaaggaagtccctcaggccaggcacagtggctcactcctgtaatcccaacactctgggaggccgaggcaggcggatcacctgaggtcaggggttcgagaccagcccggccaacatggtgacatgccatctctactgaaaacacaaaaaaattagctgggcttgggtggcgggcgcccgtaatcccagctactcgggaggctgaggcaggagaatcgcttaaacccaggaggcagacgttgcagtgagccgagatcgcgccactgcacgccagcctgggcaacaagagccaaaactctgtctcagaaacacactcagaaaaaaacagaaaccaaacaaacaaaaagtcactcagaggagctcaaggcccctctgggtttgccacttccgacccgctgtggggcttgtaaaaactttgcctcccggcacagctcagtgttttgttagggagcctcccgtgagcggccgacgctggctgggctccatgggatcagctggggctgctcattcattcatttccacatctacccactgggcttccaagttgaagttcctggggctcccatgtcccctccccatgaccttcaatcccacagagcccatgggcacggcacgtcgctctcatcctctgacattcctgcaagctgaagtcacttcttccttccaccaaggccatcccgggccattcctctgatcatctgtttattgtgtctctgtgtgggagagaactggctgaagaggtggggctccagttttgggaacatggacactgagagagttggggatggaaaacaacatagaaggaagcaaagccagaggctgcgatggccatgctgcctggccctggtcccagacagacaccccagccagctttcctcttgcaccctttgtctgctggccgcagcgtcgcagtgggagtcctgggcccacttctccaaatggcacacagaagcctcaacaggcacccacctgggaaaggccaaggccgagggcttggggtgcacagtcaagaacacgcctcagctcagcatttgtgagccgagtcactttggcccatcgtttgtacacagcccccacctgctggttgaccatgaccacagggcaggcgctgccacagggcgtgggcaggctggaccttcgagggcctcctctgtctcccctaccttctgcccccccaccacttcccatcacccagtctgtgccaagggcactgaccctgtccttgtcttgcaggaagaggagcaggacttggatggtgagaaggggccatcatcggaagggcctgaggaggaggacggtgagtgggacctctgcgctcatgagggggcctgacagtgtcgggggtggtctgtgtcctgctggggatcacaggagctggggttcgagtgccgaggggagggatggggtgggacagtggcctgagtggggcatgagaggtagagtctggcgccatggatgtcctgccctggcctgcctgtagccctccctcacccccattgcactttggggcttggctttcccatcccggggcccctcttgggaacacactacacgccctgcctggctctgtcctgcgctgcctcctaactccccttttgtgaccgcgctgtacatttcacgattctctccaaacatctctgacctattttactgagacgaaaaccactcacacggcctcccccgtgccttcttcagaacgaaggccccaggagggcacacgcctgctttctaagcagctctggctgactggccacaggccccagccatgagactgagaggagaaagggagtgaccgagaacaggggagacactgccagatcggacccggccaggacagacagaggcggaaccaaacatggagtggcttctgctgggtccatccacttatttctctaaaaaagaaagcggaggcagacatgcaagatgtcagcgtttgttggctctgtgtggcaagcacagggaggattagtgctttctgcatttttgtatgtttgaaatatttcataattttaaaaaagcaagtctgcttttgtgatgttaagtcggctgctggcaggagcagtggaaagagaaggtttcaggaatgtaggaaccagctcctgcgggcaggctgggctggggtgcagagcttcccctgaggcagtgccttggtttccatcagcacagcctgaagcaggaggggagaatgaagcttgggtgcaggcggtgggctgcaggtggggacattagtcccttaccaggaaggacccttgctccctgcttttggggactggggactcaccgcagccatggccctggcatctgtccctgccatgtggcctgagacagctgaagggatgcagggatcctgttagtgacttggggacacgggagggaggccctttggcaaggacaaggagagaggctcgcagacccctctccctggcatagctgccagagggcacagtcccccagcactgtcaccagcctccccccttatctgcaccgctgctcctgaacatcccccacccccagcgcctcctgccatcttagcctcctgccatctctagcaaggcagggaaaggaaaggtttatggctccagctgttggaagaatgtgtgagcacctccagcccctctgcagtacgaggcagcctcagaggttaattattagtgtcgctaaaatgacttccctgagcgactaggtgaattcacaggagactggaggaagaaacctcccccgtccctcggaggctgtcacgttgaattctggtctagcaaaactggatgcgctgcctggtgcactgcatgtgactgagcgaaatccttttcaagtcgtttgttctgtctggctcagaaaacaaaactaatcagacttgccccataaattgaaacctaagactgggaccaaggcaggattttgtatgttttctttttttggggggtagggggatactggaatcttactctattgcccaggctggagtacagtggcgcgatctcggctcactgcaacctctgcctcccgggttcaagcgattctcctgcctcagcctcctgagtagctgggattacaggcgcctgccaccacgcccggctaattttttgtatttttagtagagacggggttttgccacattggccaggttggtctcgaactcctggcctcaagtgatccacctgccttggcctcccaaggtgctgggattacaggcatgagccaccacacccaaccagatgtttgggttctgaattcgcatctagaaccttcttcctttcaccctgagagcccccccgcctccccatcggtccacatcagcctatccggtagcatgaaggctgcaagctagaggggaggggcctggcttttcgggctgctggacaggatatggagggacagagagggcagcacttccagaatagcagctgaggatctctctatgcctccctcactgggtcctttagttagtggaggtcgataagaggccagccagctctgcccgacacctgctggattcaggaaccaagaggttgctcccccatggggcttttccctctggaagctcagcttttctctcctcaccgtggctcatgtgcccggagcctgtgtccactccaggccacaggtcctggcttcctctgtgcccaccacctacccatccatgtgccctcttcaggcctcgagatctgtccgttttttgcaggcagcaatggggggtctcccctcggggactggcaaatcgggctctgcctcttcagcggtacacacgtcaaacctgctgcagcaaatcccgcatccctggcctggccactgtgggctgcctggatgcgtgttttcagatttccaatagccacagggggtggggggatgacacaagcctccccaagcccaggcaggcgtggtgtgtgtcccaagatgagctgtgctctgcttgccggagttgtcgcctctgagctcagtagccgagaggacctgctgggcagggccagggcaaggcagagcactgcagatgttgggagggatgtggcatctggagacagctgtggactaggagtaggactgctttctctctggctgtctcgttgtaggatttaagggaaagctatggaacgagagggggtataggcgctggggtgagatgtctctgatagccagatgtggcctctgcttgaggtgtttctttttaaacctagggaaagggggccggggtttgtggggccagcctctacagcactcctggcacttactgggtcccccctccacaggagaaggcttctccttcaaatacagccccgggaagctgaggggaaaccagtacaagaagatgatgaccaaagaggagctggaggaggagcagaggtaggctgcagccccttcgctggcgcctggcgggctcttgggggaggggggtgcccctctgagcccttcatgttcctgccccttggcagaagggcccagaaaggaggtggggctcctacacgctctgcccaaccaccgccccaccttcccagtttaggagttctttcctgccctggtcagccaggctcgcacacccctggcacccctccctggcactgaccagaaggaggccactggtgatgggggatacagagcccatttactgcacccccccaccccctccacaccccactgcccccatctaaagaaatgagatgccaggaaagagcctggagcagacctggctgtcactcacacacacagtccccaacagagctgatttctccatttctccttcgggacacagcggattcttggtgctcatccttcagcggcctcccaggccggcgcctgcagcagcgccttgtagctccgggcagtgcagctatggcttctcgttgttggaattggctcccccttcccatttggacaccccctgcacagccactgggcaccccgccaccttttccctccacaccatcctgctgggcggggaaggggtgcgctgggcacagtgggacagctggggaggtctcagcagagggacagtcctttgcaccaggcgcagcaggctcctggtgctcacccacactgctgcccttctgcagcgtggcctggagtcctttggttaaagcagaagtctaggtggtagctgtgccattttccaagcctggcgacccagagcagcttgtgggaatcaccccctacttgtcagcagaaaccagcggtctagggtccgagcaggaggggtggtttatgattttggaatcagaactcaactgccctctcatggctgcatgccaagccacccgccgggcagccctctaacctcacagctgctctgccggtgacaggccctgtctcccctcccgctgctggcatcagcgctctcgaccctcagcaggaaagctcttcaccctgggtgggtggggggcgggcagtgtaagcacagccaggaggaagagccctggcaggagccccgagtcctcaggtgctgaggatgctgccgcttggcatgaccaggtttgctgcatttatatttcaggattgagctgacctctgacctcacttccctgtagcaagttccttaggtcctgagccacaaatattcttgcaaatccttttggtaaggacactgatttcttagactagtggtgctccccttctactgcgtgctaacgtgcccccaaacaactgacgcggcctcaacctcccctcctccatcgccttcataaccgattaatacatttcccacctgagcccttctcattcttctcaagcacgaggaatctctggcagaagaggccccgtctgggggcagaggttcctggaggggagttaagtccctgagttcctggagggggcctaatgggccggcaggttggggtgctagcgccccctcgcaaggctgggggaactgtcaccctgggacctcaggcttcggaaatgtggatgtcgtcaccctgcagccttgggtctcaccctgagaagatgaggcagcttctgcacagtgcacagcagatactctgagaacggtccgtgctcccaagctgtgagacaggcaggttcttaggatcagggcaagggttagcagacaacggccgggccacatctgatcccccacctgcctgtgccaatccagcgtggcagtagtagcaacactcacccattttcctgtggtctgtgcctctttgtgccgcagtggccgaggtgagtcactgcagcagagaccacacagccccccaaatctaagtagtatctggctgtttgcagaaaaaggttgcagtccctggacagaggctagagggggctggacacaactgccagcccttgaaggtccctggggacagaggctgctcaggcagatggatctggagggcctcttagaacaagaaagaccaggcctccggctgggggtgaaactgccactgccacccacgtccagagctgggaccttggcagtggggagggaaaatcccttccccttattttcagagagtagaccctctgctgcccatccttcccccactggatctttggaggtctctagaccaccaacccacacttggctgttctgtgggaccgagactgtgcccgaggtgctgctcctgggacgagggaagactcctcgactcctctgcatgctgcagttaccactttgtgccctgaattgagaaggaggggccggaggacttcttggggcaggactggagttcacgttcattcccatcactgcccagcccgcatgctccctgtggctcctaggcatgccggtggcatctgcttgctcccccacacctctgcccccctgcatgtggttgcccctcgcagcactgcgtggggtctccgcggctccacatcacgctgtcctcacacggtgatgcttggggttgcagaggctggtcagtttggctttggctcttcatcttcagcacgatggttctcatgggggtggggagcgctggcagctgtgagacagttctggtcccagccaagtccagggaaccgccctagaatcatcagtatgaaaaataacatgcctgttgttatcaaaccactaaaaccacaggccagctagcagggtgctctctctccgcctgtcaggttccaccctcccggcctccatgcctctgatgcctttcccagctctcagggtccagtcgagttgcagctacaagctgcacgtcccctaactttaaatttactagctcagccaacagatctgcatctagaacctgaagctttagtggttgccagttccagcactccccaggagcttcagttcacaggctctcatgacaattaggaagtgggactggaagcagaaggcccccaattagttccccgacatgctgaagtggtcagtctcatccttgaactactcacagatcaaattccttccgcctggggccagaaagcggtcaggtctgtaaatccagaggcagctgctgcttaagatcctgcttgccactgtctgcccgcctcctcagctctcccctcgggccggagtttcacacacttcatgcctctggtggcgtccctgggttccgctgaagctgctgtgggaagtgccacctccagtttcacagtgtggctaggacagtgggcttgcaggctggtgacagctcccctgagcaagaggcctcctcctcctcccccagagctagggaagctggcagggcttggctggcttcacagcttggcaggagaaagaacaggcgcggctgtcagctcctctccatcacttcttcccaccttgtggtctcagagggaaaatgaacccaggctatagactgggctggctctgatagatcaggacccacccctccatttgaggtctgcagggctgtcttgactcctctggaaatggacatgactctagaggaaggtgctagtgtggtaaaacagggaaggggaggaggaggccaaggaaccccagctgtggggtagttctggttcttccatctgatgtatgcaagaaactacagacaatagacctgccagtgtgaatttccagctcaggctggaaatgcgtgctgactgtgaccaccaggagagggcgtcagagggacaagatcagacctgctgggttctcagtggtcccagggctggcagtgtgtcttggttcataaaagacgggcatgcagttggctccatctggaagcgtgcatcctagggtgccagtatcccccgaggggacaaaactcagccagcgggaatgggaaattatctagggtgataggaatattgtcagcacaaccacacaacccaagatcagaaaggcccttggcaactcaaatgcccaagttccttccttaagtaccctgcagaggctgaacagggtctgtgggctgccaggttctgtgcgggatcaaggggagctctgcaagctctggccggcttggcggcacagactgtcttgctgcaagcgatgagaagcaaatcagcagtggtttgagaaaccagagtctagcgcagcttctgcaattccaaacattctccttcctcgtccccatttccccctttccttgcccatggtgcaggatggaatgagtaaaataaattatctttttctccccatttctctttacagaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaattactgtgtgttttttcagtttgctttgttttaaaacaaaatcccttttgaacccattgaagtttgacctttctttcattttgatgcctcttactctgcagcagagtacaaagccatacatccaccctgttaaaaaatatgcagtcaccatggctgtcaaaaccacatgacatgatctgtgttcactcagggacatatggattgtgcttccatccacagagctcagcacatcctttctgttcacgggaattcctcttcttcttctttttttttttttttttgagacagggcctccctctgttgcccaagctggagtgcagtggtgcaatcacagctcactgtggcctggacctcgtgggcttaagtgatcctcccgtctcagcctcccaggtagctgggactacaggtgctcaccaccacacctggctaattgttttatagagacagagtctgactatgttgctcaggctggtcttgaactcctgggctcaagtgatcttcccatcttggcctcctaaagttctaggattacaggcatgagccactgcacctgaccctctttcttcttacaggagggcacaaagcacacatcataggctgctgcttcaccagacaggggaaccgactgtagacacagctttcccaggggacaagggaggctgggaagtgggacttcagtatttcaactactagatgctgctctagacagaaaattttgcaggatggaagatgcggggctgaggagaggagggaagggtgaagcaaaggaatatggtagcaaaagtatgggagcgaacgtggagaccacccctccaggcagtgtgggggatgccagtggcccagggctatgctgaggtcctgcggttgcagagcctgtaacgtgcttacagccgacccagctgcagagcagggctgagaggtccgacactgtgatgtggtttacgttctctgaaggcactgagcccgtggtgtgtggggggcaggaactgcagaaaccagaagagtgagatgcagccaggatgcagtgcccggctgggctgaggagcacagggcaccagagtggagcaaacaacaaacatatggctccctgggttcggcagccgcctcgccccacctgaggtgtttgtgctgcagaagttgtcctgtgctggtcagatggtgtagctgagcctcataaagataacaagacattgctcccagcacagaacccgcgtggagcaaacatttaggccagtcttcctccacacccatcccttgataaaaggggcagggccgccacctgccatagggtatcttgtgcaaattaggaaaaggcacccccctttctctggccagtgaaaccccacaggcttccctccccgctcctttgccaagcaccgtcttgcacacacttgtatgctccctgatttcccagctgataatgttttttctttctccactttcggctcattcctctcaacgaaggctgtttctaacctacttcttcatagcactacctcaagctgcttcatggagcctatcttcttcctcattacatcactgtgggacatgcagtcaacaatcaaatgaggcccaaagggaaactgaggcacagagcacctaagtgatacctggggtccccaaacctccccggcaaacctgagatttcgcatcccagtttttagagccctcaaaagttgcgtgtgtcagacccaaccagctccgatgttctaagtgggttttattttcattttcttcttgttctgaaaagcaaccgcagtcacacaagagagaggagagtcccaactccgccggctgcacacaggctccctctctccccagtgggctaggagcaccttcttcctctttgtcctttcttctcgacagagttcagaaggaacagctggctgccatcttcaagctcatgaaagacaacaaggagacgtttggcgagatgtccgacggcgacgtgcaggagcagctccggctctacgacatgtagactgcgcccacgggatgcacagcggccatgcctgatgctgtccccacccttgccccatgcccttgttctttccagacttctgtaggcctaattttcccttataaacatagatgcaggcgtacattctataggtacttgccgagttcttgcagtgtgtatattactttgcaggaatcaaaattgttttattcagaagacaaagtccctgacccctctggtttctgcttgctggtgaggttccagctgttattgggctctgaggccctctcctgatccaaatctttttttgtttgtttgagatggagtctcactctgtctcccaggctggagtgcagtggcgtgatcttggctcactgcaacctccacctccctgattcaagcgactctcctgcctcagcctcccgagtagctgggattgcaggcatgcaccatcacacctggctaattttgtattttcagtagagacagcgttttgccatgctggccaggctcgtctcgaactcctgacctcaggtgatccgcccaccttggcctcccaaagtgctgggattacacgcgtgagccaccatgcccggccaatactacactcttattctgccttacgaggatttctggaagcttctgtaactgtagggaagaaagctgtaggggagcatggtttttttgttttgtttttgtttttgagacgaggtctcactgtcacccaggctggagtgcagtggtgccatcatgactcactgcagccttgacctcccaggcgcacaaaatcctcctctcagcctgagtaactgggactacaggtgtgtaccactacatccagctaaaggagagcgtttttttctttttctttttgagacagagtctcactctggcgcctggtcactgtgcccttcaccttctgggttcaagtgattctcctgcctcagcctccctagtagctgggattacaggcatgcaccaccatacccagctaatttctgtatttttagtagagatggagtttcaccatgttggccaggctggtctcgaactcctgacctcaggtgatccacctgcctcggcctcccaaagtgctaggattacaggcgtgagccaccatgcccagctgggagcgttctttcagcaaaaagtctaattcagagactcaccttccatcctggcactaaacaatagtactagaggtaagatctgccaagaatttctctcacttaagcaggatacttactttaaatataattaggcaagacttatttgagtacttgcctaattgtatttaattagaactatgctggatgctgtagacagaagaaataaaatactcaacttggtccctatcttccagcaggttagaggcctttagggaagaaaagcctgtgtgcagggaaagagaacctcaccagaaagtattcaataaaatgccaaagtgatcttacagaacagtgcctgtgacaccggaggggattgttctgtctttgtgagtgaacatacaatgatggggataactggtcctcataccatgcaggtcccatttctgatcaccccactggcaggacaattcacagttcttgagcaaactgagttagggagggtatgctaacgacagaacctatgcaagttcttagaaatattttttgtttgctgaaataaagctcaatcaacacactaccttaaaaaaaaagtggagcagtggcatttccatgcctcatgctcaccatcatgaggttaacttcccgccgtcgcctcttgcctgccaggggtttttcgggagcccctctctgttccactctgattccttttgtttcttgctgaccattcactctctgtgtctgttgttggatccaaatacgagtgtttttctttc

SEQ ID NO: 37724 - DNA, 62183 bp, Homo sapiens
cgaagcgggtcctgccccgctgtcagctgcggcccccggcgccgggcgggggtggccgcgaccattggcggagaggcgaaaggggcggggccgccgccagccgctgcgggcaaggctgaacaggcggaggtgggcagccggccagggaagcacggtccaggcggctacattcggcccggccatggcagcggcgcccctgaaagtgtgcatcgtgggctcggggaactggtgagcggcggcgggctggaggccggggctccgcttccaggaagcgcctctcccgggcggtgagggctgcgcgccccatgctgcggcgtgggcaccgggcactgcgcgcagggaggcggggtgggcgacctcgttgctgggctgggcaccgtgcgcccgaggaggccgcaccggggcactcgctcgggaggcgctgggctcgcgtgcgtgcgggggacagcgcggagagagggcaccccgagcacgcgggcacctgtctgcgcccccgttactgagcgcacagaagccacctgcttgccacgcctgggtgttttgcacaatatcctaagggcgtattccgttctccacggcggatctcctgggtcaaggacttggtggaggctcgagcattcttactgcagtttcggtgttgaggaaaccgaggcggagagggctaaagggctcttgctgcccaggtcacgggcggggcatgctctgcccttcaaggtgcccgtctcgcccccgcttctgataggtccactatcttaggcgcgtcgtatcaggaagaaaatccaagtttcaacaggccgctctccctgaggcgttgagaattctcccttgccgagatgtttgcgaagctttgcgtctctttggggccttatttgactttaacattttatagagcacattagaaatgtcagttcttctagtacccttaatcaaacgtacactgtgggattctctggtgtgtttgggtgaatgtagaggtgggggtgtgaagggggaaggaagcaaagtgtagcatctggtgtttccaagccttttttcattgctgtacactctgccacattggagggactggtgtacaatagttaagagtgatgatgtcctttcagtgcttctgtttaccggtttttctgtggcgtgacaggcatcagaagtgctgcagcagctggtcctaggtagttggtcttagttttactctttcaagacttggcccagaaagtacttattgaaggaaaccttacctggttcttcacttttccatcccagcaaggccagtggcctctctctgtgtccctattgctggcctgcatcactgcattataaggagttatttgattatctgtctcccaacttttgagaatggcatctaccctagtgcctggcatatgctaagtcaatactaagactctgttgcagtggtgcgatcttggctcactgcaacctccacctcctggattcaagcgattcttgtgcctcatccacttgagtagctgggattacaggtgtgagccaccgctccctgcctaaaaactaatttttaaaaccataatgatatttgattgaataatacattcacattgtttaacaaccagggctgggcgcagtagcttatgcctgtaatcccagcactttgggaggctgaggtgggcccaggagtttgagactagcctgggcaacacggcaaaaccccgcctctacaaaaaataaaatattagtcgggcatggtggctcacgcttgtaatcccagcactttgggaggctgaggcagggggatcacgaggtcaggagattgagaccacggtgaaaccccgtctctactgaaaatacaaaaaattagccaggtgtggtggcaggcgcctgtagtcccggctacttgggatgctaaggcagcagaatcgcctgagcctgggaggcagaggttgcagtgagccaaaatcagattgcaccatcgtactctagtctgtgtgaagggagtgaaaccctgtctcaaaagaacaaaacaaaacaaaaaataaaaaacaaaaaccaaagagtaccaaaaacagtgaaacatcacccatccacatttatcccccctgagtacctcctggaggaaaaccagtgttatgaattacttctgtcctttctggaggaattccatgcaagtgaatgcttacatatagtcctttcgccctccacgctgcaaatactagggtattgcatacttttctgtgagctgcatttttcaaccaacaacagaatgttctacacaatatttaatagagttggtagcttgctgctgcaaagcttaatttggactttcagcttggctttgccagttgtttttttttattactatttttttagacggagtctccctctgtcgcccaggctggagtgcagtggcgcgatctctgctcactgcaagctccgcttcctgggttcatgccattctcctgcctcagcctcctgagtagctgggactacaggcatccgccaccatgcctggctaattttttgtattcttagtagagacggggtttcaccatgttagccaggatggtctcaatctcctgacctcatgatccgcctgcctcttcctcccaaagtgctgggattacaggcatgaaccaccgtacccggccggctttgccagttttaatgtcaagctcacttgagtgcagtgtcagctcccctgttggccatgccacttgaaaggcacccatttagcacatgtttttttaacattagttttttagtctgtacaattccacagatgacagccccttttcctaatttgcaagatgcaggacaagtagcacagctctgccatgctggaactgggcctggagcaagagtagtgaagtgagcctcctgccccctctgctgggatttggctgcctgcccgtggcttcttcattctggtgtacttgactgtttccttggcccactccagcccagggaaatggagtagaacttggccagtgatactgaagcagagcaattgagaaatgtgctgatggtttgggctggctgcctggcttcattaattatgggattagacgggaacaattcttggcttctgtgccactgccttgggtacagagttactccagtcctagagagaggatcacaacctccccagagggattcaggaactcagaaactgaaaacaacatggagaagccccagaggagtgttcagctctagtcagtagacatttgagtgttgcccggtgaagagactgtggtctgaccagggatgcagacacagctggacacagtcccggtccttaaacaacttaccttcaggtctgagatcagtgaggacatggaagataagaccgaaggaattgccaagtggaatggagtaactgctctgttacactttaaatcgtgtttctttttttgtttgtttgtttttgtttttcttgagacggagtctcgctctgtcgcccaggctagagtgcagtggcgcaatctcagctcaccgcaagcttcgcctcgcgggttcacgccattctcctgcctcagcctcccaggtagctgggactacaggcacccgccaccacgcccagctaattttttgtgttttttagtagagacgaggtttcactgtgttagctaggatggtctcaatctcctgacgtcgtgatctgcctgcctcggcctcccaaagtgctgggattacaggcgtaagccactgcgcccggcctaaatcgtgtttcttaaattgtggtcccaagaccacttgtgtcagaattaccactgaaactagacttgcttaatcatatcccctgagaatgagatttttttttctgaaggaactttagccttttgccaattttaatacagatcaccaagagatagacctacccttccagatctggttcttacctcaggaatgtcaagttgcttaagcaatgtttatacttggaactttagggcagcttagcctgtttgtgtaaataaaggtgtttgtcacatttgagaactctcacatggagtgcctctcccaagtcaattgtcatcagttgcaatacagttatcagaatattgaatctagctggcttgccagggagcttcagccaggaaggtcctgggcaggaaagtagacgtgttgtataacatgcccttgtcctgtcctttggtgaagctcattttctctacatagatcagagagaggaggctagaggaggggccgtcatgcatccagctgagccctgctgtgttgcccactgccgcaggtgcagggagggacttcctaacctgcatgacttttcctgaccctgtaaatttgatttggaaaaacaacaaaagcttctcaggttctttcaaagatgaaacagtttcttttttctttttttgtttttgttgttgttgagacagagtcagctctgttacccaggctagagtgcaatggcaccatcttggctcactgcaacctccatctgctgggttctagcgattctcatgcctccgccttctgagtagctgggattacaggtgggcaccaccatgcccggctaagttttatatttttagtacagacagggttttgccgtgttggccaggttggtcttgaactcctggcctcaaatagtctgcccgccttggcctcccaaagtgctgggattataggcatcagccacagtgcctggcccaaagtttctttcttttaaccagcaccttgggaagatcacccagacaaagtgcaaaataaagttctagagttaaaacctcagggctgtatttacagccaaacccttgtgataggaagcatatgtccagaaacacatcctaaatctcctttggaggcagggtagtgcagtggtataagaaagagcttgggaatctgactgcctacgtttctgcctgggtctcccacttggcagctctgaggccttgggaaaagcgcttctctctaagaatcatgtattgatacctgctgtctgggattatggttaggattaaatgaaatgatctggggagagtgcatggtgactagcactcagtaaatgacagttgctattagtattattagtttcatcatccttgatggacctgtcattaagtcacaaaatggactggtttggggtttggccaaggggtagagaggcagaggataggagagaagacaggagatgaggagagaggctgatagacagctggaggagtgtccttgggagttgcctatctcttgcccttgttttcacatcaccccacagcctgacattttctctgataccgaaggtcaaggagagctttggcccactttgctctgatgactgaagctggacctgtgactctgtcttttttttttttttggtctgctggaactggctgggtgcagcatcctggctgttcatccgccctgggcacccttttgtctgtgctactcagtttctgttgtgattctcaccacacagagagctcagaaacaatttgagtgactataagttagctcctttatggtcagaaataatccttccctgaggacaggcgcacggacacacttctgccttggaagttggagtgagagttgataggatggactggagatgaactgggaagagacttagagttcccttgtgggctaagatgagaaagtttgtacggctttttaaaaagtaatatttaatcacctgtttccttcatctcccccacctgtttggtatacaaatcatgagtggggctgggtgcagtggctcatgcctataacctcaatactttgggaggctgaggtggagaatcatttgagccccacaatttgagtccagcctgagaaacatagcaagaccctgtctctaaatctaaaaaataaataaataaaatataaataaaactcatggccgggcgcagtggctcatgcctgtaatcccaacactttgggaggctgaggtaggtggactggttgagcctaggagttcaagaccagcctagacaacttagtgagaccctgtctgtacaaaaaaaatacaaaaattagctgggcatgatggcatgcgcctgtagtcccacccacttgggaggctaaggcaggagaatcacttgagcccaggaggcaaaggttgcagtgagccaagatggcaccattgcactccagcctgggtgacaggagggaaaccctatctcaaaaaaatatatataatataataatgactactattctaggaatgagtcgagagctcccagtgtcttaccttaacctttcatttcttaacctttacctcttgcttcattcttccattctatctccttctcttccttaagaggcataaatataataatttatcattttctgtgtgtcatgtacatgatgttatttcgtttaaacatgtgacaggcctgtggggtactattattataaccctatgttagatgacataactaagatttagagaaaacttgcttaagtcaacagttagtaggtggacttgaaacccagatccttttaaccccaaagaccatgtttccataaattcttaccattttcagtgtgaagcatactttcacatgaggataaatatcattttcataaaaatgttgagtatcctcccaacaaaatccaattttatattctccttctgagaaataaaatggaagcaaggccttaaaaatcatctcattcagtttcccaccaatgtagtcatcccttctcctatagatatgacagatgattatagtttactattttcaaggcaattgatcttaaaattaattagaggattaattgttgaaaaaatcttatctttttttttctttgtatgtgaagaaaaatcttaggaaaatctaagctaaaaatctatcacctctaacttttacctgttaatcccagagcaacacttaggtgagcctactcttctctaagtcatgtccctttggacagaaaagtcacatatctcctaaatcttgtctctggcaggccaagtagcatccccaagtctctcagtggttgcaggtggacagtagtttctgggatcctcaccatctgtgtcaccattctcctttccctttcctcctccccaactgggtgatgtcaggaactaagctcactgtgccagaagtgtcctgggctcccataaggttatactggtgacactttgtagttattctgctttgaggctcagtctcttccacaattggaagaggagaactgaatcagtcatctctcactgcctaacagtctacccccaaacttagtggcttcagacagcaatcatttattagctcatgattctggggtttaacaatgtgggctgactaacctggcagattttctgctgatctagcctaggctcactcatatggctgtggttggctggtgacttggttggacactctcacccaccttttttttgttgttattttttgggagtctcactctgtcacccaggctggagtacagtggcatgatcacaatgcattgcagcctcaacctccaaggctcaagcaatcctcccaccttaacctcccgagtagctgggactagaggcacacaccaccatgcctggctaatcttcagatttcatcatagaggtggggtctcactatgttgcccaagctgatttcgaacacctgggctcaagtgatcctcctgccttggcctcccaaagtactgggattacaggcatgggccaccacacccagcctggctgggactcttggtcctagatgacctccttcatgtctggcagtgggcaggcttcagccagcgtgacaggggtgaccagcccacatgtctttcatccttcagcaggctagcttaggcttctccatatggtggttgggttctaacaagagtaagagaaggcaaaccttcatgaacttaataggcacttttcaagctgtagcacgaattgggccagatgcttttctagtccatgtgttcagaagagtcatagtttcctaaatctgtggctttaaattttttgacttgcaactagctgacatacaattttatattatgatggaggatacttcatatccaaccagaaacaaatgtttcacagtaacaaatgttactatgggtgattaactgtgatctcttctccttatatttattttgtgcctgcataaccttcagtttgagaaacactgtcctagatagtaaaacagtttctcattcttattgtttccggacttggttccttccggtgggttcttggtctcgctgacttcgagaatgaagccgcggaccctcacggtgagtgttacagttcttaaagatggtgtgttcagagtttgttccttcagatgttcagatgtgttcggagtttcttccttccagtgggttcgtggtctcgctgacttcaggagtgaagccacagaccttcccagtgagtgttacagctcttaaaggtggcgcgttcagagttgtttgttcctccaggtgggtttgtggtctcgcttacttcaggagtgaagccgcagacctctgtagtgagtgttacagctcataaaggtagtacagacccaaagagtgagcagcagcaagatttattgtgaagagcgaaagaacaaagcatccacggagtagaaggagacctgagccggttgccaccactggctggggtggccagcttctattcctttatttggccctgcccacaacctgctgattggtccgttttacagagtgctgattggtccattttacagagtgctgattgatgcattttatagagtgctgattggtgcatttacaatcctttagctagacacagagtgctgattggtgcatttacaatcctttagctagacacagagtgctgactggtgtgtttttccagagtactgattggtgcatttataatcctttagctagacacagagtgctgattggtgcatttttacagagtgctgattggtgcgtttacaatactttagctaggcagaaaagttctccaagtccccactggacccaagaagtccagctggcttcacctctcattatcattacagccagagtcacatgtatgtcctaagaaaactatatcctcatcatttggattttctctacccggtttttccagtgctgaagaaaggaagtggtttgcatgggttataggcaaaaaaagaaccaaagaatttgtgtttctccagtcctggaggaggaggagaactctaacctaatagccctaacactggccatctggacagaaatatccccaagctgaaattagtaattcatgtagctacctcagcttgatggaaatgtcttcaagcatctaaacccttttcgtgtacgttgaacttttttttttttttttttttttttttttttttttttttttttttttttgagacggagtctcgctctgttgcacaggttggagtgcagtggcacgatcttggctcactgcaacctccacctcccgggttcaagcaattctcctgcctcagcctccgagtagctgggactgcaggcatgtgccaccacgccaggctaatttttttgtatttttagtagagacggggtttcaccgtgttagccaggatggtctcgatctcctgacctcgtgatgtgcccgcctcggcctctcaaagtgctgggtttacagatgtgagccaccgtgcccggccaggttgaactttttaagttgggtttcttgagtggatccacccagtgagaggaagtgccttttgtagactgtactccatggttctccattgtgtgggtcgtctgttgaaattctgcatgtgcaaacactttgacaactgtaatatgttatataaatgttagaaatgattatggataaatttgcattatcacatataattaagtgaccatgcattcacatttgtcttcaactgtggtttatacttgtcccagtctaatttcagagcattctcaaaaggatcttgttttaaacaacaaatcttatggtaacctgcttaaaaggaactcttgtgagtttgagtaacatgattctgatcctcacaaccaggaccagcaatgatggcagataaatttcatctcaggcactgactctagttgattaatggtggctgcagagagttttgtgttgagaaggattctggggaagagagtagctttgccaggaaagggtgctgtgacctacgatagcaagctggggtggggattggggtggggactgacagcatctagcttggactgatttactactaccaattttactactactcatatttaaatttactactacttggactagttacttctaccaaaggagaacccatctgtgaggccttgactgacacagccagctcatgctcagctttggcccacagctgcacaaatgttagattcagtagtaaggactatcccggttaaccccttaagcactttatgtgttatctgagttaatcctcacagtatgaggtactgtattgtcatcatccttattttataataagtctgagcttacagaagttatgtaatgtgttctaagttacacagatactatgcagtagagtggttgaagttctctgccttcctgcccacttgaaatgtggctattcggactacatttaaatgttaactaattaaaatgtaaatactatgtgtagctacgtatgcagtggagctctacatacttattttctccttgctttttcatgtaactgtgtcttgaagccctttccatatctatacataaagaacatcttcattcttttttatacttgtataatattgctgggtataggtatgcttttgtttaatcagtttcctcttgatggatattctaagagttctgcagtgaatagccttatactgaaccatctgcatatatgttggtggaagccagaacaatacatgagaaataatttagtcatgatttcttatttcatttttcactttgtaataagcaagtatgaggaaggtggacagtaacattccagctgtagagggcctagaaacataagcagaaaagagatttgtttgttctggattacctagcatgtctggtgtagagctcaggtttgaaagctgagattttgcattgttgagactctggtggatgtttggaaatggttttcagtaattctcattatccaggaatgcgggcaggggtgtatagtctttcagttgttatgtcaacagagaccaagtgccaggtggctgttagaatttgcactgcatggttctttccattatcaatagatgggcttgcagaatgtatttatctaaaaagtttgtgctaggatgtagaatatgcttgtttgaagcaccatggacagtttggttctctgccatccttgcttaagactggtggtccttaaaggcaatttgagactgtgacttagacattctccaggaccctgtgtgttgttctcctgagtgggcaggtagattctcctgctacctatgtctttgattccgatctgaattaatcactgaccattcctccattcactcagatgaacattgttcccatggtgtgtggggttgatagcatggctgaccaggtcatggatagccatttttgtacaggctgacagaggtgtggtccatcccaaactgctcctacttggctgctctgaaaacatattgaagtaagtatcaactaaaatgagacttagggggcatctgtggatttcagttaaacctccatagcttctattttctggttggctaacaggccttgggacttgctgaaacttgtctgctttggattcggggtctgttaaaatatctaaatgggaatgatttaaaatcagaataaaaaaataaactaacacatgcctgtttgggaaaatttggaaaagataggcaagtatgaagaacacaataacatttgcttgtaaacttaccaacaagaaaggatgtattcatgcaacaaatgtttgttgtgcatctactatgtcaacacttcaatgtgcatgtgaatctcttggggattgtgttacagagcagattctgattcagcaggtctggggtagggcctgaggttcagcatttctaacacgctctcagggatatattcactgctggtccacgaactgcacttttaataggatctgaccataggctgggtcttatgcttgttcttgtgtgttttcttgccatcctttttaagtgtgtatgtttttttaattgtgacaaaatacacataacataaaatttaccaccttaaccatttttaagcatacggtttagtagggttaagaatgttcacattgttcgtattgaaaacaatgaaaatattgaaaagaattagatctccagaattcttttcatcttgcaaatctgaaactctatattcattaaacgacagttcctcaatccactctttccccagtccctggaaaccacgcttctactttctgtctctatgaatttgactactctaagtacctcatataagtagaattatacattatttatccttctgtgtctggcttatttcagttagcataatgtcttcaaggttcatccatgttgtaacgtatgtcagaatttcctttttaaggctggataatatcccattgcatgtgtagaccaccttttgcttatccatacatcagttgatggacacttgggttgcttccaccttttggcaattgtgaatagtgttgctatgaacatgggtgtacaaatacctctttgagaccctgctttcaattctttggggtatatacccagaaacagaattgcttgatcatatgttagttctatttttaattctttgagggactgccatttggttttccacagtggctgcagtattttacaaatctacaaacagtatacaagggtcctgatttctctgcatccttaccaacacttattattttctgtgtttttgatagtagccatctaagtggatctgaggtggtattatttattaattgcacacttgcaatcatatggtatgtacaattttacatcctttttgttaaatgtaacattctatcataagcattttcccctacagtttgaattttgatagaaagccttttcagtctccttcctctttgaagtgaagttgttcatattgatcttttttcctttgtggtttctttctttgattttaagcttagaaagcttccctatgtagagatcaaataacattcgccaagttgaatctatttttaaaatacttcatttttaacatttgcatctaatactctggcatttggttgttctttaaaagccctttgactgcaaagaattacgcaaaatgttaatagtggttctccctgggtggtgagattattcataatttttttcatgtattgctcttatgagtgaaaaagtacatgttatttaaaccacaaaggaccacgcttttgcccatggaaccagcccgggtcagctctggaagagatgggggcatggaatgtggagaatctagctgatggtgtattcttcctggacctccgcttcctccatagtaaaaagaaggatggactgtagggtcctttctggcctcaaagaaattcatcaggtttttaggcccaacttgatagtgtcaacctaaaataatcaaaaaggtcagaatctagtttaaagagagtttaattaagtgcgaaggttaaaagtgagcctgccggccggacacagtggctcacaactgtaatcccagcactttgggaggccgaggcaggcggatcacaaagagatcaagaccatgccagccaacatggtgaaaccctgtctctactaaaaatacaaaatttagttgggtgtggtggcgcgtgcctgtagtcccagctactggggagcctgaggcaggagaatcgcttgaacccaggagacggaggttgcagtgagtcaagatcgcaccactgtactccagcctggcgacagagtgagactctgtctcaaaaaaaacaaaaaacaaacaaacaaacaaaaacaagtgagcctgcccagaaagaacagattccaagaaatttgacagtgttcatatagaaaaagttcagggaaatttaataggatttcagcatgtttctatgtaaggcttaatgcatagttacaatgatctgattagtcaaggtggtctttctgagtggtgggggaggtatatttaacattccacacagcagatgtaaccatcattgggtcttggactgacgctatctggtgcgagttaggtacaggacaatgaaggaggcagttaatgtacaacaaagatcagcaattagaagcgggaagatctggtctctcctagtcatttacaatgaggaagtcaagaacagtggggaagagagtgaagcagaattgcaagcatgcaagttatacataacccagtctccaagccctaacttcccccttggcataataaatttagagggttctgaaatttttatttttatttaaaaacaggcgtccattccttggctgaagtagtacctccccagcctaattaaatactacacctttttagagagaaaggggtgagaaggctgtggacagagtgaatggcaaagggttagctggggctggaggcggggagggcattgccaagctgggggttaggacctcctgcaggcgggtgtccatccagctgggactcagggccgtagagcagaagggttaaaagggatactgtgggtaaggtatttgaaacagtgcctgacacctggtacgcaccaaattagtgctgtttttgcccaccccgtcccttccttgcctcttgcccctgccacgccattttctccaccttccctccctcctctttttctcctcccttagtctccctgatcctttccatttctcttgcactgtctcctcttctctccttcccttaacctgtctcctcttccttcttttctctcctctctggatgtgttggttctagataaaatctgtgcctattgttggccatgccacctgctatgagtgagctttgccccaggggccttactgctgccgggaaggtacccagcctcctccccgggtaaggcccactaagcctcagagctccgccctggctaggctttctttatatatatatttctctctatatatatttctctctatatatatttctctctatatatatttctctctatatatatttctctctatatatatttctatgtatatatttctatatatatatttctatgtatatatttctatatatatatttctatatatatatttctatatatatttctatatatattatatatatttctatatatataatatatatatttctatatatatttctatgtgtatatttctatatatatatttatatatatatttctacatatatttctatatatatatttctatatatatatttctatatatatatatttctatatatatatatattttttttaggcagagttttgctcttttgccgaggctggagtgcagtggtgtgatttcagctcaccgcaacctctgcctcccagtttcaagtgagtctctgtcctcagcctcctgaggagctgggattacaggcacgcgccaccacgcccggctaatttttgtatttttagcagagacggtgttttaccatgttggtcaggctggtcttgaactcctgacctcgtgatctgcccgccttggcctcccaaagtgctgggattacaggcgtgagccaccgtgcgcagcagcacagttacatttttttctgtgcttgttgaaacagcgtcagtctctgtttaccagtctccaagctccatgaggatggggacttgtctgcgttcattcccttgtgtcccttgcacccagcatggtgtctgaaattaatgggtgctcaataaatattttcaataaaagactctacactacaatagggcaaatatgaattagcagcaagtgcaggctttggagacactcagatctgggtttgaattgctaaccgtagatggacagcatgacttaggcaattcatttatgctctttgggcctcaatttcatcatctgtaaaatggggataatgtgcacctctcttatgggctgtaataaagattttttaaatgaaatcttatatgaagtacccatctactcaagttccttttaaattttatttgcatagcattacaggacttgtgaaatagtgtatactttaaggcctaagacttaagacaattcattatttcatgggtaatagaattttatacatctatgtaaagacccaggactggccatcagcagacctgagtcctccaagttctgccttagctagtttttgacctttgctccgggggccttccttctgcctggaaggctccccaacctcctccccaggtaagacccacctggaggccatacctggtcgtaggatgcaaggtgaacatgactgagtctcatgcatcttaatctgcaagatgaagagtttgggtagggttaaacacatcatgcaggcagcacccttatggctttggctctatctgcttcatagctatagtattatttgattgctattctttctttaaaagtttatttttattcatttattttttggagacagggttgtgtgccattacccaggctggattgcggtggtatgatcatggcttactgcagccttgacctcctgggctcaactgatcctctcgcttcagcctcctgagtcgctaggactacaggtgcagccgccatgcccagctaattttttattttttgtagagacaggatctcagtatgttgcccaagctgtctcaaactcctgggctcaagaaatgctccctccttagcctcccagtgtgctgagattccaggtggaagccactgtgtccagcctaaatgtttactttaaaagacaacttcataccactatagtaaatatcacaagtagaaggtaacaacaacaaaacccagtagaatgaaaacaagacagtgttataaaattcttgccagatattactacctgccaaggctcagagtctgaggcctcttcagactttgtgaagaagggaaattagcacatgctggagagatggtaaccacttaatggcactgcagcgagacattctgcactcgctcaggaccatgagagttgaaaagggcatgagtgattcagtgtcatttggtttcgtgtgtatccctagtacccatttctcactttgggaagcactggattcgatcatagacctggaaggaaccttaaagattacctgacccccccatcattttgtagatggatgagctgagcctgatgtggaggtggctgctcgtgcccttgacccagccatgtgaagacctgtgccctcgattctcaaaatgcgggagtcgaaagacagacagacagatagatagatagatagatatgcaggagttgaaaaataggcaggcaggtagatagacagagagatagatatgcaggaattgaaagatagatagatagatagatagatagatagatagatagatagatagatagacagacagataagacccatgcctgactatgcttgtgtagtgttacagaaagcagctgagacatggagagtgccagcagtgtggccgcaggtccccaactatgacctgttcacatgcaaaccacctttgtggactgtagtcagtacttttattttaagctcagctctaatatatctatgtacatttttggactggccttctgttggccagtcacatttctttctttctttctttcttttttcccagacagagtcttcctctgtagcccaagctggaatacagtggcatgatctcggctcactgcaacctccgcctcctgagttcaagcgattctcctgcctcagcctcttgagtagctgggactacaggcgcacgccaccatgctcagctaattttttgtatttttagtagagacagggtttcaccatgttggccaggatggtctcaatctcctgaccttgtgatccacccgcctcggcctcccaaagtgctgggattacaggcgtgagccaccacccccggcccatttctttagaacagggtgtgccacttataagtagactctgttcccttcaaaaccctctggctcctccaaaacactttccttgctctatttcatccacaagaaaaatgaaactgctctttcacattggtcagaagaggtaacacttgggacaaatgcatctagtaccattccagaggcacaaaggaattttgggtgcgggttatactttttgattttttataaaccacacagataaaagtggacaacagagaaaatattgagttcaacatggagattgggctgggcgcagtggctcatgcctgtaatcctaacaccttgggaggccaaggtgggaggatcgtttgagcccaggagttcaagactagcctgggcaacatagagagatttcatctctacaaaaactttttaaaaaattagctgggcgtggtggcacacatgtagtccagctactcgaggggccagggatgattcccttgagcctgggaggtcaaggctgcagtgagccatgattgcaccactgcactccagcctggaggacagagcaagacattgtctcaaacaaacaaacagagagagtatgccaaagggggttaaaacaaaataaaatatagtgttttaagtcctggtcctcctcctccatgccctgcctccccgccacccttgccaaaaaaattactgtataaattatatatagagaacaaaactaggccttaaggtactaggatcattttgttcctctccatatgtgaatttaattccacagtccttccttcagcactgaacactaccgcagcccccaatccctcccaccacattgccaatccctgggtggcaaatccaacagcttggccaacaattcacttggagtggcctctagttgtgtcaaagatgctgtatttatgcatctatcagcttttgctgcaacacagcccactctcccctaactcagctgcttaaaataacaagcatttatgattgcttatgagttatggatcagctggtcaggctcactcatgtgtctgcagttagctgagtatttgggtggaaagcactgctgtgtctgctcttcccagccctgatttgcgaagctttttttgcttctcagcggggtttggtcttcctgagcaccatccttatgtcttctccctgcaccctgggttgggctgtccattatggttctcttaatagaaggttgagcctgggagacttgtcatggatcaacatgtattgcagttggttcctttgtattgaagtccactgcagtttacccttctaaccacatctgcttccactttcttccacctcttaccacacacagcatcatgaatgccttttagctatttatctctctgagcgggtggtaagcttttgagagcaaataacacattgcctttcccctgctgtattaccaccatctggcccaatgcattacgcatagtaggtgctcagtaaatatttgatgactgagataaatgagtgaatgactgaaattattgatgaaaccaggaatgaggtagaatgaggtcttgatgaccccccaagagtaaaataactggaattccccttattaattttttatcctgtcactttaagccccattgaatcccaaaggatgtacagacatggtctggagggcttagttcttaatggtaccaatgtttgtttaaattttcctaactctaggcaggtgtggtggcatgtgcctgtagtcccagccactcaggaggctgagttggaaggatcacctgagcccaggaggtcgaggctgcagtgaattgtgactgtgccactgcactccagcctgggtgacagagtgagatcctgtatcaataaattaaataaataaataaatacataaataaataaatattcccaactcattgcagcagatactacaggtttgcttctggttgcaaatgtttggcttccccaagaggcagctgtaaaggggaaagcaagtgtattccagtaagatcatggggagggattcctggttctgatttatttttccacttggtttactagacttagattcctggtgtctcatagtccctcgtcagttgatgctcagtcccccagaaccatacttgttctctatgaccttgtgaaagttacttgatgccagggaacactgtgaaccacagcctttatcttcctgtgagtacgtgagcagctgtttccaagattagaataaaggtggtagtgatggtgggagattcctggcctcccttctacaaagtgtcagtaggagaattagattaatgggtatttttctaataacctgtcctgctggcatagaataagaatttcacaggtacagctgcatagccttgatatctacagctattcttttgtgagggaggagggcatcagaattctaatcattgtgcagagcagtggctctcagccctggctgcacatcaagtcatcagggagctttaaaaagtacagatgcctgatcccaccacagaagtgccagttccgttggcctggggtgtggtctgggactcaggatttttaaatctcccgggtaactctgtgtgcagccaaagttgagaaccactggttcagtttatcccttctatgtcaggaaagggacaatatttataatctgttagaattacttgaaattttatggttgttaaagcatacaggtttatatgctgggatgtattatatttgggttagaataacagattcatccagggatgaaaataaatgtctccaacatgttctgcatccacttggccgcccccgccttttgttgtcaccccctactccatctcatcaatttgtcttgagaataattgtgagaaaaagtagcaactgccctaacacatgaatttgcaagatgctctttactgcgttctctcatttgctcctcacgccaggaaggtcatctaagaaacaaactgtttctcagttgaaagtccagaggggaaagctgacaggctcagctaggatcaagtgcccaccatggccccatcagcagcttctgtgagatggacacaggtgcctggtccaacctcctctgctgcggcaaccacgtgcagacctgcactgctgtcgggaggacagatgttaacaaatcagggtcattcttgtcccctgtaggaaagcctgtgggagactgagccgtcactagaacatgtttgctaaatagagatgcagagaaaagggagcttgggggccagaggccggcttggttgcagggcggagggagtgcaaagtactcaacaactgggccctgcgctctccctttgctcctcttctggaatccagtcaggttcttgtctttcctttgtgattctgctttgcacctgttgcagttcatcaagacacagtttatcttaccacaggtacatctcaatatcctttcaagaccttctagggtcattttcatgctttggggtggatttctcttctgcctgtgacgttgtcttccaagataggttgattcttactagtttcaaggggtggtgcattttgaccttaagccaaattctggtgctttcccagtcacaggcggtggtattccatgtgaaaacaactaagtttcaaatggcttggggctgatacacgtcacatcttgagtaggctcagtgtttgaatcagaatcaaaacacaagtcttctgaattttaatcaaacgctttttctctcccgcccaagtgagtttatgtttttcttttccacgatttcttttgtaggggttcagctgttgcaaaaataattggtaataatgtcaagaaacttcagaaatttgcctccacagtcaagatgtgggtctttgaagaaacagtgaatggcagaaaactgacagacatcataaataatgaccatgaaaatgtaaaatatcttcctggacacaagctgccagaaaatgtggtaagactttggggtgaaatgtacattggttcattctgcaagttgtgcttggctgagcagcacttgggttttggaactgggaaagctgcttcccttttccccagttcctttccactaccaattggttggttggttttggtcttcctgactctgaaaatgggtttcctattatgttgctaaggatgccttaacaaagtgccagactgggtaccttaaacaacagaaatttatcttttataattctagaggttttgagcatgagatcagggtgttgatagggttaatttcttctgaggcctctctccttggcttatagatagcatcttctgtattttcacatggtcttccctctaatcctgtctctgtcataatctcctcttataaagatagcagtcatattggataaagacccaccccaatgacttaagttaattacctcttttaagacactgtttccagatacagtcacattctgaggtacagcccataacaggtttcctccttggcattcaaagtgccagccacctctggaactaacaaacttgccttaggctgctcctgctccccaagtagctcctgctgtaccctaagtgcatgagatcagcttgctaggacagctaatacaatggtctgtaattaaagtcagggtcaaggcctaaattacagaaggagatagaagaaaatgggaaaatgtaagactgacagtttaaattcaagcttattaagtctgggagagaaaaatacaggttattgcctgacctccttctattgacttgcaggggaagaaagaaatgagcttggggagtgaaaagggtgtaccctgctgcttgtctgagtggaatttatgaacttcttctgttgtcagattcacccctttgtggctttctatcataatctctttgaaaaacagacagttgtggctgtctgattcctatggttaacccaagaagctcatctcctttgttaacgaaataccctttactgcatatattcactcaccaaaccttatgagcatgcactgtgcatgcaaagcaccgtgttgggtgctggggacagaaagaggaataagacagtgttgctttcctcaaggaactgagcgggggagaccgatctctaaatcaataaatgtggggaagttttagttacagtgttcgttagtgtcaagcactgtgctaagcaatacatttagtctcatttaatcctctcaataaccctcttaggctgatactactggttttcctattagggtgattattttgattatatagtggaggaaaccaagactcaaagaggctaatgaacttgtccagggtcacacagctgagggctacggttcagattgattcctggtggacgcatccctgagcatgccgaatctgttgccttctagacagtgatgactttctgctctggacttgggtgagccagcatttccctacagttattcttggtgtagttggtgggggaagaagaacctttagagttgtgagcttagaagttaagttgtccaaatatctgctggagagaataaaagaggtagctcttccccctgcaatggaaggcctgtggggtcatctctaatccattcttggggcagatcattcttttgagcttcacttttctcatttttatcagaattggttgccccttccctttggtaaactacatgcttcattgttacattcctcccaccctgcctggcgccagtcccttgtgtacctgtctgtctacctccacgtgccctcagtgtgtgaccttgctttctggttcttcattcacccacagtccctagcacagtgcttttcctacagtggatatttgaggaatgttgggggaagtgaatctgctgagtggttctgtgaagctggagcctgtgctgcgaacagggagagtgggagggaaggaatcgacatagaggagttgagagagcctgccccccacttgactgactccaccacccacccctggtcactgggtgtggacagaggcaggagaattcactcccagaaccctgttgttgtctgatagatctctcaaacctattcttcctgtttaagtgaaatttttgaccaatatgtccccagtccctcaccctccagcctcaggtagccacctaaaagtacagtttttaatcattgtttttctttccaattcaagcaggagaggtttgttgcatttccgtcaacacaagctcactgtttatgctgtcatttgatgtgctgacttcagactgagccttttctgtgtgagaccctcaaactgctgccaacgtgacccttccccaggtccacactcatcatgtggcccctcccacataggagccttctgttacagtgacttcaccatgtcattgcctgctcactaaaagctgagcccgtctggatttgcgatttccctttagatccgaatgaaaagaatgctcattattttctgaaggccggttgcggtggctcacacctgtaatcccagcactttgggaccgagcgcagtggctcatgcctgtaatcccagcactttgggaggctgaggggggcggatcacttgaggtcaggagctcgagaccaccctggccaacatggcaaaacctcatctctactaaaaaaagaaaaattagccgggtgtagtggtgcacacctgtaatcccggctatactcgggaggctgaggcaggagaattgcctgaacccaggaggcggaagttgcagtgagacgagattgccccgctgcactccagcctgggcaacagagcaagactccatctaaaaaaaaaatagaatgctccgtttaaaaaaaaaaagaatgctcattattttctgtaattgcaaaatggttgatcctgttttctagctctatttccagagcctgtgtttggagctcatcaaggtagaggattcttttgcttccctgttccagcttcagccagtgacaccaggatttagattccagcacccccatgaaatatagttgccgttgcctctcatctcctgcctcctttttaaaaaactgcttcactgagatataatccacagaccatacaattcagtggcttttttcgtatatttacatagctgtgcagccatcactgccatcaattttaacacattttcatcaccttgaaaagaaacttgtaccctttcatagtcacctcctgttttccccagttgtcccacagccctaggtgactactaatctactttctatctctatagatttacctgttctccatatttcatgtaaattgcgtcttacaatatgcggtcttctgtgactggcttctttcactttgcataatgctgtgaagctccatccatgttgtagcatgtatcaatacttcgttcctttttatggctgaatacgatcctgttgtatggatgtcccacattttgtttacccattcattggttgatggtcatttgagctgtttccactctttgggtattatgaataatacctttatgtacaatgtgaacctttatatacaatgttttgtatgaacatatgttttcatttcttttgtgtgtatacctaggagtagagttaactttttgaggaactgccagactgttttacaaagtggctgtaccattttacattcctatcaacagtgtgtgaatgttccagtttcttcacattctcaccagtgcttgctgttatctgactttttaatcctagcgagtatctcattcatggttttgattttcatttgcctgatggctaaccatgttgagcatcttgtgcttattgtcacttgtatatctttggagaaatgtgtattcaaatcctttgtccatttaaaaaatggattgtctttttattattgagttatacaaattctttatatattctagatacaggtcccctttctccacaagtattttctcctgttctgtgggttttctttttacttgcttgatggtatcctttgaagcacaaaagtttttaattatgaagtccaatgtttacctttttactctgctgtgaactctttgagtatagtttcttgcataggtctttattcactaatgtctcctcagcacctggaatagtgcctggcattatttgtggtttgaataaatgccaaggatagtggaagtggtgaggaagaacaaaccaggatgaagagttttgtttcagtgctttttaggtggtatcacatgggaaataagtttagggcaagacttaaaaaaaaattaatcatttacatttggatactagggttggggtaatacctattaatttttgctgaaagccttctgaaaattaaaatatcagttcagtgcgaagcctcagtgttactcctttcctccctgggtttaactctttgatttcattagaggagtagttttccctggtgatcttcaaattttagtgttcatcagatcactgggagagcttcccagggatatgtgggcccactcctatagtttctgattcagtaggtttcaggtgcggtccctgaatgtgcatttctcacaagttcccaggtaatggggatgctgttggttcaggagccatgctttgggaaccatgggggtacataataaattgatattattggtgttgtactggggaatccaggcgatggatagctatttttccagaagtagccttacttaccagcagtggcatgtttacataagaatcatcagataaggtcctctgtctgagggtcatgtttctgcatgtagagccaagtatgtgaatttcacctgagatcttggctgcaagtgagatgaagagacagaggaaaattacgctatttttgagcctctactatgtcccaagtatgacactgctatgtgttttactcctggtattgtcttgaatctgagtacacacatcccccagataatgtaggtgagttgccatggtgtccggttagctgactggcattagagcccggccacgatgctccgtgcagccacggcagctggaccgttgttaaaccacaccattctcattaggaaccagaattgtttcagcatgtagattcatacagacttgaagtagacataactagtggccctaagagattagataaaaatgagaacagccttggtatcttttatttggcttatccttgttttatctgtcattactatgatgttgctacaaaaaggtttgtagtaagattcatggattttagggggaaaagtcttcatttgaataacaggaaaattcttataatactatattaaaaagatataaaatattactttaattctataaatacaattttagacattgctgtaggctcgaaaagaccttggaaggagtgtaccaaaatattgatagtgattatttctgggaacagcagggagaagctgttcttattttcctacttagagattttttcttcagatttgatccagcgagcctatttatagtcatgaatgaatggagaaagcattttagtcctaattggttttaaagaccataaaatagcatctttggagggtgaggagatcagtctgtgatgatgaaagtgaggtctttttcttgcccactctgatggctgcagataagatgttgctaacaggtaaaagctcattgagcacacactgtggacagtgatggtggatccaggaagtacgaaagaaccttcagacttgtccacacagacttcaccagctttgtttccaatggtttttatttattattaggtttttattaacttagactaagagcactgggctcctgaaagtctgggcattaagcaaaccagccctgatgccttcgttctgggttgtttgtcctacttgccattgaaaggcaagacctgttgttctgagttttgcttcccagcatatttcagaatctggaacgatggacaccttcagagttttggcaggaggctcacaaaatcagtcaccatttccaaagcagctcctgattattttcagagcagaaaatcgggtaggggcttagcaaaaggttttattctgaaagatgagattcacatgatctcattagctgataagaacttgttctgatacggtgtaagaggaataatgttctgtgaatggaccatgcacaccataaaaatacagctcacattgtacacgttgcttctgtgggttaaaccctaagtattccaccaaggagaataagccccaaccacattgtcctagagaccatcacattccctaccacctgcaggttcctctttgatttattaagaaggaaatgtaagagacagaagaaatcctggccagctagcagattccttgagaatggtttgtttgtttgcttgtgacagggcctcactctgtccccaaggctggagtacagtggtgcaatcacaactttttgcagcctcgacctcctgggctcaagtgatcctcccacctcaacttcccaagtagctgggaccacaggcactcgccaccacacctggttaattttttttattttttgtaaagatgaagtcgcactgtgttgcttaggctggtcttgagctcctgggctcaagcagtcctcccacctcagcctcccaaaagtgttgggattatggcatgagccactgagcctggctggggatgtattttagcaagagacatgggaataggccgatttcttaaaagttaaggatttgcaagacacgggtagatttttctgatgaatacgctttcatttgttaaggtctttgtagtttcaaaacattgccactcatattacttaattggaaagggttctgtgaggtagccagatcggaaaggtaatttttatctctattttacatatggagtgactgaggtcgatgaagctgagtagcttgccagaggtcacacagctggtcagttgcagatgtgcaacccagaccttcaaacctatattttttctctttggttctggtgttttttccacttcaccatgttgaaaatgccccaaagggggaaagggaggaatgtgtatgtgttagaggtggatggggaagaggagaaacagtaggtccagaggaataggttttaattaaaagtcaggcggccaggctccatatgaaccagggagtagggtgcataaatgcccatctgagcaaggccagtgttgaaggggaaggagtgatcggagttcttgtgaaggccgtgggaagatgggtgggacacaggcaaacacatgagaacaaaacaatgagctttgccaataaacgacacacaggccaattgtgggttggcatcgagagggttgtttttttgtttgttttgttttgttttttttgagacagagtcttgctctgtcgcccaggctggagtgcagtggcacgatcttggctcactgcaacctccccatcccaggttcaagtgattctcatgcctcagcctcctaagtagctgggattacaggtgtgcaccaccacacctggctaatttttatatttttagtagagatggggttttgccatgttggccaggctggtttcaaactcttggcctcaagcgatccacccacctcagcctccccaagtgctgggattattacaggcatgagcatggcgcccagccttcatcgggagattaatgcaatagaatcagaaaatgctttgttggagggggtggagtctccaggtgggagaggaataatgtagcaggtggatttttttaataaatcttcaccacttgtggactacctagcctagattaccaatctggagaagccctttcaagaggaaaataggcaaataggccttccctgcctttggatctgccactaacggtggagaagtgctgagctttgggttttgatctgctctatggggagtgactctaggttgtcattcaaatcagcttaaagctaaatgttttggctcttgtaactaaagatccaggcagtgctggcttcaggtgtagcctgaaccagcaggttacatgatattaacagggccctgtttttccctctgttcccctgctttgccatccgcaaagttggcttcatccacatggtagccccgtggcgtaggttctcccctcacatttgtaaacatggttgcagtagttccagacttcacagcagcatcccacactgttcaaggaaagacattgttcaggctactcctgaagaataaggaagcatctgtttcccagaagacatctactggtttcttgttggctctgattgtttaatgtgcccattagcttgaacaagttaagaaccacccctgaaatggggtaggggccaattccacccaaatggcatggataaaatggggaagttgtagcttttgaaaggaagtttaaggaaacttctagaaagaaggggaatggaggctaggcaataaattatggaagtcctccacacctcctgaagggataagggaattaaacttcagatacattttctttggggaatcctttgtgtgagggagtaactcttagcacaggcattagtcaaggtaataggctaagatactgcaaaagacataataatgtgacaaagaacaagagacttgtcttcctctcacatagaaatactccagtggtttgctttacactattattcttggtcccatgttttttgtttttttttcccctgtaccatctcctaagccttgtaaccctcagtgtgatcaaggctaagttaccaaggttttcagctcacagaaagggggaagagaaagtgtagaggaggcaacccactgtcttgagggctctgggctgtcagtggaaaccacttctccctctcacatccaacaatgagaacttggtccatggccatgtgtagctgcaaggactgctgggaaacacagtccctggctagatgactagcgaccagcttacaggtctgtgattatagagaaaggggagaaggaattttggctgggagttggcaatctccatcacaacccccaaactaggtttcctcagaggctggcccattccgaatgatgttcctgtgacagacacgatttcctcagagaagaatcttcatccaaggcctttcattttgggaaccaggaatgcttaatggggactaagtcagttatagttaggtttaaatacatatgacagaaaacctaaaataacagtggtctaagcaaggtaaatgtttgtgcatttttctctaatgtaaagacatttgtggttggtgtagcatcatggtggcagagacttgtttgattccactgttctgccatctcggcatgtgctgtcctccttctgctctaagatgactgtctgaatttccgccatgccttcacattcccactggcaaaaggaaggagaaggaccttccaggacattttctagaagtcacaggcagcacttccattgatgctcccttgatcagaactcagtcacatggtacacgtagctgcaaggagcacagggaaacatagccttctttgctggcattcaggagcccagcttgaaactaggggttctaatgctgaggaataaggaagaacagatactaggtgcagcaagaagcctttgccagagaccatgtgccctggagtccgcacggcatgccttcacttctgccgtgttaaactaatcttcacccttaaggaaagaaatcgtcataatagctgacatgtgttgagtgtatatcaagtcccaggcagttttctatatcatttagtcctcacagtggcactctcaaaggagagtttagtgtgggatcatttacagaggggccatggggtcgagggaatcaacaggggttggtgaagtgctcggagattagcaacagcaggaagccattaccacccctaaaagggtcagggaaagaacatgtcaccagcctgaagagggcttagagacatggccttagaaaggggctgcctggcagcagggacagctgtggaatgaagccaagccagaaacactgtgagcctaggcagaagtggcccgaggaggctgataaatacccttgacctgtctctcctcccatcctttgatctcctgacaatgcctcccattggctgaagcccactggaagccagagaacaagggagcctggggaaatagtttagagaaagcagcctcctgagaacagaatggggcagagaagagcggaaaatggatgagggggctggtgaggtgggagagcaacagagagcaacccacatagtgttattagaggtgccttttgcagataaggcagttgaggggtggagaggataactcacctgcccagctggtgacagaggcaaaccctctgcttcagacccccataaggaataaggaaggcaaagcaaacacacttgccttccttgtctatctgtgcaatgctctgcacatagtaggcatctgataaatggtcagtgagtgaaaccttgtggacaggcaaggtttgatataagaggagaaacggtcttctctgccttttggttgcaggttgccatgtcaaatcttagcgaggctgtgcaggatgcagacctgctggtgtttgtcattccccaccagttcattcacagaatctgtgatgagatcactgggagagtgcccaagaaagcgctgggaatcaccctcatcaaggtaactcgagtgcatgctgcccagggctagacattggttatcaggaaatttcatttcctcacactttcatctgcttgagatttggagctgaaggggaagttgtggcggtttttcgtttgtgttcttaaagatgctcaaaagtcataaaaaaaataagactagtttagctcagattgagagtgggctgctttccattgcagcagactagcagcagcagtgatgtgaagagctgtgccgccccttccagtccactctcggggctcagcctgccatctggaaagcaccagcagtttgaattagctgggaaattaataaccattagtgcccattcttggatatataccctaaagcatgtgtttttaaccagaactccatgaaccacctctgaaggtccacaggttgaatacaggaagttcatgcatttaaatgtggtggaaaaaaatccttgcattctaactcattttaacctctaagtgaaatgagcattctcttcatttatgaatgcagctcacagccaaagtttcagtaatagcagtattagcaggatctgagaccttgtcaataggagtcgcagggctttcatttcagtttacacctttttctgatatctcaaggtatcatttatactcatcactacttggaaattgtggtaattgttagacctgccatgatatctttttctaattgcattaataaaacagtgcatatattactttatcataaatttgttttttaaacaaatttcaacataattggattcctgggttattttaggtgttttgttttatgcatatgaaattctgagaatgagtccataaacttcaccagactaccaggggtaaggcccatgtcgttggaaagattaagaactcccaagagaggctgtgccagagcatttacagatgaatgttcatgaaggcaaaccagagcaacccaaatgtcatcagcaagagagtagacaaatgaaatgtgaactattcattttggaatactgtgcagtaagtgaacagaaacgaaccagaagtttgatgcagccacatgagtgaatctctaaaacggtattgtagttcaagacagcacatcacaggtgaatggcacaactctctttatagacttgaaaccccagggataatgacgtataacattgtctagggaccatccgatgtggtaaaatagtcaagaaaagcaagggagcaatgcatacagcattcaggacagtggttcaccctggggagcaggggtagaaggaggatgaacttgagaggagacacacaggggacttcagtggtgtcagtcacgttctatttcttaacacgagtgatgagtacatgtttattttcttcatttgattcttctttaagctgtacataggcagtatagatgcttttactcttgtaagtaggagacatttttcaagttgtgtagccatgggacatctactatcccatgcctctttgatttggcggtttgttctctcctaacttcttggcatccttgtagggcatagacgagggccccgaggggctgaagctcatttctgacatcatccgtgagaagatgggtattgacatcagtgtgctgatgggagccaacattgccaatgaggtggctgcagagaagttctgtgagaccaccatcggtaagcactgcctgggagggaccccaggagtctggacatttgatgtttgaacatgtacatattccatttctgatattttctgtaatagactcttccctgtccctcttaacattccttagttgggcattcagtggggcgagggttttacttaaggaggctattttgtggaactgaagtgtttcaacaacctccagaatgaatataaatgaatatagccaagaagagcattctgacttgctgtgatccaataatgaattactgaggttaaacacaaaagtgcaaggttgcttgtaccaagaaacaggtggctacatccatggtaggggtcccctggcctcagaagcccaaattttcttttcttacaaatgttagtatctggatcctcattgattccagtgagatctaaaaattggttgaatgacccccattttcaggtgaatgataagactcagagaataaattacctgccccaagatcacacactaatgtagaagccaggaacaaatttgagtcttctgtttcctgaactagtaagccttttctactcttacacattatacattagatacattattctcacattgacgttatgaaaattttcatttcttttgaaaggggctttgagaattctcaagtgtccgtgtactatattaaacgatgctttgttggaagagtaatattattgtattttcagatgctttgcaaaagtttatctaccactgcagaacttactttcacccttatcaaacctgcaagcaatatgaatcatttccccttggcagctttgtaaaaggaagctctgagagatgtcaggctctcttgcatgagatgaatgcgcaggaaaatgtagctccagattcttatacctgcctatacgtaggactttttaggatttttttggaattttctaccttaatttttatttttaattatggaggtattttacatgattattatggaagatagagataatcaaaagaaagccattttaaatttttgataattttgttatatatccttttttactatttgtatgaactattatgtttgtagtgaatcatatgctgtttaataattgctttattcgctgaatatgtaacaaaaacctttcagagtctgttaacatactgtacatcctcataactgcatagcattccatcagcaattccatatatttggatacaaaacttttttttgaaaaataatatttgttggagaggagaagtatcacaaataatacaaagaagaaaagaatagcctatgataccacctgcccaggttgtcatttacgaaagtgatacagacacaggtttaaaaaaaaattcaagcaccatgagaaggtggaaaagtagaactaagattgtaatttcccacccatttccctcttcccagagggaatcactgttagcagtttcttttttgttttttataattgcaacttttattttagattcgggggtacatgtgcaggtttgttacatgggtgtattgcatgatgctgaggtctgggttatgactaatcctgtcacccaggtagtgagcatagtaccccacaggtagtttttcaatccttccctcctttctctcctctctagtagtccccagtatctgttgttgctatctttatgttcatgggtacccaatgtttagccctcacttgtaagtgagaacatgcagtatttggttttctgttcctatgttaactcacttaggataatggcttccagctgcatccatgctgcaaaggacatgattttctttttttttttttgagatggagtctcaccctgtcgccaggcttgagcgcagtggtgctatcttggctcactgcaacctccaattccctggttcaagcgattctcctgcctcagcctcccaagtagctggaattacaggcatgcgccaccacgcccagctaatttttgtatttttggtagagacagggtttcaccatgttggccaggatggtcttgatctcctgacctcatgatccacctgcctcaacctcccaaagtgctgggattacagatgtgagccaccgcgcccggctgatttcattcttttttaatggcttttactattagcagtttctaaatattcttctggaaaaaatttatttatatttgtatgctagtatgtacatatatgaatatgtcttattcttttacagtaaattcttttatttatctgcagttttaatatagcctgtgaaattgttatgtaattacttatattttcccaaaaagattaactagtttgttccaactcaatcctatttgccaataatcctttcccagttcattctggaagactaaatcttaatctgcaatcccaatccctgatccaatcctggctaggactctagccctgtttgttgtaggaaagtttctagttgggtacattaggcttttttggttttaaaaaacagataaaagcacataagttgcatttctttccctctggcatttctttacccggtgcttctatgccttctctgtggggtggagtgtgataagcactgatgacctgaattaaattaagtaaagcatttctgggtggagtagctctcgtgaggctaaagccgaggatcttctgaggccaagagtttgaaatcaccctgggaaatgtagctgggagtttccaaaaaagaaaaaaaaaaattttttaattagcctggtatggtagtacatacctgtagtcccagctactcaggagactgctgtgggaggatcaccttgaggctaggagattgagcgaggctgtagtcactgcagtggctatgatcacgtcattgcactcctgcctgggtgacagcaataccctgtctctttaaaaaaaaaaaatttaagtaaaacattgaaagtaagatagaatatgaaagtgatgtttaaaaattgttttatataacctgaattaattaatttttaaaagtagagtcttgttcgaattcctggcctcatgggatcctcctgcctcagcctgctgatgtaccgggattacaggtgcgagccactgtgcccagcctataacctgaatttaatcatgagaaaatatcagacaagcccaaagtaagagatatgttataaaacaacaggccaatggtatctttgactcttcaaaaaagtcagtgtcatgaaagacaatgaaaggctaaaggagtgtcccagaataaaaaggactaaagatatattaccgagccaggcgtggtgactcacacttattatcttagcactttgggaggccaaggtgggagatcacttgggcctaggagtttgagaccagcctgggcaacataatgagatcccatctctacaaaaaatacaaaaattagccaggtgtggtggcgcacacctgtaatcccagcactttgggaggctgaggcgggcggatcacctgaagttaggagtttgagaccagccttgtcaacatgacaagcgaaacctcatctttactaaaaatacaaaaattagccaggtgtggtggtgcacgcctatggtcccaggtactcgagagcctgagatgagaggattgcttcagcgtgggaggtggaggctgcaatgagcagtgatcgcaccatggcactccagcctgggtgacagagcaagaccttgtctctaaaaatcaaaaaggagacatgagcactatgtgcagtgtggggtcctggattaggcagggagggttgctgtggaagacaatgcagaggtgattggtgaggtttgaatgtggattatatgttagataataatattatgtaaacattacattttctgtatttgatcattgcagtgtggttatccagacatcctttgttgatgcatagggactattttaaattgcggtaggttcaggaatcgtggcccacttgaatcttctgtggagggaaaagatagggcagcttcaggcctcaaaatcctgtcatggtgaactacagtgccctcttgtggtaaggtctcctttcgttcttggggcataccacagactctgaggcttttaatccagtcattccacaaatatttttcaaaccctcttatgtatcaggcatggtgccaaatgtctagaatacataagctccttatggaacttgtaagcacacaaacacatatggaatcacaaactaaaataagggttttgaaggagttttattacataggttaattgcctctaaaacttggtgtgacagagaaaggggattttcctgtctttggtttacattgagttttgggcaaccttcccacatggctgtccggcattagctgttctgtacagatgccctgagtccctgcttgccatgtcactgtttattactggggtttgttgttgttgttgttgttgtttttgagatggagtctcacgctgttgcccaggctggagtgcagtggcgtgatctcggctcacagcaacctccgccccctgggctcaaatgattctaatgcctcagcctcctgagtagctgggaacacacacacacacacacacacacacacacaccaccacgccaggctaatttttgaattttttgtagagatgggatttcgccatgctgaccaggctggtctcgaactcctgacctcaagtaatccacttacctgagcctcccaaagtgctgggattacaggcatgagccaccgcgctggcttatgactggtattatattaataataaaattcgcgggccgggtgcggtggctcatgcctttaatcccagcacttgggaaggccaaggcaggtggattgctggaggtcaggagttcgagaccagcctggccaacatggcgaaaccccatctttactaaaaatacaaaacttagccgagtatggtggcgcatgcctatagttgcagctactcaggaggctgaggcgggagaatcgcttgagcttgggaggtggaggttgcagtgagctgagatagtgccactgcactctagcctgggcaacacagcaactctgtctcataaataaataaataaagttactacctattatccatgatttaaggtaataaattttaaaaggtacctttgagaaaatatgagattgctataaatcaagcccacctcttggatgggcattgcgttatttgcagccacaaaggaacccatagaccctaccttgtatctatggcaagccaagagtgtgccttcccctgcccattcctcagtttgttcaccagcaacccaagtttccagctgcagatggctggattaaagtgacttgagggaggggctggtctgcaatgttcaggagcatgcttcatgttggaggcactgagcagtgggaggagacacgatgaggctgtaatatgatgtaggggccaggggctggtttacccaacccagatgatgcaacagtgttgcacagagtcacctagacagcctggtggactgtttaaaaaggaagagaacagtttgcacaaactgacatagttctaacatttggaaaaggggaactcagctaaatgaaagaacagtaatgctacagagtagactgtgtttctaagtattgggtgtagatattgtgttttattatgaaacttttcagaaaagtagagtagtatcacgaacctcacatgcccgtcacccatctttagaaatgattaactcctggccagtctcatttcatccactccccaccctctctcaaccctcagatggcctggattattttgacattgtgtcacttcttggtgtagttttacttgttgacaatcatgcttttttctttttttttttttttttttttgagacagagtctcgctctgttgcccaggatggagtgcagtggtgagatctcagctcactacagcctccacctcctgggttcaagcgatgctcctgcctcaacctcctgagtagctgggaccacaggtacgtgccaccacgcccagctaattttttgtatttttagtagagatggggtttcaccatgttagccaggatggcttcaatctcttgacctcgtgatctgcccgcctcagcctcccaaagtgctgggattacaggtgtgagtcatcgtgtctggccaaaaaaaactttagattcacattcggtcagttaaaaatgtatgtcaaattgtaaatgatcacctcgattggaaacgggatatttttactttatttctgctcctatgtgttttctaaatatcctatcatgaacatgttacttttatagtaagtagaaacttattttaaagtgtattaggtgtgaaaattaagattagaggctgttattaatatccttgttgtctaacctttcaacaggcagcaaagtaatggagaacggccttctcttcaaagaacttctgcagactccaaattttcgaattaccgtggttgatgatgcagacactgttgaactctgtggtgcgcttaaggtaaagtcagcctcaggggaggagttcatcaagcaaggcaaatgttagcatcattgagtctaatcctcaagaatgggctctgtgttctgtgcacccacatcagcgaagaatagtgaattgagagtcttgtttataacttcctgttttgctgcagcctttcccgggtggttcagttcctctcttactcgtggcttgctttaacttgtaaatatgggggaattgtgatgttttggtctttgggaagttggcagcattgatatttggaaagcatgggagttccttgatgacagggtttcacccaggagcaaatgattctattcattcatgtttttctcccacacttcatcctgagcaggaaaaggaacttgtttcctctgaattatgctactctactagtttggctggttgttcttattaagggaaaaaataatctgctgctggtagaggtttttctaagaatagttttgtctttgccctcaagagagagaagatgtgattaaagaaatgcactccactggccagtggcttgctggatttttgtaagtggaactgtacagtatgcactcttttgtgtccggcttctttgattggaggtgtatttttgtttgttttaatgtaaattttaagaggtacttcatacagaaaagtacaaaaatcataagtatgtagtttatgttatctttttttcccctcttttgaggtaaagggaggtctccacacctgggctcctgacttgttggctgctgtcttttaaagccttaggcactgtccctctctctgccgtgacttgggggaacaaccaacagggaacagcagcagctacctgctcattccccctcactatctaagttgcctttatttcactatcatctacaaaaaagagtggggggaataggggaaataaaaagttctcaatgtgaatgccccttttgagccacttctgagtcatctcttttgcagcaaaaagccacccttcagaaatttgagcatctagggaagaggttaggcaatccaccagtcacctgtctttattggatgggagttgcaaaggtggaaagaatgcctgtctatgctttctcataaattgtatatgtttttttctagtcagaagttaaaaccactctctagaattaacattgtgtatatatgtgtggtcatgatatataatgagcatttaaaaaaattaaagccaattaaaggcctgggctcctagggagcacacatgcatatttctaagcgcctgtgtggggcattctttgcattagcattacattacatgcaggcccagttatacatgtaagacgctgactttggctgctttgtttatttttgttggttgagatttttatgtgtttttaatagtccttcattaaactaattaccactcaacagcagggggcatcgtgaatgcctaattgctcagtgctggcctgagctgctccaaagctgttttcaagtgactggatgtttttggtggtcatggagaagctgtgaaaccctgcccagagcaaagagtgctgggtgagaagaaggagtctagattgaggtgagggctttggaaaagcttctgctaatgggaacccatgctggtcttgtgtctgaacttagaatggctttcatttttgctggcaggaagactgtaagtggatgtgccagctaccttgatggaaagggattcatgggggatgcagggaggtgggggttgaaggcccttaatcatcctccctgcaacttcccacacaatcttttaaaacgagatcagttaccatcattcctgggggtttgcatcagagttaaaatttttgaaaactgagaaacaggcacttgtagcaattattaactccaaccattgtcttgcacagataaggaaatcgagatccaaagagcaaatgactttagggtagcaaacactggcacactcggagcgtgaacacgggttttaagactctcagcccagtttctttggttactgtgtaccacttgacttttctggttagtaatcaggcagcatgaatgaaacgaagccctctctcatcagagcctgccagagcaaggacacatggccgtatgttgctttcatcacataaataacagtgatgggtttttccccccgactataacacagtcatattccttgttttcacacaacagaaaggtgtaaagaaggaagtaaaaatcaaatcactgacaatcctacatcctgaaataacctcagttaatgtttgttgtatacccttccaatgtttttagtgtgtacctatgtgtatgggtcctttttaaaacaaaaactagatattagtgttcaagtagtttgattttgtgtgtgtgtgttttgtttgtttttgagacaaggtctcgctgtgctgcccagactgagtgcagtggcacaatcatggctcattgcaacctcagcctcccaagctcaagctgtcctcccacctctgcctcctgagtagctgggactacaggcacatgctgccatgcccgactaattttgtttattttttgtagagatggggcctcgctgtgttgttcaggctggtcttgaacttgtgaactcaagcagtcttcccacctcagactcccaaagtgctgggattacaggcatgacccaccacatccagccattgatgtgttttacttttttacgttaacaatctttagtaatattctccatactagccaatttacaaaatgtacattatcttttttgtactcaaaaatgtggagcatttgacttactaggaaaaatgtgaaaacaactctctacaaggataaaatagaaaattcaaaggatttatgcataatcattttgtaccagtgcctcttactaccttcggaatgtccttcatgaactcttagctgtattcatctcttagtaaggatatatccttttttaaaaatcaactttaagtgtaattcatgtaattaggccaggcatggtggctcacacctgtaatcccagcacttgtggaggccaaggcgggtggatcacgtgagtatgggagtcttagaccagtctggccaatagggcgaaaccgcatctctactaaaaaatacaaaaattagctgggcgtggtggtgtgtgcctgtaatcccagctactcgggaggctgaggcacgagaatcacttgaatctgggaggcagaggctgcagtgagccaagatcgtgccactgcactccagcctgggcgacagagtgagactccgtctcaaaaaaaaaaaaaaatgtaattcatgtaatcaaactgcatctatttagagtttataataccatgggttttgagagttgtgtgcatgcacttgcgaaaaccactaccaaagtacacaacatttccattatccccaaacaactccacatgtccctttgaggttcctcatcaccccagcctccagttgggcagtcagctgatctgcttttatatgccatcgtttgcattttctaggatttttataagtggaactgtacagtatgcactcttttgtgtctggcttctttgattggaggtgtattttttgtttgttttaatataaattttaagaggtacttcatatagaaaagtacaaaaatcataagtatattgtttaatctatgttatcttttttttcccctctgagagaggtcttgtgttccttggctcaagctgttttcctgcctcagcctcccaagtagctgggattataggtatgcaccacagcgcctgatttatgttattgttttctgtgtttttaaatagtctagtggtcttttttttcttaacaacttttttttttttttgagacagagtcttgcccaggctggagtgcagtggtgtgatctcagcttactgcaacctctgccttccaggttcaaggaattctcatgcctcagcctcccaagtagctgggattacaggtgcattccaccacacccagttaatttttgtatttttagtagagatagggttttgccatgttggccaggctgtagctggccaacagatgtattacatctgtaatgtacgttttgtaattggctactatggagaatattactaaagatgattaatgttaaaaaagtgaaactcatcaatggctggacgtcgtgggtcatccttgtaatcccagcactttgggaggccgaggtgggaagactgcttgagtccacgagttcaagaccagcctggacaacacagtgagaccccccgcatctctacaaaaaataaacaaaattagtcagacgtggtggcttgtgcctgtagtcccagctactcgaactcctggcctcaagtgatccgcctgcctcagcttcccaaagtgctggggttacatgcgtgagccatcacacccagcctatttttcacacctattatgcatgaattcatagagaataagtcccagcagctcaggctccttcccactggttcccacaaagtgcgcttctctgggtggagcaggctggtacttcagtctaatccaggtacctttctctttggcttccttctttttctgatcattttccttcatgtgtttcaggaagctatctcagctcttagcttaatatgctccatacacccattaattcttggcaagaatcttgcccttaacttgtttaccacaatgccagcagcatgctgggtaacattgtagactcttccagtttagccatggtgacacttgtggggcattcctttttgaacagtgaccattcccctgatgtctacaatatcatctttttttaaaaaaaggttttttagcttatgtatttattttttattttttttgagacagggtctcactctgttgcccaggctggagtgcagtggcacaatctcagctcagtgcaacctctgcctcctgggctcaagtgatcctcccgcctcagccttctgagtaactgggactataggtgcttgccaccatgcctgctaatttttgtattttttgtggagacagagtttcaccatgttgcccagtctgatctcaaactcctggactcaagtgatccatcagccttggcctcccaacgtgctaggattatagacctgagccaccacaccctgccaatatcacctttctgatagattcacatatatgtggccaaaggagcaacttcatgctttctaaaaggcctggagaacatatgtcaggtacttctctcctctttcccttttgtattcatcattttggtaaattactggaagatggcgattctggccagaaggctatcatttttaatagattctttatcaggattgagtttcattaacagagacccaaaataatacaggttgagtatctcttatctaaaatacttgtgaccagaagtgttttggattttggattttttcttttttggaatatttgcattatacttaccagttcatcatccctatttgaaaatacaaaatgctccaatgactatttcctttgagcatgatgttggtgctccagaagtctcagattttggagcattttggattttggattttcagattaggaatgctcaaactgtactggctgaacaaggtagacgtttctttctttcttatgtaaaatccagaatgtatatgacaattctattctatagaattcgcagggatccaggcttcttccagctcacttggtgcttagcccattttgtgctgctataacagaacacttgagactgggtgatttataatgaacagaaatgtattggctcatacagttctggaggctggaaaatccagtatcgggcaccagcagttctggtgtctcatgagggcacggtctgttccaagtggcaccttgaatgctgccggaggggaggagcgctgaccctcatgcaacagaggaatggaagaggcaaacagagagccactcccggagtcttttttctaaggaaaagcctcagtccattcatgaaggcagaacacgcatgaccaaaacacttcctgttaggccccacctcccaacactgccacagtggccaccgaatttcaacatgggttttggagaggacaaacactgaatggcatagggtagcatagggtgtggcccttgtcttcatggtctgtgaaagtgaccagagcatcaatgtcacatctaccttccaagcagcgaggttaaaaaaagaagaaagaaagaaagaaaaaaaaaaaaagacagacaaagagcacgtggcagctatctttcaaggaaggttctggaaaatcaaccttgtcacttggcttcatctcagtgggtacactaggtgtgaccataactagctacaaggcaggctggaaaatcattttggggatcttttttctggatagccatatacttgcattaaaataagagattctattattgtagaaggaaagaatagattggggataaagcagcagcccgtggtacaggctggtggtgttcctttgtggggctgttctgcagttctaattgctgggcatgtaggtttgctccagggctttggctgtggtaaaccatgccgggatgcccagctttgggtctcatctgtagtcagggccactgctcgcccaaaagcacctttatgtgagtgagagcaaggcctacataatctgacatgctagccactagacatatgtactatttatatttacattcaaattaattaaaattcttaaaaactaaaaattccatttcggagtcacagtaactacattttgaagactcagtggctgactaatggctactgtattcgatagagcaaatataaaacatttctatcattgcagaaacttctattggacaacgctcttccagctaaggcagcttcatattggtgcgaccgactaggtgggccaagtgtgggcctgcctcagccttccttgacatctcagccaggctgccttagacaggggccagcagcaaacaatatgtggcaccttgcctttagtaatcccaaaccctgcagacagtctcctcttggcagctagcctcaggaggagtcggatggattgttggactgagagaaaacagtgagtactgacttgggttttggggaggcagttcttgctgggtggtgagaatgtttatgtaacctgcaggtagcatgggctggttctcctgttctttattctttttgtgggaaggtggaagtgggagaggaattgagccccatccaacccacccctattcagaactggaaagagtacactcaagagtggatgattgcctctgagtattccgtcactcaggagatggggaagagctacatacgtctgttttctgaaaattatggtatttttagctccaaaagagtttaaagcagatttaaatgcacagtggataatgataactttcacatctgagcgatctcggaggacatctgctcggatgctgttcaaacacgctctgactggctcagtatctttatttttcttttgacaatggtaagtggtggagggagagaatgaggatttcaagatctgtcataaggcgactaaactgggttgcagcccagggtcctcttagaagagaggagtttaccctgcactaggtctcctgatctcccctggtgggaaggttaaatgtctagtaaaagcttctagtagaagctttggggtggtctagactcccatgccctgcagtgaaggggccacagaggagctgtgagggagcacccaggcaccctcatgtggcttttctgagtacagcaacatagaaacactgctttggagctcagggcctgtccatacagtcctgcttggatggttctggttgcagagagctcctgctaaatctttcctgttgggtgaggtcagctcttcctgttagaaagttctcatctggactctgcggtggcctctctgtgcctttcactcactgaccctagagcagcacggtgtggcgtgatcttctcgggcaaggtccttactctgtgtgcttcagtttcctatcatgttcccatgataataggacctgccctgtgacaatgttgtgaggtttaaatgaggtaataatatatgaagctcttagaacagttcagtaaggtttgctgttgctattttttattaccttttcttctcctaagctacttttttttttttgagacaggctcactctgtcacccaggctggagtgcagtggcatgatctcggctcactgcaacctccgcctccccagctcaagtgatccttccacctcagcctcccaagtaggtgggacgaaaggtgcatgccaccatgcccagctaattttttgtatttttggtagaaacagggtttcactatgttgcccaggctggtctcaaactcctgagctcaagcaatccacccaccccagcctcccaaagtgctaggattatgcccaacctaagctaccgtttttacctcccaagccttggtgtaggccagggaggcactctcctttgacaaccaattgcaaagggtcaggcaggtctttttgaccgaggttggaggaagggcagatttcccacactggagcagcaaggcacaggggacagagcgggctgcaaagccaggcaccaggggcacatccagactccatcttttaccagtgaggtgttctcagtgggccactaaacctctctgagcctcagttgtgccagttgggaaataggaggataggtacatacttctgagtcatgggaatgatgatgaggcagtgtgtaactagcctgggctggctgaaggcacgtaataaataagtgcctcccctcctctgttgacaggagccccttgttgaacagaagtccatgttctctcccattcagcccatagacatttcctggggttggtttttcatataacagtttcagaatggttcatgttgtgatggagggggaaatagggacacagtccagggggcatcagagagcaatttcaggaatctgaccagttggccaacagcctaagcctcgccacattgcatggcaacttcaataaaaccacttggccagctcacccaagggctggcctctgggcttcggcagtcagacccgctgcatgtccccaggtgtcaatctgttgccccagtactggttgcagccccagtgcaggctacaattgcaccaactttcctgaaagaatgtcaatactagaagggccttgaaaagtcttgtccaagccctgaattttacatctgaggtgaagatggccggagaggtggagtggttggcctaggtcacactgtgacaatgtagaggctctctggatgtcagtgccgtgtaccgcttccgtctccttgtagcctccttagtctggctgctatgctgggaagggcgtccagacctaggtgggcccagccccaggtgttcttatggtccctgctcttagcctctgcatagcactcatcctaaaaggtctggctgtcccatcctgactcggcaactcaccccttctagaagcagagctgcagaactagatcgcacccgaccccccagcatctctccaggctcctttcacacggcttctgccttgcctcttccatgatgctgcctgttgctgagagtgtgtaagccgggaattacacactgatgagaactgatgaaacctatagttcgcatagcctgtgtggtaggaagaggctgagaagctttcgcaggttcaggcaagttggtaccttacgaagacatatgcacttggtcaggctgtcagttcctaggaccaattcctcatcagctctgcctgcatcatttttagagaatttttccactttttcctttctatgttgactgcaatgagaggcataagcagcaaccgcagtaagctctcacattattgctcaggaagagaagacactagggggccttcctatccccatcctttattctctagccctcttcattccacatcaccccgtgggagagggcaagagagggctctgttctgtgggtctgtggggagtagacagaaacttcaggaggcccaattggatgttttttttcatgtgaagtatctttgcgcctcggtcttctggtaagcaatagctgtatctaaatgaccaagtctgtttgtcatggtgagcccggccacatcaatgatatgtttgatgtgttttatcaaaaactgcctgtgtactagagaagacatttttattccccagctcattctgtttttcatctcatccctcacattttataggcctgatgttttaagaaaagttattctttcactataaaacttggttttattaaaatacacttattttaactcatttcccaaactaagttcatgttttaaaatctcccacggctctctgtacagtcacaggtattactggaattgctagtgtggttagacagttggatatttgctttttggggggcattgagtgttcttggtgaaggagctggaaaagtggaaggggccaggaacctaggggctcaactgaagttccaactgagttgccacctgtgcaactgtgcaggtgttacttgtcataggtggtaatctgacttttacttattatttgggcccagctcagatgccgcctcctccatgtggccttccctgctgtgaacggaagcttgtggctcctgccacttgtcagcacactctctcccctctgccttttttttttttgagacagagtctcgctctcgcccaggctggagtgcagtggtgcgatctcggcttactgcaagctccacctcccaggttcactccatcccctctgccttttgatgtgctttgttgtgtctcttttctcagccagattgtcagctccttgaggacaagctctatgtcttaactctcatctttgcagctctcccctgggggcatcttcagcccctgcattccccctgccacccgctagcccctgcaatcactgtgtccctccagggctgagtggggtgctccccacacagtacatgctcagtgcatacctgttgaaacggaatttcagattctcagtaccttttatggaatatcactttctgctgagcattaacagttatttgtacacgttttatttttcctgtaaggtcagggctggtaaacgttttccatcagggccagacagaagaggccttgtggaccatatggtctctgttgcaattactcaaatctgcaaccatagacgatgtgtaaatgaatgggtatggctgggttcccgtaaaacattatttacaaaacaggcagttggcctagattgccagcccccttagcagattttcagcttctgaaaaggcaggctctgtgtctcatttgccttgtgtctagcagaggccatgcagagagtgagtgctccataaatactcatttggggattattaaatgaagcaaaaggctggaatttgagctgcacacatacaggcctcatgacccagtgtttcaattcctaggtcatacccaacaggattgcctgcacgtagtcaccggagggcatgtgccagggtgtccatggcagcactgtttgtcatggccccaaactggaatctaccccagtgccagttgacaggagataattaaatcaattgcagcatattcacaaaatggaatactatgcagcaattaaaataaatgtgctctatgtaaaaatatggatgaatctcacaaacacgatgttgaattaagatgaagctacacataaaatattacatattgtatgactccattcacaaaaagttgaaaggcaggtaaaacacatctatgctgtgagaagtgaggagagtggttacctttggtggtggaggtgggctggaaggggttctcgggagcttcctgaagcactggctgtgcttttctccttgatcagtgtgctggctatgggggtatgctcagtttgtgaaaattcttcaatccgtgcacttaggatttgtgtacttttctgtatgaatgttatggttgcataaagcattccatttaaaacaaaacaaaaagtaaagtagtttgtccaaacattatttaaccaaagactactatcagccgttctgattttctgtccaatgctcttcaactgctgaccccaaatatgggctctttgtcctagaaaggggaatatggaagccctgtctctcctttcgtcatctctttcacccaggtgtacaagagcagagcccggcattgagtattttgaagatggagccaatgtccctggtctgcccctgcctcggcatcccccaccacctctggcatccatacccgtggtgggtgctgtaacggcatctgggctttgtcatctcctttgcagaacatcgtagctgtgggagctgggttctgcgacggcctccgctgtggagacaacaccaaagcggccgtcatccgcctgggactcatggaaatgattgcttttgccaggatcttctgcaaaggccaagtgtctacagccaccttcctagagagctgcggggtggccgacctgatcaccacctgttacggagggcggaaccgcagggtggccgaggccttcgccagaactgggaaggtagcccctcacctgctctcccgcaccccctccttcctcacttgagactcctggcttggggtgaactgcagcccagtggagatttcatgccagcatctatttgctgggattgttccgtttgcctggctgctttttcacttgactcttctgttctttatctttgtgtctttatctttccttggcttccagcaggggactgaagctcttctctcactctgctcttgaaataattgatgctaggccgggcgtggtggctcatgcctgtaatcccaccactttgggaggccaaggtgggaggattgctttaggccgcaagttcgaggccagcctgcacagcatagcaagacccattctctaaaaaaaaaaaaaaagaaaaaaaacacttaaaaattaaacaaataaatgattctttagtctttaccatagtttttttaaatatataatcctttgtttttaagaccattgaagagttggagaaggagatgctgaatgggcaaaagctccaaggaccgcagacttctgctgaagtgtaccgcatcctcaaacagaagggactactggacaagtaagtctctcagtcgcccatgagaccagataaatgtccatcattcctattctcaggacttccagccccacggagatgagctagactatttgacaagtgcccttagaacttatctggattagttcagtcctttgtgtgatgtgaacgtctgtgatgagaagcatctacctactcccaaaacatgtgtttacacaaaaccaggctcaacttcaatgaaaggagctcaattctataagtcatgttataaaatacaaaatttaagattctagtttgtctcgcagggtgtttggtaaaagctacatatcatacgttttaaaatttgtaaaaattacttttttgtttttattaaaaagtatggttatgttattaaaatgtcaagtcagaaaagaaggaaggacgagttagcccaacattataccattagaaggtagctctgttaagtttggtgcacagccttccagtctcttcatcgggtgggtagatggggcttaggatgggatgggatgggatggaatgggatgaagggatggatgatgggtgggtgggttggcaggtgggaagggatgggatgagatagatggatggatggatgatggatgggtgcatgggtagatgggtgagtggatgggtgggatgggtgaatggatggatgatgggtgggtgggatgggatgggatgagatggatggatggatggatggatggatggattatggatgggtgcatgggtggatgggtgagtggatgggtgggatgggtgaatggatggatgatgggtgggtgggtgggatgggatgagatagatggagggatggatgatggatgggcgcatgggtagatgggtgagtggatgggtgggatgggtgaatggatggatgatgggtgggtgggtgggatgggatgagatagacggagggatggataatggatgggtgcatggatagatgggtgagtggatgggtgggatgggtgaatggatggatagatgggtgggtgcatccatcctccattgcccttccaggccagttgtgtgttaaaggtgggcttaagtcagtttatttgccacctgattgagagagtgagccctgtagcaccagaaaagcttcccagcctctcctgaggccactctccagccctacctgctccacagcactttctcttgccgatttactgagcatgattgtggaggaccataatcatgatgccaactacaccactgcataaatgcttatgcagcatattgcatgtatccttaactctcccgtaatactctctaggggaggggaggtcttgttgcctaggactgaagggagctgggcagctggaatgacatgctgattgtggctaatttagagcatgagcttctctccaagctgggaggagggtcgtggatgttgttgctattatctctggttgcagctcctttatcctggttctgtcagtttaggtgtctgctggtcccagtcatgcatctttacctccccctgcacccagcacccctcctccttttacccagaacaaattaatcagccatggagttctgtactgaaagttaaaaatgagggtggatggagcatttgtcttaccttttaaatttgcactttatttttctgaaatggcttttaaaaccagccatgcagagatggaagttcacaaacaggctgccaaaggaggagaactacctttaaattgtggctaaaaggaaaatgcctctgacatgcatggttttccttacctacttagcagcagacagtgatatgtttgtgtgtggttggactactttaatgaccactgagcatttatcaagaaatttttttaagtctcaaaaaaaaataatacttggctgtttagtgagactctcccaaccagaattttcaagtggcatcttgaaacacaccccaagtgtgctaccatggggtgccttgataggattctctggatggacaggttggctgggcattagcctgttagctccagggggacatggactagaattgcgattctggggccagtagctccctgttttcaaaagcaggtgtaatcaagcaggtaaatctctgctctgagcagacatctctccttggtcatgtcccattttatttcttctgattagagattgaacaggctccacctgtgcttaataacatcgctgctggattggacgtggcagcacccttctcctgggctggagtgtagaatcccctgggactcctccccattccttgtaccacctgcctcccaaaggcagaggcctattgtgctccctttgcaccacctcttactttgattcctttttcctttttcattctgaccaccactactccggtcttcctctgtttccttctccctcccttctcttctccattgctatagaaaaaatagcaggagggcagcattcaaggctgccctgtggcttattagccctgtggccttgggcaagtcacgtatttagctgttctgtgccccggtgttcttatccacaaaattaagatggaagaccagatgaacaccatggtccctaccagcttgagcattcacattcagaggcctcctgctcttatagagtgaagcacatggtccttaggcagatgtggcccccctcaatctagcaccaatgtaacttcctgcagtacatcctcttactccctatggtaccgtcttttcttgaatggaacttttctttgcctctcattttaccttaattaccttttctttttttttttgagacggagtctcgctctgtcgcccaggccggactgcggactgcagtggcgcaatctcggctcactgcaagctccgcttcccgggttcaagccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgcccttaattaccttttcaaagaccgtgtcacattctgagatactaggggttaggacctaagcatattaattgggaggagggcacaattcagcccgtacacaacatgttctctgaggtgcatgttgcaagctcctgggtctcactctgtcacccaggctggagtgcaatggtgcaatctcagcactgcaatctccgcctcccatgtttaagtaattctcttgcctcagcctctccagtagctgggattacaggcgtgtgcccctatacccagctaatttttgcatttttagtagagactggtttttaccacgttgcccaggctggtctcgaactcctggcctcaagcaatctgcccaccttggcttcccaaagtgctggattacaggcatgagccaccacgcctggcctggctttatttataatactgcacatccctgcacttagtctgaagtctgaaacatcttaagccctcagtattgattagtgggatagctggctgactggtttgtcctttttttttttttttttttttttttgagacagagtcttgctctgtcgcccaggctggagtgcagtggcacgatcttggctcactgcaacctccacctcccaggttcacaccattcttctgcctcagcctcctgagtagctgggactacaggcgcccgccaccacgcccagctaagtttttgtatttttagtagagacggggtttcactgtgttagccaagatggtctcgatctcctgacctcgtgatccacctgcctcaacctcccaaagtgctgagattacaggcgtgagccagcacacccaggcctctggtttgtcatttttttaaatgaaatgttgtctttttcttcctttcacctctaactttatttagagagtcttccaaactgatctaattgtccttttagcattttatgtaatagaaaataatatttagatgggcagtgtagcctaatggttgatcattggcttcagagtccaaaactgtggttcaatttactcatatatagaatggggacaatattttctacctcatggggtgattgtaaggattaaacaagttactcgtctgtagaaatttctcttccacacacttcatatctcttgttaacatcccttccacagaatgcactttggaaatgatagttttaaaagttgggagtgctttcagctgcaagaccaacacacagttataacagggaatatggaggtgaacattattaaagtgttggcccagtggctctggctctggattagaatctcagtgatcctgttggctttcccttgaacctcaagatggctgcagcagctccaggcatcacattcacttttacactcaggaagggaacaagagtagtctggggtaacagatttttcctctagtgcctctcgagaaatcttcctcgagaaaccttcagcagatatattatgtcttgctgcctaggactgtgttacttgaccaattctaggtgaaaggctaggaaggtgagtagtctcttccaaccttggggaaagggagaagcaggttggaaatggctttggatggccagtcatctgctaccacactgctttggggacatatacattgttcttgttttaggaacagggaaacatagcatggaaggacaaagaaaggggctgaagtttctaggctttaaatccaatccacaggaatttattcaacgaattctcacggagcacctgccccttgccgtgcatggtgccaggcactgaggatacagtagtgaaaaaaacagacttggtcccagtcctcagggagctttctcggtccaggacacactatccatcttgtggctgctattataagctgttgttactgcacatccaccatttgccaagtgtgtactgtgtgcttcacacataagtcatttaatacttgcagcaaggctgtgtatccagtcccattttacagatgggcaaacagggtcagaaggattgtgaaacttgcccagagttagtaggctgtagagtcagagttgattaggtctacctgactccaaaaaaataaaacattccacaaaaaagtagcaaaacattccgtaccttaaaaaaactacaatgaagaaacaaccctacaacgatagactctcataaagacatgtgatctattagtactatttgttcttcttaaaaattatcattataaggttctgtccagctaattttcaggattgcctttcaagactctattgattctgccaagctcactttgagctatgtgtgtgtgtgtatttaaaagcctgggccggcgcggtggctcacgcctgtaatcccagcactttgggaggccgaggtgggtggatcatgaggttaggagtttgagaccagcctgaccaacatggtaaaaccccgtctctactaaaaatacaaaaattagccaggcgtggtggcacacacctgtaatcccaactactctcaggagactgaggcagcagaatcgcttgaatccaggaggcagaggttgcagtgagacaagatcatgccaccgcactccagcctgggcgatagagtgagactttgtcgcaaaagaaaagaaaaaagaaaaaaagcctgatgaaattatttctttagtgatttttcacttatatctgtattcacatcttggaagaaaaggtaagataaatcaagcttctgacataagatgagtgctttgctaatcgtgggtcctcactcggattcttgcgggagcattccagcctacattatttgttaccttgggatgattctttttggagaagggagagcaatgcctccttgcaatttaaaaatttatttttacaacttttaaaataatgacagaatatagactcctccaagatttgaccaagagttggagccacagctcctatgtaaatgacaacagtttgccctggtaggatcaccgtgtgacttggttgtggacagtgtgctccaagcttaattaggcagaggatggtctaggttgccccaggatctgacagccacattccagaggctctctgcagaccaaataataaaggaatgtagaaagtgctcactgtgttttccatagtcacatactaacctgcaatctgttaggacagaaaacctaacttattctctgaggtaaatccagtggcctaactttgtcttttcacatttcctcccaactaggtttccattgtttactgcagtgtatcagatctgctacgaaagcagaccagttcaagagatgttgtcttgtcttcagagccatccagagcatacataaagtgaatcatgcaacgtgttgggggaagttctgcctttctgatcaatcttttgggttcacgtggaaaccaggacttggcaacatgatgtttgactgtaatctcatcacggatatgtatgaatttttacaggttcgtttttgaattgtgagaggcagttcattagcaaagatgtactgggcagtaactaaacacacatgcaaacatgtgaatggtggtttattcctcattctgtggatgtttctatgagccaaaatttgatgtctttttttcaaaattgcttatgaaatttccacacaatcgtagcttataagattggaacgatctcagccaaatattttaggtgtaattcatatgtatttgagtggaggattttttttctcatttttctagtgttaaattttaaccagcattaacatggtagagtggaggagtgagtgtgttcaaagatcaacatatttaacttttaaacactatctcaaagccagcataattaactactttgattgtgggctgacctttgtttttttaacaatcaggcatttttaattagataatccactcatgtatttccccctcactgcagttgtctgcatttttagcctcttttctcttcgttagttgtcagaatatgccttcgtcaaggctcagaggtaacaagacagaaaattcatctgggattttcctgctgtggctggcacattcttctgattaacagacacttgtatgatgctttaggctagttagtgcattttttagcaaacatttatcttaaacatcacagatccactggggggtgcaaggggctactgttagtcctcttgttagatgcagtcactcctcctggtcacctagtgagcagggacagagccaggagtcaagtgcagtgccaaggtgcatgaccctctgagaagtcactgggctgatttgacctccgactcattggttgtgcaaatgccatgtgcagcctttcctgaggccataggagggcttcctgcagctgagatctatgcaggccatcctctcaacaagtgccactccaagggcggtcctcggtgcagcagcatcagcttcacttgtgggggggtgggggaaggggcggtctcagaaatgcaggttcccaggtcccaccctggacttctgaaggggtgtggcatctgtgtttctgatgcttactacaatatgtgaaccactactttagaaaatctgctttaacttggtattcctctaattgtgttccctaggaaatgactgtcccaagagccagtgattattccaggtgttccctggaaaggtcaagtgagtctgggaaacactatgtctgtacacctcttgaaggtgtcgaatgtatgtttatacatcagtggaacccatttttctagcctagcaagtcccaaacacattacactgaagagattttggtgaggaaacttgctggagttttcagggaacactgttctaggcttaggtgaccttaggatcactcaagtagacccttcactccctgcgagaaattaggatgaataactacctgtggcattgttggttctgaacttttacagttcaggcctgctgtgaatctttgatgaagctttaaggtgacactgttgtacaagatgtcagctttgctgaaacgcacattacctggaataagtgctttaattgtagaattagaatgggatttactgtactgttttaaatgagattggcttcagaatccattacagttaccttacatagcacttgatacgtgttaaatgaacatatgaatgtaatttatatattcctagaatttaagttactttgtgagatttgggcctgtccctcaatgccagtttaggatttctttttttctataccttgaaatgattataaaatagattttcatgggaattttaaaaactctatccaaaacatttttggagcattttaaagccccatacacagaagtatacgaaagcacacaaaacactccaagtttcagcagttttagcgccaccattaacccactttgcttgtctcatgaaaaatctttgttaaagtttgtacacaggtaacaaaaagttactttaaaagatatataaagggctgtaagctaattgtggtgtctagtaagtagcataatgagatgtgaggagttggaactttgcgtgttttgcgtattttcatctgcattcagcttcttactctgggtttgtactcgagtgttatttctttacaaatgcccttgtaattaccactctgaagtctgctgactgtgtctcttgaacatacttaggatattctgcacattatggaaaaaggtaaattttagaagtttctgctctactaactgtagatatttatgactctgcgagttatctatttttataaccacctgtggtccattgttcattttaattcacatttcttatgaagtatggtaacagggagggagacacctagattagcagctcaatttgtactacttcagccaatctgtgaatgtaaaaactacactgttgccttgctaggatccaccctcctataatatggaacaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccctaaacttg

SEQ ID NO: 37725 - DNA, 45122 bp, Homo sapiens
gcaggcgccgagcagccgacgtggccgcaggggaccgtgcctgggggggtctgcgcggggccgctgactcgcgaggttctctgtcgcctgccgccctcgctccttttctccccttctagagtgttacggtgactcttgggtccgaaggggacggacgtcctcccacgtaccatttagaaggtcagagtgggcagaacctagtctgagcaggccggtgatgaatccgctggcaagacgcgcgcgtgggtactcacgtgacctaggctgcggcggcggcgtgctgcgggctctgtggcgggagcgaggccgacgggcggggccgcgcggccgcgtgacgcgaagcgttcgagagcgcgcgtcgtggaacgtcttggttgccacggcaagcgcgcgcgcgaggccttgggaacctcgggaccggcccccggcgagcgcagcggcgcccagtgtaagggagtgggagctggtccgtgccgcggcggccgcgcagggagctctcgaggcaacgccggggcgcccgaggtctggaaggcgcaggtggggcgcgggggagttcacccctgcgcggtcccttgggtgggcggggtgggcgccccaggccccgcggactcggctgggaggctgagcgggcgacggtcacgggacaagggtggagggggtggggacctcatccgagtctcagagatggaattttcgaggaagggagcgatttcgagagagaatagtttgagaagttgttctcagtcccttctctcgcgggagtgtggtatttagggaagcttcggcctcttaacccatggactgttaggatggagggaatccttcccgctcgattcctatcgcggagtcctttcggagcatcgctattgatcattctcgccgccccaaccccgttgtttactttggcttcgcagatctctgtggtcttttgccctcccgcagcgcccatggccccgtcaaggttgggcagcctttctctgcaagaaggcccacgaacaactgcggttatattgggatggattgcgcgtgattttactctttacaatacattctttcatgcttcctagggattgagctgcgcggcggatccctccgacttaattctgggcctgagaaaagtttctcttggaatgcgcagtttcgtgacgcagcattattgcgtgactctagggctgacccagtttttcactttctaattgtaaggaagtgcgctagtagtccaccgaggatcctcgaggttggccttattgtatcataatttaacgaatttgcgttccaggttgttacagcctttgaaataatggcctcatatttaagaatgtagcaatttttctttgaaatttccgaaagtggggaaaaaagtaatagaagactgcacctatatggaattattttctgattcgcagttctttataatcgtagacttaatttggtggctttattggacctgtttgaaacaggaagcctttctgtaatgtggtttcgggtcggcttcacctctggcactctctgaaacgtcgttgtctatggtttccctaagaagctagaatgagcgggatgctacggagggaggtgtatacaggtgttagacaaagccccctccgcttttttggtaaagggccaaataggcattagatcaacttgtgctagctctaaggagttaaatgcggtattattaaagactgcttgtaatgttgactgttaagtgagagtgttacttctttcagtgtttatggaatcgaactaaattgctaggtattttaatgcagaattttaccttttctcgggtattttttaagacatacacagacatacatgtagttatgttgaaataaatgtgttttattagaacgttaaaaaattagaatttaggtgaactactggtatcggaacagattttggtttgttgttgaagactgtacactggtgtaggtactgtttaatacatcagattgtcatttcaaagactttgtcttcttaactttgaaaattaaataatgtgaaataatgtgataatggtttttatcttttcaggacacttgattgacacttaattgtgcttaggaatagaataggcttttttttaagtcaccatcctccaatccttatttctgtaaaatgtattttctgagaccgctgaggatatagcaaatcccagtcacaaaataaaaatgtgatattttaatataaacctttttctttctgtgttgagattccccagagattagactgaaattgaccattagacttatatataacctctagatacccaggctcttctctcgtgtatcctttttttctctttaagatggagatgtagcaaggaaggttattaagcaatcctgtggaattagccctcccactccacccctacacacaggcacactcttctttctcagtagccatcttgttccctccattgacacattattaggaaatctttcatcacaccgtatgtaaaataagcttagaaataaacgtatacccaaggtaaatattgcttctagctatattccttcattatgcctcgcttctactttcaaatgctacctattgaagatttaagccacatgactttctacgacgggacactctgggttttcttcacccctccctcactctgctgacttgtaaacatagtaggacttttagatttggaatcaaacacatctcatctaattttcattttcatttttcttttctttctttcttttttttttttttttaaagagacaaggtcttgctctgtcacccaggctggttggagtgcagtggtgcagtcatagctcactgcaaccttgaacttctgggcccaagcgatcctccggcctcagcctgtgcagtagctgggattacaggcgagagctcatttaattttcttgacagataatcttctgatccatgaactgatttgaatgtatcatttactagctctcttcttgggcaagctgctcaatatttgtaaaacatttttaaaatcagatatcaacctccaagagtgaggattggataaccttagaagggtgccagacacatatagagagcttaacaaaagatagtaaattttggtgcttctgagggccagagacagaccatgtccattatatctttgctatatattatagttgtgagtgatttttaaagcagtacttttaatttgcttgtgaacccccaaataatttttgtaaaactgtccctcttgcacacttttggttaacttacagcattttacatcatgcgttagttgaaaagaatgcagtttcccacatggtattgatattaacattttaatattggtacatcattctttcacctgtattcagtggggtatcatatctttgtagttttatatccatcaccatcaatttttaaaatacattatattttacacacttccttttttaaaaaattttacttttttatcacccccaccccacagaatattatcttaaggtaatgcatttttatgcttgaaagctttttattaatctctgtgatacatggctttaataacaatagttatataaattgaagctaagtttaaaaatttcctataactaattctgtaagttgtaatttttcttttgggttgagttattataaatagttgattagaatagcttaaaaacttgatggattttaatgaataataattattaagagtagaagtttactggaaatctgtgtcctaatggaatggatagtgggagttgtgcctaaattaaaggagggtctttgagcccttcgacttattgtttgttggtagggaggcttttccatcctggggcagtgtaccatagtaagaataggagtgggtgagaagtatgcctttattttgtaaagtggaagattgtgaaaggatcttggggaataaaaatcagcatgataactggacaatgggcatattctcaggcagatcagtttagtgagaagtactcatgggagtaaaggatctggaagcctttttcttaaaattacacatgtcgttggtgtatgtcccatggaagacttcatttgtcctggggggcacacatcccccagtttgaagaccatttagagtggtaattctcagtgggggacgattttgctgcccaaagtacatttggcaatgtctggagacgtttttggttgtcacaaccgggatgaggggtggtgctgctatgggcatccagtggacagagatcagggatgctgctaacaaagcattatccaacccaaaatgtcaaccatgccaagactgagaaaccctgatttagaggatttgttttggaatcagactatttaattctgtaaactagtgcagggtcagtaaactttttttgttaagtgccagatagtaaatattttaggcttttggggccatgtatgatctctgttgcacattcttctttgtttttataacctttaaaaaatgtaaaagtaattcttaattccagggtctttcagaaaacaggtgatctaaggcaattaatgcttgcaaacttcaattttcttctctgcaaagtagtactaatagtaatattgcatcaagaattgtttgtaaggattgagataaacacctagcatactgtccagcatatgttaagtactctaaatgatgcgtggggatagtggtgtcctatcgtatgtagcacaaaagtgggtgccaagtcacagtgttgttcaagaccctgttcaagtcatttggacaaatttaatgatgctggtgaagctcccaatcaactcacagatgcctatttaacctctgctgtctttctgctgccttagtctgggcctccttgtatcctgaggaagataaaatacaaaatgcctgtcttgtggtttctttggaaagatgtggcaatcttatgacacaacaggatagtattccaggagaagagattgttaatattgataggggttgtggggtagagcaaatacgtgggtctgtatatggtcaattgtatatggtattttctaaattgggtactgaatatattctgttgactaccatgaagttgttgcataataaggctgactagtggcacttcaggttagaaagtatagttatattattaatcggaagctagaccaattttaatgaatgctttctgtgatgcttctgtgctttcatagtgtagattgctgctaaaatagtttcatatcagtgaaattcttctatcgtaagttttcatgagatcacaggaaaagaattgccacatctaatgacagtagccactaggtacatgtggatattgagcacttgcaatggggttagttggaattgaactatcttttcagtgtaaaacacatactgagttttgaagacttcataccaaaaaaaagaaagctaaaatatttaactgaaagtttttatattaactgcatattgaaataatatttttgatatatttggataaataagatactatcattgaaattaacttcacctgttttttacctttttaatgttattagaaaagtataaattacatatgtggcttgcattacagttctgtttgacatagttgctctaaagcttccatttacttttttaatagtaattaaattttctatcatacacatagatttaagaaaaatcttaccccttcctcccaaagtcagcttgtatcatttttcttacccaattcttttggtcttttttgtactctaaacagtgcgaatatattggcactttttcagttttaggcactgtccattaacttctcagtgagaaagatgaagttttatctctttcatcctttgtcgcatgcacataaactttttatccatccatcttcccatctttcaatatggttgtaccataattttgtttatattgagattcattgtgtatattatgacaccaatcaaaactgaaacatttagtacattatgattactttttatttcttgctcaacatcattttccctagagttaatccttagtttttaattattactaatggaaccctgaatactctcacagttgtgtagatcttttttcagagcttacaatcacattaggtattctatcagttttactttcttaaaaaattcttttctgttgtctcctactccaccctggagtgtttgcctaattgttatcttggaaactcatcatcagtcttgggattcctttcatcaaacatggtacccagcaaacagaagatgtaataactgagcaatcacttggctgggtttagaagctatttttactcagaattatgaattaaatgtataatttccttcttctattgttgcctttaagaagttccttagcactcttacttctctctctttttttgtgtgtaagtattttaaagatgatccttttgagcttagtgttctaaaatgtcatggtatgtttcttggtgtgaaatctttttttcttatttatttatttatttttatttttttgaaacagagtcttgctctgtcgcccaggctggagtgcagtggtgtgatctcggctcactgcaaggtccgcctcccgggttcaagcaattctcctgtctcagcctcctgagtagctgggactacaggcgcctgccaccacgcctggctaatatttttgtatttttagtagagacagggtttcaccttgttagccagggtggtctcgatctcctgaccttgtgatctgcccacctcagcctcccctttttttcttattttttgcccattggtttttttatttacttttatttgttagagatggggtcttgctctttcaacccaggctggagtacagtggtgtgatcatagctcactgcagccttgaattcctgcactcaagtgattctcctgcctcacttcctgagtagctggaactacaggcacgcgccagcatgtctggctaattttttgatgttttctttgtagagctggtctcactatgttgcccaggctgatctcaaactcctggactcaagcgatcctcctgtctcagtctcctaaagtgctgggattacaggtgtcagccactgtgcccaacctgttggtctttttaaattaggaaattcatgttttccaattctaggaaattctatgaattatttctttaattctttcatcccttattttttctctgttctctatttctaggaggttttttgtttgttggttggtttttttttttttttttttttttttgatggagtcgtgctctgtgaacaggctggagtgcagtggcatgatctcggctcagtgcaacctctgccttccgggttcaagcaattctcctgtctcagcttcctgagtagctggggtacaggtgcatgccatgatgccctggaaatttttttgtatttttagacggggtttcaccatattggtcaggctggtctcgagctcctgacctcaggtgatctgcccgcctcagcctcacatatttctagaagttttattattcaaatgatatgccttatagactgggtcctaattttcttatttattattgcctatttttcatctctgtctttttgctctgctttctgggcattttctataattgtatgacctcatccttcttgagtttttccttcctgcgttttaaatatttaatttcccggagttccttttgtcactcgaatatccttctttcagtatgcacgcatcccactttttattttatggatgcgatattttctttttctttatgttgatataaatgatagggtttttttttttacgtttcctgcacattgtccatttcaaccaaattacattgctcttcttttaatcctttatactggatgtttgcctcatgttttgtgatcctgggctgtgtgtgtgtctgtgtgtgagtgtgtgcgtgtgagtgaagcactagaaagctgatctgagattctatgggtggaacctatcaactatggcttctgaacggtgaattgcttggacagttttccttagggaactctcactgtcactattctttgtgtctttcttcttggtgatgatcagattcctcaagaagataacttccaatctcctttcttgaggggtacctggcagccaaaactctaattaccaagttgtggggaagaaggctgtgggtctcaataatcaatgtgtaacatttcacttaatccccctgcttttggtttttacccttaatcatgcctgatagtttcttatcctcactttattttacactcttctagatcaaagcactcagtctttcagggctgtagagaaacagcgtcctgattgcttggtgtaggaaagatctgagggtgctaatttgtaaataggctttcaaccagtcctcttttttcagctctttgtctacttcctttccataggaagattgaattccatcaattcttatgcctttggaggttcttgatgtgacgtaagtgcagctgcgtctctgattttcccactgacagtttaaagcatctgttttctcaagtgtgttttgggagttttcacttgtctgcctccttttttgacaccaagtactgttgacttttcatcttccctatttgtccttgtgagttatggctttattatttatctgttttattgaggaatcacataaaatgcatatagtaccctgatcttaaatgtatagtttaatgatttttatgtatatatacagtagtcccccctaaccccttatccaagggagataagttgcaagacccctagtggatgcctgaaaccatggatagtgtggcacccaattgctttcaattggaacatgtttctgttcatatctcagccttttccatcttaactaaacacttgtcacatgctttgaccataagttttgcagtttgagggacaacagcaaaactggcactaatttctttttccttcttcacaatttcaggaatagaaaatatgttattaatggtagatcttagcaacctcagcatatgattttttttcttgttaagttgaaaactttaaccttttcacttgaaggaagcacttcacagcttttcagtgtatcaaaattgccagcatcactactgttgcactttggggccattattaagtaaaaagaattagttgaatccaaccaccacaatatcggaacagttgatctgataaccaagatggctactgtattagtccgttttcacactgctgtaaagaactgcccaagactgggtactttataaagaaaagaggtttaattgactcagttctgcgtggctggggaggcctcaggaaacttacagtcatggcggaagatgaaggggaagcaaagaccttcttcacatgatggcaggaaagagagagctagcaaaagctggaaaaactgccttataaaaccatcagatgttgtgagaactcactatcaggagaacagcatggggcaaactgcccccatgatccagtcatctcccacggggtccctctcttgacacctggggattatgggtattacagttcaaggtgagatctgggtggggacatcgccaaaccatatcagctactaagtgatcatgggaggggagcatagacagcatggatgccctggacaaaaggatgattcatgccccagggggcacagagagagacaagaggagatttaatcatgatactgagaatgtgcaatttaaaatttatgaattatttatctctgtaattttccatttaatattaatattttcagatcatagttgactgcaggtaactgaaaccacagaaaatgaaactatacataagtggggaccactgtacacccttgtagtcatcactcagatcaacaagagaacatttccaaaggccatgagattccctcctgtacctgtgaagtctgtagcctctacctataagcactattttgatttatgtcatatcatagaccagtttttcccatttaattcattcatgtagaatcatagtatgtggtctcaatatgaagtcttttgtatttggcttttcctcaaagaattggtgagattcattgatgttgcaggcaatcaggtttaaaattttttttctgtgtattattgcattgtatgaatgagtgagcatttgggttgttttaaggatttgctttttgtgaatatagttgctgtgaatattgccatacatgtttttggcatgcacatgcatccatttctcttggttatatacctgcaagtggaattgttgggtcattgagtgggtgtttagctttagtagaaactgccggttttccaaaatgttgtatcatttttcagctttcaccagcaaggtagaagagttccacttgtcttcacttagcactaatcagtcttttaaattttagccatctgttaagtgcctagttggtatcactcgattttagtttcacttttctgagggaatagtatgttgaacaccttttcagatgctttttaaagattttcttctgtgaagtgcctattcatgtatttttctcactaagaaaaatggttgttcctttttcataatctttccagagtcatcttagtgggatttggggaagcaacagggctgtgtggggtaacctgccacctttaagtggaaatcaggtaacaaagtttcattcactttttttttctcatttctgttttccccagtctatgattcaattcattttttattggctggatataatctggatttatattataatgaattttagaatgagactcttgtttcaaccataaggatgtatgataggaaactattataagaaaccagaacaagaaaattatttaatagatgtattctgatttattctcttatgtttttaaattaagatattttggaccaagagttttcatttatttatccattcatcaaatacatgttaagtgctttctttatgacagacctaatagtaggcttaaaggatagtataatagtgaacaaaacagagataagcgaggcacttgtcctcttaaaatatattcaggtaggagatacgaatcataagtaaacaatagctaagcaagataattaaatatgtctccaattttgcagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtaagcgaaagaaaaatgaaagcataatttgaaatacgtgtagactacatcatttttatttgttaatgtttatgtgtccagtataagtgcaaaaagataacgacaaattctactttgtttttaaatatattccatgaaattatgagccttgaacatgtttgtgtttgtctttttctttttttaaaaaagatatattaatagttttattttggtattaagtttgtgatgataaaacttgagaagagtggtcatccttacatttttaattctttatctgaagaagaaatctaataagtttaatttcgaaagggatttatgtaattcctgtggatgtatagctgtaaatattcacaaatgttgtcaagactcagctgagggtctgaactgggagagaccgagcccatggtccagaacagttgttctcaacccagggtagttttgcctccccagagaacatttgacaatgtctggaggcatttttggttgtcatactggaagttgattgctactggcatagtggatagaggccacggatgctgccacacattttcacaggacagccctcatgaacaaaaaaaaattatcctgcccaaaatctcaactatgccaaggttgagagaccttggtttagaagtcgagactgtggtgataatttaagatgtaattccaacagtccaagcagagaaatttaccagaatgcacttggtctaagagtaaagagtgctacataaagattgatgtcagggcattgctgtggatttagtgaggtactctgaagagagtggtccagtgacagtctcgttttaaaagattggatgtaggtataggaagatgagttcttgaaatgaggactcagtatacgttgaatataacaaaggagtttgcattgaagaaagatcactatttaagcaaaacagatgttttgtccacagtccaaataatgtggtttagtaatagcacagcttatctctattcattttctcttttggtattctctcctgttgattcttatgtagtttttatatgaagtcaacttgaaagttgtttaaagacaattcgaggcttgctagggatgtgtgagggagatactttgagggcattattgaaaggaaatatttgatactggacagaaagaatattgtgaatcctgtagattattttaaggaaggagccttaaggttacaaagagtaggcttattgattggggtttgtagtggcgggtgataaaagctataacagtttctactaatagtgttgcactgtaatgatggaataaaaaatctttgggtccttagcaactggagatggggtagtgaatggcagaaatactgtaccgtggttacattcactcatccattgaaatgacttgtactttaatacaaatttgtccttagtgcatttaattttgtttttaatctttctcatgtgtattttttgtcctaaacgaaaagtaaaattgcacccaaaatttaatttgagtctctttaagaggttctcatttgcttgtattcaggtatttgtagcagagtgtccttaaaaggagttaacatatgtgtttactgaatgtttttatccaaaaaaaaaaaaaaaatacaataataatccaactaaatactagaagttagatatttcctgtgctaaaaatcactgttaaaatcactattggtctaaataggaaattaagtttttttggttttaggtagatagaattctggaacttcaaaaaaagatttttcttttggttttagttttaataccaaatactttttaaacctgttaaatctataattacagaaattggacatgagattgccctctgaaaatgaaactgggaaaaatcagcctatggtggatgactcacttatctgtaatatcctgtcctaggaaaggtctataaagtgttggtttttttaaagacaatttggtgatattgcagttcaattaaggtgaccaggatatagataatctgaaagaaaccatggaatagtttaaaaaaaagaaaaaaaaaagaaaaacctttcctaagttttattttagaataacttttacaatttttttgtcaactctataccactgctattacttgctttatatttttactaaattgtcccacttgtcagttttatcttaataataactgaaattaagggaaatatgtatttttctcatacatattaaaataaataactactcaaatgttaaaagtttgtgggtaagactgttttgatgttgagcacagttatattttggtttctcaaagaatgtattgcattagaaataaattaggcagccaggatgtgagcttatgtctgtgtatgtactggcaagccgacctccgcagatgacattgcaggagagcttttgttattttgcttttaatttcacaatagatagataatccataaacattaacttaatctattctgttatgtcaggttctcttgggtttagtacaaaaaattattccatgttgtgagtgagtgctgaatttcttatttattcatttattttttctttgagacagagtcttgctgtgttgcccaggctggagtgcagtggcacaatcttggctcactgcaacttccacctcccaggttcaggtgattcccctgcctcagcctcccaaggagctggagctaggattacaggcatgcactaccacccccagctaatttttgtagttttagtagagatgggggtttcaccatgttgtccaggcaggtcttgaactcctgacctcaaataatccccccacctctccttggcctcccagagtgttgggattataggtgtgagccactgtgcccggcctgtgagtgctgggtttctaattaaaatacttgttcagcttctctggtccagactatatgtgttaaaatccaagctccactttttagttgttggttctgggcgacttaattgacctctctgtgcctcaattttcttgtacataaaatgacaataatagtaactgatttcataggattgttaggaggattaaatcagtaaatactattatttcagtaaatatttcaagtaaataatatctgaaaatagtttatttaccacaaaaggaatatctgatttcaataacgaaaaccttaatttactttgattattatttatttaaagctggagtcattattggttaacactaggctagttaaggccatcagctttaagattgtataattagtggagccatggcacatttagcacagtccttattgcagaaagatcagactagcaaatgattaattttcttggggatttgttgatgttgatgtttcttaaagccttttaaaatatgtttccaactttgaagtgtttattttctagtataacaattttattaaaacataaatgaaaatctagtttcatttatttatatgtatattttttttcttctaatgaatcctttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggtaacttgtgtgatcatctttagggtgaaaaaaatctactttaacataagcacttcagcttttagagaaattgtaataacctctactgtaatcaaggttaggagactgacagttcaccatttgtttgtgtgttcacaactacatgcttggaatttgctgtaatagtggttaagattgtgagctctagagtcaaattgcctgtatatgaattcaaactcttccacttaatgaccgtttagctcagctgttcctgatcttctctatactttaatttacttataaaatggggataataacagtgtccacttcattgggctgtggtgaaaattaaaaattaatacattaagcacttatatcagaacgagtagttatgctctgtgaatgttagctattgttttcaccactgttttattgctcagctggaaaagtgtactaatgggtctaaatggtgacatgaagataattttagctttagtagataggttatgttggacattttaaggggtatggttggcattctgaggaagaaacaggctttggttgagataattatctttgttcttgtggtaaatgaaggccaaataaaaaaataaaaagaaaatatgatttaaaatatgatcatcctggaactttccttatttggcatgtttcctctgcccacatgcgtacctgtagaaatagagtatttctgtttaacagggaacttgaatagagtattatggagagactttctttatatattgttgtagcaagagggaaaaagtatttttgattatgaatattgacagtcatcaggggttgaatgaggtgggcattataatagtataatcttttattctctccttcaatcagcagatacttggaattcattatttaaccagttactgtgttaagtgatgggatgggcaaagtatgagaacaggagaccacgaaggtgtgggggatgtgtgtgtgtgtgtgtgtgtgtgtatgaaaatataaaatcagcccctgttcacccgagaatgacctacctggtggtcaacaaaccaatactttagcatagcagcaattatttaacaaaatacatgatcagcatacagaagtgtgtagcctcattgtacttgtgaggaggaattcacaaaggcaggaatatggtcaaatgaaggagttcatcttcacttcactgtttactgagtgaaatgatgctcttaagtattcacagacctaatgtggaactatttctcccttcacccctacgttaactggacctgtattactgggctttaggaaagaaactaagcagacttttaggttgtatgtttattttctgtcttcaatttaattttttggtatttgtatgttatttttagcttgctttactgtcccagaacttcaactgtaaacataagctagttactagctataattttgactggtttttactcttaagcattcattcagcaaagtgtatattgtgcagaaaattaaaaaataaaccttccaataatgcataatgaaatggacatgagttttgttaattgcctttaaattcactttctcttgtacatgttaactaaaatttattcattaattaaatttaaatgtagctgcatctgattcaaagataacttataccaacaactgctataagttgtcttttacacgttgtcttttgaaacttacttaggcatatgctatgaaccaaagaactcagaggtttggggtttggtgatgaaacaaaagagaatcgtagagaaaaaagcaaaagtagttgttactgatagactgccaaactgacattcaaacaagtatgtcatttgagcatggtgtaatatagctggcagaaagccatctaagaaaaattctgattagagttaagcttaaacctttattctctaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggtaaataaaagagtaataagtgtgtgtgttgtcttctaatggtacctttctccagtttcatgtatttatatgatcatattcccatatactaaagcaaagcaacttgtgcattagtcaacaaagtgatcactggcaaaaacaattagaatcagttgtagtatttcccttttaaagtgtgtgttacttaaactattttaaaagatactctgtgtttgggggatagatttttttcccaactgtttgagagattttattttttttgagacaggatcctgccttgtcacccaggctggagtgcagtggtgcaaacatggctcactgcagccttgacctcccaggctcatgtgatcctcctgcctcacgctccacgagtagccagcattacagacatgagccaccatacctggccaagatatttttatatttgcattagtgatgcacatactttcttatttgttttgtgttattctctgccttcctatattcactaagagcttgggggctagatatgctactgtctttttttttcttacactgccatttttattcagtttcctgtttttttatggatgggcaacaggacagagatttgatttaaaaaaatatactgagtggtttcttctttcatttcataggctctgagtatgtaatatattctaactggtaaatttggattagagttcaggaaatatttattgagagctagaatgttaggtctacatagtggaaaaagtttaaatttcttgtctcaatgaatttactgtctaatggaaagaacagattagcaaagagatcatttctatccaatgtggctattagatagaagatgcagcctagcctaacagataagtgtgggtggatgagtggtatgggaagcagtgaggagccccctcctacaggacattataactaaaatgagtcttgaaggataaagaagagttggccttatgaatagcaaatttaaggggattctaggcagaagtggtaatataagcaagtatatgaataaaacagcattgtcttgagtatcataggcagtttagtattgttcattgctatattccacatggtaaatgctcaataattatctttggaattgatgaatatcacgtgaatattctacatttatttgcaaagtgtcactgtggtttatgttgaacatcttagaccagctatatgaggatactggaagtccaaaatggttccaagatatatattttacttaaaaatgttgttttaaaattaatcacaagaaaccaaagttgaagggtacaaaagagtatatggtaaaaaataagtctgggccctattcctgtccacataattatgtgtccagacacataatcttcccctgtctcctcacccctgcagatggagtctcactctgtcgcccaggctggagtgcagtggtgcgatctcagctgactgcaacctccgcctcccgggttcaagcaattctcgtgtctcaacctcccgagcagctgggattacaggtgcctgccaccatgcccggctaatgtttgtatttttagtagagatggggtttcagtttcaccatgttggccaggctaatctcgaactcctgacttcaggtgatccacccaccttggcctcccaaagtgctgggattacaggcatgagccagcatgcctgccctcagacacataattattaacttctgttgtccttctagatatattttatgcgtagttaaatacacacacacagagacatatataatatttaacataaatggtggcatgtaaaacataatgttttgttccttgcttttttacttaacagtatatttggaaattcttccatatcatttagaactttgtgttttaaaatttaatttcttgttctaaaaaaatcaaatgatattaaaaagtatatgcagtgaaaagctttagattttacttatgggtgacttttatcccatgtagaagttgttttgtttaatgttgtttttatattttatgtgacattctttgtgttactggccactttgattttcaagttattttattatattaatactatgaggtctgagttagcctgcatcttatttcttagaatgagttcatttagctttaagagtttgggtgttggcccaggctctcatcacagctgttcagttagcaaagtatagatatatgttctccatttcctcttaaatggaatagcagattattctgtgtttatatattccttcttgtttcaaattagacatttgtttgatctctgtcaaaaccagtttatgaattcatctttgcttactgattgagtcatttaacaaaaatcttttaatcttactgagtaccatgtgcacactaatatctagggatgatatctgtttgaaggaaatcagtctagtccagaaaagaaaaaagtcaatttaaatgatttgttaaatgccatattggacttatattggtatttaaatcttaccagtcaagatttatatggaccagaacagttttcaacttcatggcagttctggtattgtactttataagaccatactggtaactaggttggctggagatatttttcattaattttatctagtatttgttggcttcatatttgttatataatgcttacagttttccccctcttagtactaactcttcacattttgaaacatttttactgtttaggctaaagatacttcaagtgaagaagttaacctgagtcacattgtaccatgtgagccagttccagaagaaaagccaaaagaattacctgaatggagtgaaaaagtggctcacaacattttgtcaggtattacagtaatgttaatttttttccctgtatgacattaagcctttggaaccaaataaagatattgtttattagggaatactgagaaagataatattttgtattttggttttaaatgatcaatttagaaataaatgtagaaggaactagtcttttgaaacatcagatattgtcatataagtataaattcttcctggcctattattctgttctactattgggaaaatggatagtgaaaagcttcaggaatcttcaaattcttaatagttctgaatctaaaattagttatgttcgtttcccctttgaagctccctcttaacctccccctacccctgtccctcagctgtggtctgaatgtgtcccttcaaaattcatatattgaaatcctaacccctgaggtgatggttttaggaggtggggcctttggaaggtgattaggtcatgagggaggagccctcatcaatgggattagtcccttataaaagagatcccaaagagctgccttgtccctttcactatgtgaggaagcagtaagaaggtgtcattctatgaaccaggaagtgggcccctcaccagagaccaaatgtaccagcaccttagtcttgtacttcccagcctctagaattgtgagaaataaatttttgttgttaataagctactagtttatgatattttgttatagcagcacaaatggactcagatacccacccaaaaaatgagaccatgttcatccatctttggaagcaaagcagcactgtataaactatacagcaatgcagacatgagaacatctgagggttatagccaagctctttgagaagtagtctctgctgtttaattatggttataaagggcttcagatcaattattctgaagccagaatgatcattagtgacacatctttctactttaattggttaacatttcacatagctttttagctgtagtaactctctgatttataccttttattttgttttttaaaaaatattgccagtcaccattcagtgtgtcaaattcataaccccattaaatgggtcttgactcatttaaacgactgtcaattcagatttccatgtccactaaaatccattttaaaagatgtctaaagcagaggaaatcttcaacataaaaaaccaacaagctaaaataattagcttgctaggaactaataaaatacttttcctagtgccaaagaactatgcttgagacaagaaaaaaagatagagccaaattttaaaatgtagttgcgatagttaaaattgacttgaaagagatttacaaagaaactgcaatgaaaaatcttttcacttttactaccctaccccccaactttataggctgctaagcattattattaggaggccatcattcagaaaacttgcttgttaccccaacacactaaattcaaaggtcgttttcccaagtttttggaatttatacttgtcaggcctctgagcccaagccaagccatcacatccgcggtgacttgacgtatatgcccagatggcctgaagtaactgaagaatcacaaaagaagtgaaaatgccctcctctgccttaactgatgacattccaccacaaaagaagtgaaaatggctggtccttgccttaagtgatgacattaccttgtgaaagtccttttcctggctcatcctggctcaaaaagctcccccactgagcaccttgcgacccccactcctgcctgccagagaacaaatcccctttgactgtaattttcctttatctacccaaatcctataaaacggccccacccttatctcccttcgctgactctcttttcggtctcagcccgcttgcacccaggtgaaataaacagccttgttgctcacacaaagcctgtttggtggtctcttcacatgcacgcaagtgaaaatactgttacaagtttgttccatttactactgctatgtaacaaactgccccaaacccaaaggcacaaaacaacaaacatttgtttctgtggaattcagtgggccaggtatttggaaaggtcacagcaggagtggcttatatctctttcatggtatctaagggcttcatctgggaagactcaaaggctagctagtgacttgacaataagctgaagactggaatcattactgacacctctggcatctaggctgggagaggtcaaagtctaggactgccaaatagagtgcctacacatggcctcttgtggctggacttccacctagcatggtggccttaggctagtctggcttctacctagtgacttggggcttcaaatgtgaatcatccagcaaacagacagaagctgcattaccatttctgacatactcttggaaatttccaacatcatttggaaatttgttgttaaaagcaaacaacaagccagcccagatgcaaggaatgtgacatagaccccacttccctctgggaagaatgtcaagatcttgtggaaagattaacattcagaatagcaggcactgtttgtggtcatcttcagaaattttttcatcagctgccactaaatctcaggcctcctaggtactatagatagcacaccatggtgctaccggaagcagtacagccagttaatcctgggaagaggtctctttgtagatttcaaaagaactttcagcagtgcataattttaaaacaagcaaaaactgtgttctggtaacactcagaggacttctttattacttaagacctcagtttcttcgtgccagtacctcttttcctttttattctataccttcagggctggggttctagtaatgtcctcatagttggtaactgtaaactatttaactgcctatcagcgtatatgtctctttatgagctttttaataggtagaacgagtagttcgtcaaatgtttatggtacaagtaaaacaaaggggggcagaaaattaataaagatttactccagggaaaattatctgatctatcaagagactattgttacctgactgattcagtctatgtacaaaatgagtaaccagggatataaattgagctcattcatcttagcccataattggtgcctgtccactgtcaaagaataagtaaagatcactaaaagctagtctgaggttctcctaatgtaaaaggtaaaaaaagtaaaacaaccatgctgaaagtttacctgtataggcttgagaaacctagacttaacactttaagaaggcagcggctatgcagtatcaatcgagtagagcctagtaagctaatttggaaggaggtagagggttgctgacaataaactgatggagcccacctttggagcaatctaccttcaaccattctgaaacactttagtggttgtgagatagcaaaacatcatcaagggtatttgaatgtcccctctcaactccctagtctttcccaatttaatttacagatggactctggaatgctaggcaaacagttgacatggagtgagacggaatgatcactttctgcctacctattccaacatatcatcctagggttgagagtgagcagaacggaggcaactatgatgcctccctaagatttctccaagattatgcattttttgctaccattttgtgcttctaggccctagcaaaaacttttccattttggttaattcagtctgttaaagaatagacaaacaagtcctcctattcttcagtagattatttctgggactccattggcctagtacagtcttccagctgtcagatccacaaagacctttattctggcataaattatatagaatgaacaaaacatcaaagagcaatcatatattcaatttatactttgatgggtatagggtggttaagtgctaagacaaatcatttctaggtttttagaggactacgtcaaacataagatacatgtcatatgattggaaattcagtagtagccatgtgctagccaattttctgccaattttccccctctcttagccagaaataaagactatcaaaagctgaaaataaaaagatcagtgatcagtgttttaaactcatatttctcatgataaaaattattaaaacttaccagaaaagttgggttctatataatcttagggttcagctagctttttaccaggagagaaagctgtgatttgggacttctgtgtttttgtgttttgttttgttttgttttgagacagagtctcgctctgttacccaagtcggagtgcagtgacgctatctcagctcactgcaaactctgccttcagggtttaagtgactctcctgcctcagcttcctgagtagctgggactacaggtgcacaccaccacacccagctaatttttgtatttttagtaaacacaaagtttcaccatattggccaggctggtctcgagcttctgacctcaggtgatccgcccaatttggccttccaaagtgctgagtttcatgcacgtccgtgtgaagagaccaccaaacgggctttgtgtgagcaacatggctgtttatttcacctgggtgcaggtgggctgagtccgaaaagagaatcagcaaagggagataagggtggggccattttataggatttgggtaggtaaaggaaaattacagtccaagggggtttgttctctggcgggcaggagtgggggtcgcaaggtgctcagtgggggtgctttttgagccaggatgagccaggaaaaggactttcacaaggtaatgtcatcacttaaggcaaggaccggccatttacacttcttttgtggtggaatgtcatcagttaaggtggggcagggcatattcacttcttttgtgattcttcagttacttcaggccatctgggcgtatatgtgcaagtcacaggggacgcgatggcttggcttgggctcagaggcctgacattcctgacttcttatattaataagaaaaataaaacaaaatagtgttgaagtgttggggcagcaaaaatttttggggggtgatatggagagagaatgggcgatgtttctcagggctgcttcaagcgggattaggggcggcgtgggaacctagagtgggagagattaagctgaagggaggtcttgtggtaaggggtgatattgtggggttgttagaagaaacatttgtcgtgtagaatgattggtgatggcctagatacggttttggatgaattgagaaactaaatggaataacagaaggagaaaaacaggtataaaaggtctaagaattgggacgactcaggatatctgattagagagcgcctaaggagattcagcatagtcctgccagcaaagattatttatttacttcaagagttaagagtggcagtttggggacagcaccaggagatatcagctgtgatggcttggaaaaacagtgtaaactggcagtgtaaacaagagcagggcatgtatgagtagttgagaacggtgaataggagtatgagtagacagaagatagtagggatgacaggttttctggggcacagtctaagttggtctggtgtctcgaatgagactggggcctaataaggagcgtctgtacgggagcttaaatgggctgtaccctgtagcattccgaggacaggcctgaattctgagaaaggaaagtggtaaaagtattgtccagtcctttttaagttggtggctgagcttggtgaggtgtgtttttaaaagacctttagtctattctacttttcttgaagatggaggaccgtaagggatataaaggtttcactgaatactaagagcctgaaaaactgctggctgatttgactaataaaggcttgtctgttgtcagactgtattgaggtgggaaggctaaactgaggaattatgtctgacagaagggaagaaatgactgcagtggccttctcagaccctgtaggaaaggactctacctatccagtgaaagtgtctacctagactaagaggtattttagttatctgactcggggcatgttgagtaaagctaatttgccagtcttgggtgggagcaaatcctcgagcttgatgtgtagggaagggagggggcctgaataatccctgaggagtagtagaatagcagatgtaacactgagaagttatttccttgaggatagatttccacgatggaaaggaaatgagaggttctaagaggcaggctagtggcttgtactatagcatagcctgcctttgctggtgtgtggcgattaggcctggtggaactgccatcaataaatcaagcgtgatcagggtaaggaacaggaaagaaggaaatttggggaaatggggtgaatgtcaggtggatcagagagatacagtcatgggggtcaggtgtggtatccagaataatgcgagaggccggattggagtctgggccaggaacaacggtaattgtgggagactcaacaaagagtgagtacagctgaaggcgccgggaagcagaaagtatatgcgtcaggtatgaggaagaaaatggattttggaagttatgagaactgtagagagtgagttgagcatagtttgtgattttgagggcctctaaaagtattaaagcagcagcagccgctgcacgcagacatgagggctaggctaaaacagtaaggtcaagttgtttggacagaagggctacaggatgtggtcctggctcttgtgtaagaattctgactgcgctaaccgtgcttaggaaggaaaggagttgttgttttgtagaaggtgcttgggtttgagagatcagtcagacagattggcagggagagcacgtgtgtttttatgagaattatgccgagataggtaacagatgaggaagaaatttgggcttgattgaagtaatgggggctgtctgagaagctttgtggcagtacagcctaggtaatttgctgagcttgatgggtgtcagggtcagtccaagtgaaagcgaagaaaggctgggatgaagggtgcaaagggatagtaaagaaagcatgtttgagatctagaacagaataatgggttgtagaggcaggtactgaggatatgagagtatatgggtttggcaccatggggtggaaaggcaaaacaatttggttgataagatgcagatcctgaactaacttgtaaggcttgtctggtttcaggacaggtaaaatgggggaattttaaggagagtttataggctttaaaaggccatgctgtagcaggcgagtgataacaggctttaatctttttaaagcatgctgcgggatgggatattggcgttgagtggggtaagggtgattaggttttaatgagatggtaaggggtgcatgatcggttgccaagaagggagtagaggtatcttatacttgtgggttaaggtggggggatacaagagggggacgcaaaggaggctttggattgggaagaagggtggcaatgagatacagctgtagtccaggaatagtcagggaagcagataatttagttagtgtctcagcctaataagggaactgggcaggtggggataactaaaaaggagtgcttaaaagagtattgtctaagttggcaccagagttggggagttttaagaggtttagaagcctggccgtcaatacccacaacagttatggaggcaagggaaacaggcccttgaaaagagggtaatgtggagtgggtagcctccgtattgattaagaaggggacgggcttaccttccactgttagagttacctgaagctcagcgtccgtgatggtctagggggcttccgaggcgatcgggcagtgtcagtcttcagccgctaagccgagaagatctgggaaggagtcagtcagagagccttgggccagagttccaggggctctgggagtggctgccaggtgagttgaacagtccgattttcagtggggtcccacacagatgggacggggcttaggaggaatcccgggctgcgggcattccttggcccagtggccagatttccggcacgtgtagcaagctcctgtgggaggaggttctggaggaacgcctggccactgcggttcaggcgtttggaagttcttgtgtgctggagatggggctggggtttgtctcacagtggaggcaaggaattgcaacttttttctattattgtacaccttgaaggcgaggttaattaaatcctgttgtggggtttgagggccagaatttaatttttggagttatatttaatgtcaggagcagattgggtaataaaatgtattttgagaataagacggccttttgaccttttagggtctagggctgtaaagtgtctcagggttgttgccaaacaagtcatgaactgggctggatttttatatttgatgaaaaagagcctaaacgctatctgatttgggataaagaaaaatgagcattaaccttgactatggctttagctccagccacctttttaagagtaaattgctgggcaggagggggagggctagtcacagaactaaactgtaagccagaccaggtgtgaggaggggaggtgataaaaagattatagggtggagtagcagaggctgaggaagaattgggacctagctcggcctggcagggagtagcctggggaggaagggagaggtcagatgggtctgtagaaaaggaagattagaaagactcagcgacgcttggtgttgggactgaggggacaggcgggagggaaagaaggaagatttgggacgagttgcactgggcacagactaggaagggactgatgtgtaaaagaatgcctggacgtcaggcacctcagaccatttgcctattttacaacaagaattatttagatcttgtaggatggaaaaattcaaagtgccattttctggctatttggaactactgtagagtttgtattggggtcaagtggcattgcagaagaaaataagacatttaggttttaggtaaggtgtgagttgaagaggttttaagtttttgagaacacaggccaagggagtagaaggaggaatggagggtggaaggttgcctatagtgaaggaagcaagcctagagaaaagagagagcagagaaacggagggaaggggttcggggttcttaccttccagaaaaggggttggggcgcagagataagaggtcagggcgtggaaataagggatggggtgcagaaataaggggtcagggcatggaaataaggggtggggcacggaaataaggggtcggggcacggaaataaaggattggggcgcagagttaagttagggcacagaaataagggattggggcacagagatataagaggttggggcacggaaataagggattggggcacagagatacgaggttggggtacttgcccctcctctagaaaagcaggacttgctgctaagagtgaaggagaaggggttgaggggtacttgcccctcccccagaaaagcagagaaggggtagagacaaggagaggaggggttggggtacttgccccttccccagaaaagcgggacttgccgctaagggtgaaggaccaaggcaggcatccctgcgtggtctaacacctttgaaacgtgggtgaataatcagagaggcatccctgcaatgattaaaggtcaagggaaggctgccttcccagtctgtgactggcaccggagttttgggtccacggataaaacgtgtctcctttgtctctcccagaaaatgaaaggaattgaaattaagagaagggagagattgaagtgtggcaccaagattgaaaggagaaagaggtcgagggatagtgagggaggttggagaagagagtaaaaagaggccgcttaccggatttgaaattggtgagatgtttcttgggctggtcggtcttaggacctgaggttgtaggtggatctttctcacggagcaaagaacatgacaggggattgatctcctaagggaggtcccctgatccgagtcacggcaccaaatttcatgcgcgtctgtgtgaagagaccaccaaacaggctttgtgtgagcaacaaggctgtttatttcacctgggtgcaggcaggctgagtctgaaaagagtcagcaaagggagataagggtggggccgttttataggatttgggtaggtaaaggaaaattacagtcaaagggggtttgttctctgtcaggtaggagtgggggtcgcaaggtgctcagtgggggtgctttttgagccaggatgagccaggaaaaggactttcacaaggtaatgtcatcacttaaggcaaggagtggccatttacacttcttttgtggtagaatgtcatcagttaaggtggggcagggcatattcacttttgtgattcttcagttacttcaggccatctgggcgtatatgtgcaagtcacaggggatgcgatggcttggcttgggctcagaggcctgacactgtgattacaggcgtgagccactgcacctggtcagtgacttctgtttttaataacaactgtaaatggtagctttctttagttcagtaaaagtggacagtgtcccacaagctgtagtagttaggtttgagttagggaattttaatatctgccaatgtctcatttattcagcaaacgttcatggtctgccatatggcagcattaatacagtgcataggaggcaaacatgaacagaatcaatctatatctggcattgtacatgccatttaaaatatctacatagctaccgatgaaatattgcatttccttatcttctgttgcagtgtttacagttttaacatatttatgtatactgtatacttccatggtgatatgtgattatttgcatctaatatttctctttattagtgctgtgactttttatctcatttccatttatttttctcagtcatcatttgacttcatccctgttatttcttataatttcattataggattatagtctcctttgtttcactgtcatttattttatgatttctcagtcttcatgttcagctggtttcttcttaaaacttttcaacctataagttaatctaaaaagataatttttttaaatgggcatcttcaagccttttgttgtttatggaagcctgtttgcttgggtttgaatcctgcacttccccagaagttgattgtcaggtaggacagtgggggtaggattggagctggaggtagagatgttgactaaaacaggaagagaaacataaaatttctaattatttattacatgtcacttttcattgttaacattttaaaataaactgctgtggttttcacatgattgctggatgcttattcatgggctggagtaatcatgtaaaaccatgccacagaccttgagagaacataattaagtatttcatatgttcagctttgaaagctcattgttaagtgttagccaaaaaagaaatattttaaattgaaagtctctgcagagtagggtaatacttcttccatcttaggggacactgttcttacatgttttttcttttcccatccctctcccactcctttccccacatttccactggctgaggaccttttgtcctcactagagaaggcccttccatccctctgttcctctggtgagcacttctgtcattcaagctgcgagaacataagcaaagcaaagcaaagggctagggcccactgtcatgagaaatggccaaattatctgggcctcactcttcttcttttagattttctctactcatgcatttgagtgttctcatgtttttgtcattcaggtatgtgtagcaagctaaacggtgctgagatccaagagtttgggtttaggattcaggaaggaacaggaccccctgactaaagcttttagcctaaagaaagtaagagttctgccttggtgtttgagaggcagtttctttggtttccattttgtgatgtttctgtctttctccctcaagatttcatggggaaaagagatgcctggcctaaggcaaaaagaacaagaatatctgggttctttggccaaattctatcttaatggcaccaaaactaaaaattaatacctaacagtaatatactgtggtaagtaacatatagagatactgtttgtggtcatcttcagaaattatcagctgccactaaatctcaggccttctaggtactaggtagtggcagcatagagtaacgcagaactgtgtcactaagtattcaggaagaaaactgcaggtataaagttagcttgaaagtttatgacatggcacatttagcatctgaatatcaaactccttttatttttttctggttgatgttatttattaaagtgttcaaaagcataattagccctaatattgtgcaattttaaattttcttttaaaaaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctgggtaaagtaattctagataactttactttttaaagttatatttaaaataatgtcttaatccagggttaatctgcatgttcatttagatggtttaatctcaagaataaagaattaggacaaagcagtttctctttgttattcatagtgagacctgcggaccagcaacatcacatcgtcctatctggaatccttagaaatgcagaattttagggacagacacacctactgattcagaatctgcattttcacaagatccctaggtgattcttatttgcacattaaagtttgagaaactggttaaagggttgttctgatgtgttggagaggagaatgtgtgtatctttgaaaaagagttctgaatgtaaagtcatgtattgtttaacgcaggaggtaagttctaagaaatgtgtcattaggtgatttcatcattgtgtgaacatcatagcatgtactcacacaaacctaaacgttgccactccacacctaggctatatgatatagcctattgctcctaagtacaaacctatacaccatgtgactgtactgaatactataggaaattgtaacacaatggtaagtatttgtgcatttaaacacatctaaacatagaaaaggtgcagcaagaatgcagtatataaaagataaaaaatggcataaaaactgtagagagcacttaccagaagtgtcacttgcaggactggaagttgctctgagtgagtcactgagtgagtggtgagtgaatgtgaaggcctaggacattactatacactattgtagactttttaacactgtacacttgggccacactaaatttattttaaaaacaaagtaattgcactatgatgttatggcggctgtggtgttactaggcagtgggacttaatcagctccattataatcttatgggaccatgaaatgtctgaaatgaccaaaccatcattatgcagcatgactggatgtgaatccttgagtccttctaagggatatgacacattctttcaaggagagcagtttactgcttagcagttgagggtcaagagggagggatctgttgtttgagaaaaactgacttagtgattctggtgccaaccttcccaagcaatgtacttctaaatccttgctcttagagaatcacagcactgaaatttggtgttttgaggtgggtagataggaccttaatggattaccattaaatttagtaaaattatcttttttggtatttagtattttttgaatcagattttagattgtttacttttattcaccgagataactgagatatttatcagtagaaaaatatgaatacgctaagctggaataagctaaaagtaccaaccaatcttgcattgcaacagtcagatagaaaaggtggctggttttctcaagcagaagtgcaagagcatgtatatctgagaggcaaggttataaacatcagtaggctctgcaagcacagctttaaagcaaacaaaagctttcatttaaaaaataaccagtctatgcttcatgcctgtagtcccagctactcaggaggcagaggcaggaggatcacttgagcccaggagtacaagtcaaggccagcctgggcaacatagtgagacctcctctctaagcttcatatccttaagaagaaattgtaacattatatagtaaaacaatttagatgttcatttaagaatgttgcaagatgagtggtaaaaatcaagggaataatatatttttcctaagttttctttttttatggtcatattagttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggtaacaaagggcccagaattttaactatgaaggtccgtttgctttggactagatttacatcgttttaaatattatttttacaggattttcaactgtctggcaaggattggaatgtgcagctaaatgcatcgttaacaatgtttcagcagaaactgtacaaactgtcagatacaagtaagttgaattttattttaatgactaaatctctgttttgttgttgttgttgtttttctgagagggagtttctcttgttgcccaagctggagtgcaatggcgcgatcttaggtcactgcaacctccacctcccaggttcaggcatttctcctgcctcagcctcccgagtagctgggattgcaggcacacgccaccatgcccggctaattttttttttttagtagaaatggggtttcaccacattagccaggctggtctcgaactcctgacctcaggtgatctgcctgcctcagcctcccaaagtgctgggattacaggcgtaagccaccatgcctggcggactaaatctcttgtagcatttgtaaaaacccatgacggtcaagatatttttattaagtatctgataaaataatttttttcactcactgcttttcttaaatagggagaagaatagtatttctagtataataacagaattcttgtcactttgctttatgttactaatcattataaacatttgttcatcattactgtgaagaataaggttattttttttaaaagcctggaatttctgtataccttattaactgactacatgtttttgatgggtgatatctgcctgaaaaaacttgaattataattaaactcttataccccatgttaatattagcccactcggtatacagactgttaaaaattatgtcacatcttacttgactctgattaccactgtacatttgtattggaatgggtagatggtatatcttcaatttcatatattaagaaatggacaaacagaaatgaatgatttgcacaaactcacctgattagtgttatgattgctttcttatttggccttaaggtctgtctctggagagtggctataaattctaatcctgctgtgttgtggctcaagaggaaaaaatctcgtgaatgttttcagtgtgcgtttcacaggatacttctttatcctggcacacccatgaccaggtgtccctctctcagggaacttgtttatggcagatgcccttgtggctcttttctgacctgtgtccagtttattcctactaagatagctactctctaggagaccctgactaggaggagagcaaggtttgggtgtgttggtcaggtgacacacagagaaggcagcacaaccaaacacacgaaataacagaaactttttattactcacagacccttgagagaagagcggtatgcatgagggccaacaggaagtctggagatagcagagtgctcaaccagtgggtggggcgagggtgggtgaacaagggagcacgagcaagggagaggtgatttgtgtgactgccttcacgaaagtctatgggtgttcttcctttggctttccagtggggcctgtggattgactagtttaaagaaaacaagtgtgaacaggggaacatttacatggctctagttttacatgactctagtgttgaccattggattttctcgtggtcagcagctgtgggggtgtgttgggttttgagtcagtgagatgagaaacaagtatactgtattgcagacaaccgcatgggggagagagaagttttaactaggccaaaggtggtgggatacaactaggtttcaagcaacttatgtcaggcctaaaaataaatgctgaagcaacaactatataacaaatttatacaagtggtattgaaggtgagagtaaagcagggtcttctgcttttagctccttattctttctacctgactctactttctttatacaatactagaagaatcaaggtctaaaaaataaatctagtatgaaggacctgagttgctttcttagccttgaattagtttggatcttactatttatttagaaagaaaaaagaagagcaatattgatagtattcacaactcgtggttatttatgttaattatccacttattgacagcatttagttgagttcatacttttgtattaggcactgtgatcattgcttttcctacgtattaattaattttcaacactgttatctccattttgcagatgaggaaaccgaaatgtaaagttaaataccttgttaaagattactctcctagtgaatagtagagctgggatataaaccaagtgtttctgtcatcagaacctgtgctctacagtgctaatttaatttccatccttaattggttcgatctgctccgtctggggcatgaatacatttgtttgtttgttttaagataggaagtaggaattgctttatttttactttttttataatttcaactattattatagattaaagggtacatgtgcaggcttgttacatagaatttgttgtgtgatgctgaggtttggggtacaaatgatcccatcactcaggtagtaagcatagtacccaatagatggtcttttagctcacactcccctcctccctccccggcctagtaatccccagtgtctattgttgtcatctttatgtccatgagtatccagtgtttatttcccatttataagtgagaacatgtggttttctgttcctgcattaattcgcttagaataatggcctccagctgcatccatgttgctgcaaaggatatgatttcatttttttagggctgtgtagtattccatggtgtatatattagcatgttttctttgtgcagtccactgttgatgggtacctaggttgatcccatgtctttgctgttatgaatagtgcagtgaacatgtgagtgagtgcatgtgtctttttgatagaacagtttattttcttttgggtatcaaatggtaattccattttaagttttttgagatatctcccaaaagtggctgaactagtttacattctgggacatacatacctttgaatcaaatcaaagcaatgtggcatatcattttggagtgtcagttttttttttttttttgagacggagtttcactctgtcacccaggctggagtgcagtggcgcaatcttggctcactgcaacctccgcctcccaggttcacaccattctcctgcctcagcctccctagtagctgggactacaggtgtccgccaccatgaccggctaattttttgtatgttcagtacagacagggtttcactgtgttagccaggatggtcttgatcacctgatttcgtgatctgcccacctcggcctcccaaagttctgggattacaggcgtgagccaccacacctggccagagtatcagttttaccaagagttgagagataaaacatacaatagatctcaaattcttctgatagaaatatgaaactcaagtcttccaactcacttcttgtcacctgtggcctgaactctaatattcattcattgttttatgaccctgaggttactttggatcagtcataattagaaaaatagttctttatttgtagcaagaacaggagaaattcagaaatgcctttcaggccaaaagtgaattatttttagattatcatattagaaaataggaagtgctttgttgggttttatggcctactctaatgaaaaaaaaaaaaaaaaacttacctaactacaattagcttattaaaagtttgggattcacataactaggaaatactggattttaatgtagattttgtacttctggtccttaatgagaacttaatatgataaatagcatatttttaacagtgattctcagctcatttatttctattgtattattgctattctttttatcctttcttccaaagattcatggaatttaaataaaaaccaggtaagtgagaatttagttaagtagctttgtatttctaactatgaggatgattcagtcttagcagtaatttagtttctgctattagaaatttagaaggatgggagaggcagtagggaataaaagattttatctaagtaatactgtttctcacctttggagctaatctggcccaaagtagaaaatgtcttttaagagaagaaactaaaagtattgaaccagtaataacttagtgatagaactgaagaaatggaaaagcttgttgtacctttgtttaattttgttcttatttgtttacatacacttaggtttatttacactcttctgtatttaagtttactatcaaaaagtatttgatagaatgaccatttgtggagtactcaaatcgaactgatggtagtataataagggaaatttgtgttcttaattgcctgtgataagcgattgctctccaaaatagttattttaaatgtcctttaattttatgcttgggagaaaaccaaatgtattatataaacttccttatctgatttcaggtggataagccagtacaaaggattaaataactatactcttaaaatttttagctaaatgcataaaaaatattcattaagattcagtttatttttgtcagttacattaatacttttgtcttatatttggggatgtgaagacatacaggaataatgaaaaacaataagtaactttaaacctgctacacttaattgcggtatagtacctattcaataattcatcattctacatatgaagcttaagtttcacctttaagcttcttttattccactttaaagtgtttaaagaataataatatagctttgatagttagatctatttttattttccccagcaatattttctttgaatatatatttgtggaacataagcttaataatagactttttttcctgtagaaaatttactgttttatggtttttggtactatgctatagttaagtgtagctgatttattggtttgtttagtgaaatttaattaaaattcctcctaaatttgcactggatgaaggggtaacttcaatgacaggtgtcatattacccaaaaccagttttgtataactgaacacattggagaaatttcagaaaaatctggttcaattgtagttttgaatctcgttgacttatttaggcctacttcacattcattttttattatttttcaattggtagtgttagtatataaaatccgacttaatgagctctaattaaagtaaatttgtttaaaaataagagatcaaaaataaatttaacttcctcccagacatatgctttctaggagtttatagcagtatagtttgaatctgaagaaaaggactaaacagttatttatgaagaaaagaacatatgcctattaggaaaactagttctaaggcatattggaaagcaggagtgatagttgaggatatattaaaaaataaatacaactgatgaaaagctgttttatagtatatttaaaaatacatgtttagtattttagaattttaaaactgctttcacacatatacatcgtttttttgagataaagaagagaaagttgatgatatgtaaagaggtagaaacttgaccaaggtcatatggctagttactggcatagttggcattagaatctagttttctgaatattctgtttttttttcccaaattaataggaattgttactgacattggagatagcatagaaaaacagacaaaattaacaaggtgcaaaacaaattcatttttagtacgttattaaagacaatgtagtttttagaactgtgttacatacagaaatatgagtgcagctggaggtatcaaactgtatcagtggaatagggaacattccaaattctcagaagtggaagtttgtgaatatggaggatttcctatgcttgaaaacatgactgtgagttatgttgtgagttatgttgagttatggtgtcacttcattgtagctcacatggttctggaaaaataagccctcagggaaaccggctccaccaagagttacggtcactgtttttcagtgctgaaactgctgatacctttctttttgtatagacacagccattaccacctgacagtagtatttgttactggggcttggttgacaatgagaaggcaccatcagcaatggtgcatctcctgcactatcagcaaatcctgtggaatgctgaggggttgcataacagggactgtccgaagcagttgtaggaagtttttctgtctgttgactggtgagaaggcccccaattaagagtagtacagacttggaaggtttgacagactaggctctgctgtgtgctagctctaatataattattaacattaggcaaaggacagaatagaatcatcctttaggggcactataagattatttcacactggggttaaaaaagccaagcacaaacaagccggtgggatcacaaaccactgttctaggccaggctatttagtaatagaggacttgttaattcaaaaggcagatctagtgttatataagatgtccagatataggtcataaagcatctaggaaacttcactgtgtcctggagaaaatgtaaacttttgcctctttgttttgtttgttgtttaaacagtcctctatttgggggaaatctgtggacaagaaaagctttaaaagcctgttaccaaaatggggtaaagagtaaaacaaaacagtagggaaatgtgttttggtgtgcctgtataggacctcaaattgtattttatcatagaaatagtattaaatgcagatattattattatcaataataacttcttttgtatatgctttataatttcccaagcacttgctatgcatttgatgctcaaaaaactctgaggcagatagggcaggaattactgatttcattcattcagtgaatattcattgaatatcaggtactattctcaatgtttaggatatgttaaaggacaaaggtaagattctcctctccaatagggtttacattctagtgagagaagcaagacatgaacagtgataattaataagttctatagtatgtagaaagtggtaagtaatgggagaaaaaaagcagtgtaaaggggaatcgattgtcaagaggtggaggtgggcatgtggaaaaaggcaatttaaacaggttagataatgagattatagttgagccaacttgaagaaggtgaggcagagagctatgggaagtccaagcagagagcagccagtacaaaggtcctaaggcctttgagtgcttggtgggctcaaggaacagcaaggaggccagtgagtgtgcagtagagtgggatgcaggggagaatgccatagaatctctgtttaaagattaactcaaattcccataattaaaagacatagccaaagtctggttaaggtagaacttgaaactacttacgtgactctagattagttgcttctgtgaatattttccctcatatttctagaaagggaggattaaaaaaagaaataatgactgattaatgacctgtattataatttacacttttatttttacttgacagtctttattacatcattctcagctagtctgagtttattttcacacactgtttttactaaaggagaaaatactgctttgtcacagagtgtgatttcattctctactgtgttttaagttattaattaaattgaaacctaagctttaattttgctttcaggggtaacacagtaatcatttgacttatttaatactaattcagaagaccttattttatatttattgtttcattgtatgtcctctaatctttcttttaaagatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaataaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgaggttgattaatgggtacgaaaatatagttagaacgaatttgttgtagtatttgatagcccaacagggtgactacagtcaacaataactttatacatttaaaaataaaagagtgtaattgggacgtttgtaacacaaatgaatgcttgaagcagtagatacaccctgatgtaattattataaatcgcatacctgtatcaaaatatctcatgtatcccataaatatatacacctaccatgtacccataaaaatttaaaaagaaatggaatggcaaataatggaacataaactttaaacagttagctttgaccagaggtcagcaaatatcctccatgggctaaatccagatgtccacctgttttcataaataacgttttattggagcatagctgtacccatttgtttacatattggctatggctgctgtctagttcaacgtgagagttgaatagttgcatcagagagtatatggtccacaagcctaacttattcactctctggccctttgcagaaaaagtgtgctgccttagtctatagaaaatggacttttcccaccattcactgactcattaggagataggcatcttctaaagattttttttatattgtgtaatgattgatatatagataaaattatatattacttgtaaggtatgatgaataacaacacttaaaaactcatcacacctaaagacatggaaagctgccaattacctatatgtatgttcttcctattttcttacctctttccccatgtcattttttattgttccttgccattttttaatcacacatgtatgttctccaaacatactgtttcattttttgaagctttctacatatagtgtctgaatgtgaagtcttactcaacttgcttttttgagtttatgtttaaaattcattcttgcgcttatatgcatggatggtttacttgctctatagtattctgtgtgagtataccacaatttaagtgttcattttcctatcagttgacatttgtttttagtttttgttggtagaaacagtacactcaaaacatccttgactgtcccctggtacacatatgcaagagactttatgcgtaagagtggagttgttggcttgtcaagttttgcaaaataatgccaggtattttccaaaatgatgatattctcttgagtattacttccctttgcaatgtttttattgttaatgtagcatatataaaaaagtatctcataatttt

SEQ ID NO: 37726 - DNA, 20139 bp, Homo sapiens
ccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctgggtgagggggaaggggccaggtgggcaggagggcgggagccaggccagagggtggcggctggccgaggtggggagacttgggccacgactcacggggagacacatggccaggaggatggaagaaaagccgagtggagaagagagtggtctgaagtttgggccatctgagccccgctttagcctcgcagataccatcctcacgtttgaattcaaggggaagggatggaggagtcatgcctccaccttgcagggggcttgggcagaaaccgagccctcgagagccccttcgacgagggtgtggggtaaaccagcgctggatcccggcgggttctctgcctcgctcgggtagcccagtgcactcctgcctccttggcgcggtgtaggaaaggtgaggatgcctgccgcgcggtgcccctcgtggtgacagagacactgcggaggtcgggtggctctcggagaaccttgtctcagtgccaaaaggaagctccctttgcagtcccagggataggtgggatgggggagatagagctgcctagggacccagccatcgcccccaggtaggtcaagtcaggataagaggagccccgaactccagaattcaccaagcagtcttctccccacagtttctaagttaattgcttttgctcaaatggcaagaaagcagttttgggggaagtttggatgaggctgtgtgaataaggattagtaaagaaagtatttcggttgtgctccattaaactacttaactggcaggagaaaaaccagccctcattcagtgacgatcacaccttatttcaacttaaatacaggaatgtcttgtgtaacacaggaattgtcaggtttgtaatttcgggtaacaatgagcaggaaagaattccaattattgaaaattgaagctttgacagcatccatttgaatggctagtttttcctggcttctgtggagacactggcgaatgatttagttcatctctgtgagacgagggggcagagatcaagtaagggaggctacttttgagggcatccttcaatgtccttgagtttctaatatgtcgtagtgaattgaacttaatctcacaaccgtgggtccatgagttgtttctatatttggcttcacatcaaaatcatctagggtgcttgttaaaaatgcagataccctcatttccaacatatattgtaaatgagattagaaaaaacaaggttagaatagctctttaaatatgcaaatcaaaggatatatatgtgcttgcttaggcaaataattatccgtaaggatacacaagaaattgataacagcagtagcttatggaaaggggaacttgatgccaggggaacaggggtagaagagaaactttgctgtaaactgtttcttacctctggacctgtgtattacatacacataatatctatttaaaatgagaaaattttaattatatggattctaaggcttcacaaatactaaatcagaatctcctggagttttggtccaaaaatctgtatttttaatgagcttatcagctaattcttatgtagccaacccattatttgacagggatttgggcctagataaccagttgttaaaatgattgaggcacatctgaaagcaaaacttacaaagtcactgaggaagctgttactcattaatagattacatcagtcaagtgttttttttttgttggtttttttttttgagacggagtctcgctctgtcacccatgctggagtgcagtggcacgatctaggctcactgcaagctccgcctcccgggttcacgccattctcctgcctcagcctcccgagtagctgggactacaggcgcccgccaccacagccggctaattttttgtatttttagtatagacggggtttcactgtgttagccaggatggtctcgatctcctcaccttgtgatccgcctgccttggcctcccaacgtgctgggattacaggcgtcagccaccatgcccagcccacatcagtcaagttttaactaaacttcttggaatggagccatttagttgtttgtttttttatcatagtgaggaatcagatatttcctataccccacgtaaaacctccccctttacactgggtattttttatcctattacctaataattattgggcagctgaaaggagccttaggagtcattatttcattcattcagcagatgtttattgagcgtctgctctatgctagtcaacgtgttaaggtaaatgaggttgatataatgaacaaagatgttctttgccatcatggagctatctaatgggggagacattaaaaataaatacataaataattagttacaaattgcataagtgccttctgcacaggaagcacactgggtgctgtgatagaaaataacaagagagaccttttttttttttttagacgagtcttgctctgttgcccaggctggagtgcagtggggtgatctcagctcactgcaacctctgcctcccaggttcaagtgattctcctgcctcagcctccagagtagctgggattacaggcgcatgccaccacacctggctgatttttatatttttagtagagacagggtttcaccatgtttgccaggctggtcttgaactcctgacctcaagtgatccgcccgcctcagcctcccaaagtgctaggattacaggcatgagccactgcacccagtgaagagacctattttaaataagggtatcaagggtagtgactttgaaagtgggaatttaggatgaggaagaagtagccacaggagggtagtaagggagtaacagtgttccaggtaggagaaagatcaacctgccaaagccctgagacaggaaagagtctggcctgatactggaactgaaagaaggcttttgtggagtgtagtgggtgaaggggaaagtgctgtaactgaagatggagtaatagacctgcccccttcccactccccgcccttttatatagatgtaaagtcctggaatgcctcagccaaacatgggaacatcacccattcattgggcacatcagattctgatctgaggaaatcaccttgtgtgctaatctacttctgtcttctctacctcttttttccatattgcttttataccttttgcaaaattaatgaagaaagaattagcaaagctagtagtcattactttctagagttgaacacttaaggaaaataggcatggtcttactgattcatcccattcagacaacacaaatcttgaagttgggtatgtcccagtgctataagtagccatatattgatttcccattcctaaatacatttgaacctttaaaaaatcaatttgtttcctgatttttatgatgaattctagaagtatattaatagccactatttattgagagcttaccatgtgtcagaccctttttttctgagtactttgcgtgcattataatcctcaccacaactttgtgagataagtcctgttattgcctccattttcttgattgaagaacctgagaagtagagtgttaaggaatttgccccaggtcccagagctactaggtggtagagctgggttatgaacacaggcagtctgacttccagagctcgcgttctctgtcattttgagataccacctctgtgtaatacgttcctttaaaattgaagtaaagtagatgccttcctgaagtttgtaaaggcatcctttgccaaatgtttcaagtttggatgagaaaaaaagctgggttcaatgtgtatgtgccacttacaatctagatttatgatcatgcctcttagtctccattttcccaaattaaatccatgtgatctcatctgcagtaccctctcaggcttcagttatgtcagttctccaatgggagacctcatctagctctgtcgcagttcaggattagactagataaagcccaaggtaattcccctttcctgaagcaatgtaaattccgtagttttagcctgtcctgttttcagcctcctggaattgcctcaagtgaaggcattactgttctatagcttttcattcactatgaaaaatggtcccaaaattatcttcagcattctaattgagcagatagcctcattgcaccttttttcatagtcaccaattgcctaaaataattagctattataagtgtccttcagttcctcctcttaataattttggctgctctttaagtttcttgacctctttttgtgccacagtacatgcagaagtgtgtgtgtgtgtgtgtgtgtgtgtgtgtgtgtgtgtgtgttttaattgtggtaagaagtacttcatatttgtttattattttctgatcagaagtttcgtgtacatgcatcacgtttatttttctttacaagcccatttcaaaactgttttcagacttaaagatttggagacatagaatatataaattgcttggcagaatgaattctaatgaatattagagattttacactatactcaattctttacttcattttgtagtacaaatagtaatgaaataaaagatatgacgtgaactctgtcctccaggaatttttctttttttgaggcagagtttcactcttgttgcccaggctggagtgtaatgacacgatctcggctcactgcaacctccgcctcctgggttcaggcagttctcctgcctcagcctcccaaggagctgggattacagacatgtgccaccatgtccagctaatttttctatttttaatagagactgggttccaccatgttggtcaggctggtctcaaactcctgatctcaggcgatccacccaccttagcttcccaaaatgctgaacaaacccccctcccaaagtaaggcatgagtcaccatgcccagcccaggagtttttcttaaaatattattttcctttaaataatgaatgtacacatataacatttgataacaatataaaacagattatgattaggtgccaaagtgagtgagtggtgcatgaactatgttaggctttgaaataagagaggccatggtgagctgagcatgtcagagaggctttggcaagagcctggagctcctggagggcaaggactctgtccccttcctatatgtccccagtggcctgttggagcaggtgttcagtaagtattgattatagaaatgattgagacttgaacttaagcttgaagattaagtaaaatttattcaaatctgagagaggttttttctgttttaatgccatctattgtgctttgtttttgatttttgttcactgtgtgaactgttttatactcatctaatgaattaatttaataatcattcaatttctttaaggcaaaatggaaaggaatatggcttacaaggccctgcgtgattctgcttttttaaattttctttttttttttgagacagagtcttgttgtgtgcccaggctggagtgcagtggcgcgtgcctcccaggttcatgccattctcctgcctcagcctgctgagtagctgggattacaggcgcccgccaccgtgcctggctaattttttttttttttttttttttttaatttttagtagagacggggtttcaccgtgttagccgggatggtctcgatctcctgacctcgtgatcctcccgcctcggcctcccgaagtgctgggattacaggcttgagccaccgcgcccggcctgtatttttttttagaagagacggggtttcaccatgttagccaggatggacttgatctcctgacctcgtgatccgcccgcctcagcctccaaaagtgctgggattacaggcgtgagccactgcatgtggcctgaccagtggttttcaaatgctctttagctgtgaaactcttccttgaaatgaaatcttctgcagatatgcatgtggaaaacaggtgaaaaggaacttttttgttaaaaaaaaaaaaaagaagaagaaaacaaggtggggtgaggtggcttatgcctgtaatcccagcactctgggaggccaaggcgggtggatcacctgaggtcaggagtttaagaccagcctggccaagatagtgaaaccccatctctactaaaaatacaaaaattaactgggcacggtggcgcatgcctgtaatcccagctactcgggaagctgaggcaggagaatcgcttgaactcggagggcagaggttgcagtgagccgagatcatgccactgcacttcagcctgggtgatagagtgagactccatctcaaaaaaaaaaaaggatgtaggccgggcacagtagctcacacctataatcccagctacttgggaggctgaggcagaagaatcacttgaaccccggagacggaggttgcagtgagccgagatcacgccactgcactccagcctgggaaacaaagtgagactctgtctcaaaaggaaaaaagaaaggatgtaaattcactcaattcatttttaatgttattgttggctccaagtgtttggtggatgaatgaataagtgaaagaatgaacaggctgggtgcagtggttaacccctgtaatccctgcactttgggagaccgaggcgggtagatcacaaggtcaggagtttgagaccagcctggccagcatggagaaaccccgtctctactaaaaatacaaaaaattagccgggcatggtggcgagctcctgtaatcccagctactcgggaggctgaggcaggagaattgcttgaacccgggaggcgggggttgtagtgagccatgattgcaccgctgcaccccagcctggacaacagagcgagactccgtcttaaaaaaaaaaagaaagaatgaataaataaggggatcttttttctatagtccctatctccactctatgaatggatgagatcctaagtgtaccttgatgcagttgaataggaagtgtggcgtgtagcttacaggcaaattcagtgatgatacaaaggatataaaggagaataaagtagggtttgtatcctgcaacttttgagttgtttttcaggtgtgaaataactgaggcccctcttcaaaaatctgtttagtaggaatgggtttgagctgatgatacatccatacctgccagctgtactcctgagtcagtgagcatgcgcatctgagaagacagcagtagactgggagtgcagtatgccagggtggcagagtcattgcaataacaagccaggcagcccagattggggttaggaactttgtcctcaatagcactgtgtgtcaaccaacaaagctaactaaacagaacagctcatctcaacagatgttcatgtcacatctcaggaccaggtcctttgctaggtgctggagttataaagatacataagaaactgtcctggttactgaggcaactgtagtctaactggggagaaggacacgtgaatagtttcaataccagggtactatgagaacaactataaaactttcaaattataaaccctagaagaaatgagttagcctttattgggcatgtattatgtcccagaccctgtgctacgcatgtgtcatgtatcgtctcttttaatcctggaaatgttatgaggcaggcagtgttattatgcttttttttacagaataggaaactatagtttaaacagtgcgtccaatagaactttctgcagtgatggaaatgttctagatctgcactgtccagtaagtaaacactagtcacatgtggctattgaatacctaaaatgtggttagtggaactgagggactgaatttgtgcatttatttaacttaaatagccacatgtggtcagtggtcaccatattggacagctcaggcttagtgttctcagcctctgcagtgttctctgtgatctggtcctccattacctctggtcatcttctacttcccctcctcacccattctaacttcactggcctccttacaggccttcagataaacctggcatgtcattgcccctgcatccctctttcccttgcctcctttaaatcttggctcaaagctgggcctggtggctcacgcctggaggtgggaggatcacttgagcccagtagttcaagtccaggcttgacaacatagggagacgccgtctcaaaaaaaaaaaaaaaaaagtaggcctgggtggtacacatatagtctcagcaactgggaagctgaagtgggaggatcacttgagcctgggaggtcaaggctgcagtgagctttgatcgcgttactgcactccaccctgagtagcagagcaagaccctgtctcaaaaaaaaaaaaaaaatcttcactcaaatatcacattctcaaagaggcccaccctgatcatccctgaaactcccttaacctactcttttttttttttttctttttttgagacaagagttttgttcttgtcgcccaggctggagtgcagtggtgcaatcgcagctcactgcaacacctcccgggttcaagtgattcttctgtctcagcctcccgagtagctagaattacaggtgtgtgccaccatgcctggctaatttttgtacttttagtagagatggggtttcaccatgttggccaggctggtctcgaactcctgacctcaggtgatccgcccgcctctgcctcccaaagcgctcggattacaggcgtgagccactacgcccagacccccttaacctactcttgttcgttctataccattcactattgctaacatgttatgacttattatcatcattattattattgactgtcccctccccccacctagtaagtgtcatgaaggaggtttttgtttactgatgtatccttagtgccaaggatagtgcctggaaggtagtagtcactcaataaaccattagttcaccgtttaagccagtaggattcacacccaacctgtctacaccagaacctgtgttcttattcactatattgtacttcctccttgtaagcgtagcattcctcacaaagtaaatgagaaaagcttcatttgaaaggaacaggggccaggcgcggtagctcacgcctgtaatcccagcactttgggaggccgaggcgggcggatcacgaggtcaggagtttaagaccagcctggccaacatggtgaaaccccatatctactaaaaatagaaaaattagccaggcgtggtggtgagcgcctgtagtcccagctacttaggaggctgaggcaggagaatcacttgaacctgggaggcggaggttacagtcagccaagatcacaccatcgtactccagcctgggcaacagagtgagactgtctcaaaaaaaaaaaaaaaaaaaaagaaggaacaggtaagagaaagcaggtatccttaatttctccagtttcactgaactattaaatgtcttcacgtaaataaacaaattgcagccatttaaacagctgatttataaatgacagttcagaagggcacatcagctctatttaaaatgcagtgttaggccacatagagtggctcacacctgtaatcccagtactttgggaggctgaggagggcagatctcctgaggtcaggagttcgagaccagcctgggcaacatggtgaaacccaatctctactaaaaatacagaaattagctgggcatggtggcgcacacctgtaatcccagcctgtacttgggagtctgaggcaccagaattgcttgagcccaggaggcggaggttgcagtgagccaagatcgtgccactgcactccaacctaggcaatagagtgagactctgtctcaaaaaaaggaatgttagtctccccattttacatatagtaaacaggaaagaggagatttagtatcttatagcccagtggaacccagggtttgaagatgctcgtcctaaatggattaccactcccctttggcatccagtctggttctcatcaaccactgtgaaatttcacctcagtttggataaggtcagaacctgcctcacattctttagggtgctatccccagaaacccctggctaggatccctctatccacttgtggtcttttttttttttttgagacagagtttcgctcttttcacccaggctggagtacaatggcgccatctcagctcgtcgcaacctccgcctcctgggttcaagtgattcttctgcctcagcctcccaagtagctgggattacaggcgcctgccaccacgcccagctaatttttgtatttttagtagagacggggtttcatcatgttggccaggctgatctcaaactcctgacctcaggtgatccaccacgcccggcccacttgtggtcttccgggccagagcagcagatctcttggtgaaaagcagactgatctctggaattggaacagaggcagaagtactccgctacatttcattttcttgttattccatttagcctgggaacactaacagcaaagaatggaattttacatgtaaaatagatatagcatttcatattaatttgctggatgttgaaatctgttcttagattttacttaccaatactgaagtagaattttttttttttttgagacagagtctcaccctgttgcccaggctggagtacagtagtggcacgatctcggctcactgcaacctccacctcccaggttcaaacgattttcctgcctcagcttcccgagtagctgggattacaggtgcctgccaccatgcccagctaatttttgtatttttagtagagacagggtttcaccatgttggtcaggctaatcttgaactcctgacctgtgatccgcctgcctcggcctcccaaagtgctgggattacaggcgtgagccaccgtaccttgtctttttttttttttttttttaagatagagttttgctcttgttgcccaggctggagtgcaatggcgcaatctcggctcactgcaacctctgcctcctgggttcaggcgattctcctgcctcagcctcccgagtagctgggactataggcatgcactaccatgcccggctaattttgtgtttttagtagaaacggggttgttgaccaggctggtctcgaactcctgacctcatgtgatctgcccgcctcggcctcccaaagtgctgggattacaggtgtgagccaccacacctggcctattttttgttttatttgagacagggtctcactctgttgcccaggctagagtacagtggcgcaatctcggctcactgcctcccaagttcaagcaattctcgtgcctcagcctcctgagtagctgggactacaggtgcatgccaccacacccagagagtttttttatttttatttttagtaaagactgggtttctctgttggccaggctggtcttgaactcctggcttcaagtaatctgcctgcctcggcctcccaaagtgctgggattacaggggtgggccactgtgacatgtctgaagtagaatttatttttatcttctggaagtctttacccttttccccaaggaggtcattgtacctaataagagcctccatttatcagacatctgtatatcacatactgtgaagctttctatacattaacattaccagtcacagcaactctgaactggagaaacagacttaaacaggctgggtaaacttgcccaagatccaccactaggaagtggaaaatccaggatctgaacccatatggtccccttaactatctctgaggatgctatgccaagtgtgtggtggctcatgcctgtaatcctagcactttgggaggctgaggcaggtggatcacttgaggcgaggagttcgagaccagcctggccgacatggcaaaatcctgtctctactaaaaatacaaaaatcagccgggcttggtggtgcatgcctgtaatcccagctacttgggaggctgaggcatgagaatcacttgaacccggggggcagaggttgcaatgagccgagatcacgtcacttcactccagcctgggcaacagagagactctgcctctaaaaaaaagaaaggcacagggcaaacagcgaaggtagcagttagcaatcagtaatctgccatgtcgccgtgtgaagtgataagcaggagtgagtgggtgatgtttgctgacactccacgtctttcaatgcccttcctctgcctcctgagcactgctgtagagtatctctcatggactcttgtgatggtctgcttggtctgctctcttccctccaattcatctgctatcccacaactacagttatcttttccgaacatggatctgatcaaggcactctccagcctcacagcctctttgagtccaggcctgcccgctttgctggccatcctgttggccgctcctccccttggcaccatcactgcccccttcactctgccctgcaggctttagacttcacagccatgcatgtgcacatcttgttctctcccacagaaatgtccatccctgcccttacttgtcattggtaatggaagctcacaaaagtagtttattatatttagtaccttatttttaccactatgatacagcatattaacattgtgttttagttaattatttgtgtgtctcagtccatttgactttgagcttctcaagggcaggaaagtgatacgttcctgtttgcatttccacacctaacattgtttctggcacatagaggtagaataacgtgctttaactatttaaatggatagcatttgcaaagttttatcctatcagtttctgaaggatttcacctcaatgaagaaatgagtaataacattcattgtattactatagtcttactgtacgtgagacagagaagttaaaaaggcatagctgaattgaccccaaagaggaaagaatagcagacataaaactggggtacctttatactagtgtttttaatcttgcattctgataaaagactctcattacttttcaacttacttacactctgtcacaacctaaagaccttactggaggggacttgcattcctagaaagtccctcaagaggtttatgacaggttaccctgggtttgagtgatgtcatgaatttaccaaggctgaggggccacttattctagtcccaagtggctaaatctcttcttctctccacagggaaacaactggaaggcatctggtaagttgggtgggtctccttactttgactagttttgaaacaaggcagcactctatgcatttcaggttctagtctgtggcttccagcatgaaacctagctctccatgctataaatcttcaagccctaaagcagtgcttctcatcagttcttttgctctctcaccctgggacatttggccatgtccagagatatttttggttgtcatacagggaggaggatgctactggcatcttgtggatagaggcagggacgctgctcaacagactagaatgcacaggacagccccacacaacaaagaagtatccagcctcaaatgtcaatagtgccaagattgagaagccctgatctgtggtatttatcatattcatacctttggtttgttggttttataagactggtccccacagtcctatccttgggcagaaattactctcattgcattatggtgtttgctttttctcaaaagtttaagttttctggcttactgtgtctctctctgtgtgacaggcacacatccatagttgtgcacaaggatgagttcttcttcggcagtggtggtatctccagctgccccccggtgagtgtcttcccctacactctgtcctgcagtctcaggttcctgggggctcctgtagaccaggagctttgcttctactatggacttctggcattgttcctcaaagccacctgaagacttggctcaataaaacctttcccagacaccccagccagttcctctcctctctgttcccatggcacgtgtgggtccttctgtctcacagagagcatgttatggtgaaatgagctgtttctggttctccacagggaactgtgtaagctccttgcgagctgagaccttccatctccatcccctgcacagtgtccggctcatcctaggaacgcaactgatgttaagctgaatgatgagggctctgagaagcatcaagacttgcccaaacttaaacagccaataagggacaccagtcctagaacccaggattatcacactaaagcccacacccttttccgaaaatttcttttttttttttttttttttttttttttgagatggagtctcgctccgtcgcccagactgaagtgcagtggtgcgatctcggctcactgcaagctccgcctcccgggttcgcgccattctcctgcctcagcctcccgagtagctgggattacaggtgcctgccactacacccagctaattttttgtatattttagtagatacggtgtttcagcatgttggccaggctgatctcaaacttctgacctcgtgattagcccacctcggcctcccaaagtgctgggattacaggcgtgagccacagcgcccagccttttccaaaaatttctatcagctatccaagtgttgtcacagtaggtgctcaagcaatggccaagcagccattcattttggttgtgtgtttgtttgtttttgctacatcctacaggaaggattttttttttttttttgagacggggtcttgctctgtcacccaggccagaaatgcagtggcacagtcttgcttactgcagcctccacctcccaggctcaatgaatcctcccacttgagccacctgagtggctaggactcagcaccaccacgccctgctatttttttctatttttttagagataggatctccctatgttgcccagactgatctcaaactcctgggctcaagcaatctactgcataagccagaattctcccattgcttttggaataaaagccagaaaactcagcatggcctcccaggacctacctgatctggtctctgactctgactctggccagcctcttttaggttgttccctcccaaccctcactctcttctcattctttgaacacaccgtagacattgaaacctgcactctgacatcagtacaccttcttgatccttcacctggttacgcctctccatccttcagatttgagttgtgtcactttctcaggcaagtcttccctgatccctcagaccgggaaggtctcctgtcatacgtactgttggcattctgtacttttccagcctccccttaattgcagctcataattatatactggttaaggggatttttcagtttcccttccctgctacactaagcttcttaacggcaagaatctcatctattttgtccacaccacagccccagtgcctagcataaggcctgacacataataagttctcaatccatagttgttatatgagtgaataagaggggtcaaagagtgaccttttagtttcttacaactctgagataattgttctctgcctaccatggttatcttgctcaccatgctttcctcagtgcccagaacaatgtcagctatgtaggaggtgctcagtggctatgaatgaatgatcttttcagggagctctgttctggagtgttatcccttcccagatttgttctcctgctgatcccgttgcttccccagtggctggtttccccactcaacctcagtctctccttcagttttctctggcagtctgttaaccacatggctgagggttttctgtaggcctttcgggagccattaactcccttgccctatgatggtgatagggcaaggattaggctcacagatccaaaaagaactgaattatggaaatatctgccagcctgccagatttctcaccgtcctcgtttttccattattacacgggatatcaagtatatcataagaaaaactggctgcatactttatgcaaataggcatggagagatggcctgtgaagtgtgagccatttctgttgtcctgttctgtcctcatgatgagacatactggggacaaaagtagacttcagattctgggtttctctttctcagctgagtaagtggacagcatcaggagtcagagctgcaagagaatcagcttcccagggccccccctcccctctagaaacaagaagtccgactcctaactatgctgccagcacatggcaatgaaaagtgaccagaaagctctaagccaagcttgtccaacctgcagcctgtgggccatacgcagcccaggacagctttgaaagtggcctgacgtgaatttgtaaagtttcttaaaacatgagatttttttatctttttttttttttaagctcatcagctatcattagtgttagtgtattttgtgtgtggcccaagaccattcttcttccagtgtgcctcagggaagccaaaggattggacaccaatgcttctaagctattgcatccttgatacaaatagcaaatcacattcttcatctgcccagggtgctctgcaagttaaatatgaagtcaggctgggcgcagtagctcacacctgtgatctcagcactttggaaggccgaggtgggtggatcacttaaggtcaggagtttgagaccagcctgaccaacatggtgaaaccctgtatctactaaaaatacaaaaaattatctgggcatggtggcaggcacctgtaatctcagctacttgggaggctgaggcaggaggatcacttgaacccgggaggcggaggttgcagtgagctgagattatactccagcctgggtgacgagagaaactccgtctaaaaaaaaaaaaaaaaaaaaaaagtcagaacagagtgtttgtggtctactgtgggaagccacattaaaacattcagtggagatggtaacttaatgacttcctttgggttggctcttttagggagggacattgcttgggcctccagactctgtggttgatgtggggagtacagaagtcacagaagaaatctttctggagtacctctcctccctgggggagtccctgttccggtgagtggagacaggggtggtggttagttgtgtctgtctccccagctagataataacccctggaggcagctgccatgtcatatcatccttatcactcagcacaaggcctggcccagttttttgctgaattaacatgaagaaaaggcagttatgctacaaaaagctctaagttgttctgatacagatattccttcaaacatactttctgccgaaatttttagaggaaataagggcttttcattccttctgattaaaatcggcaagcgctgttctcaacctgtattggccaagtttgcagaaggaaaaacagggtttgcagaagggttgggatgaaatacaaacttgagcagattttctctgaaagaggctttagtcagtttcagtaagggggtaaactcttaacaccagagttctgctttcgtgaatgtaaagattctcctgaaactgtgtaggagccatgtcttttcagtttctccttcccttaaaaatcagttattaatggccagaatggcaaataagcagtgcttttctggtgtatgagacgggggaaatcgcaatcctcacattgagctgtgctcaccattccactgcctagcttgagttattccacatagacgcttgctggtttctcatatatgttctgcaaacctttcaatgtacagaggtgaggcctacaacctctttgaacacaattgtaacaccttcagcaacgaagtggcacagttcctgactgggcggaagattccttcttacatcacagacctgccctctgaagttctctccacgtaagtgtggcctctgtccctgcccctgccttggccaaccttgaaaatccccattcacggtcagtgcccttcctctggcccccatctgccctcccaaccaggtgggcctgccctgatggcagattctaacacagaaggctgccattctctccacccactgatgcgcacctgtattacctccaccttcagagctagaccagctctgccctggcctaagtgcaaccacagaacttagacacccacttgacactggcttcagtacttgcacaaaattctggcgtctgtccttcccattgtgctcgaagcatgccactccccagaagcacccagttaaaatgcaatgttagacaagcagagagggggtcagaaaaatagtaggggggcttgttttgtagctgttgatttgccttacactgcaccatgaactctttgactccctcaacgactatgttctacttgccctcatgtattacagcacagtcttcaacagatgttttcttcaagaacactctgcagcccgttctgtcctgatgtgccccaagccttggaagagccttgcaggccatcatccaggcagtataccccgaaaggacacaacacccccaaagccatctcacctcctccctcttgtcgttgattgcattcaggcagcctctgctcattccaggaccatgtctatttgcttattctgactcagtttctcctgaactatggccttatttaacagagatcctggcaggtttcgcaggcccagcaaggtgggctgttttttatatctgaggaagcacctcccaggaagagcttgcataggaaacaagactgctgtggcaggctggtgaggagccccagtccgccagccctggccctgccttcctatcattcgatgagtttgcagtcccacagctctgctgagggatctaggttatggggccctgagcaaactggagtagccagaatgtgcttgctgttattattttatgggtggagttcctggaattgtctgaattaggtttgatatttctaggtttcatctgtctatactttggagtacttcattcctttaaacttggagatgattttcaaaaatggcagtatccactgaagaaaaagccagtgacttaaaagtttctgggcaaccttatttatggttgtcgtaatcatggaaaatctccaaactccagtatttgtagttttttttccatctgttactatgagagcaacctaggagccctttagaaaggcattaatggctgggcccagtggcttatgcctgtaatcccagcactttgggaggccgaggcaggcaaatcactaggtcaggagttcgagaccagcctggccaacatggtgaaaccccatctctactgaaaataaaaaattagccaggcgcagtggcacacgcctgtaatcccagctacttgggaggctgaggcaggagaattgcttgaacctgggaggcagaggttgcagtgagccgagatcacgccattgcactccagctctaggctagaggtagactctgtctcggggtgaaagaaaggcattaatactggcaacctagcatttgtcatttttccagaatattccctgtactccctggcagacctctgttcctgaaaaaaatccagttgtttgctgtcctcacccctttgtcttctttttcatatccttcttcttttgcctcagtttccctgcttaaatttgatcttttccttgctcacaagaattaaagacacaagcacatagagcacagaaagttctagttctctgtatgtagccagcctactcaaaccacagctaaccaggctctagaggtgaggccctgaggagggaaccccaggaataaaaatacagagcaggctatttcggagatgccctccaagaacactggtgtgtgaggcaggtgggaaacttaagtgaggtgacgaggtgctctttccttctctgctggtgctgcttctgctgccaccagcgcccactcctcctccctacccgtgggcagcacagggtgtgtgacagcaggccacatcccagagcccacccctctcatgtctctgtttccttgcaggccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttatt

SEQ ID NO: 37727 - DNA, 83398 bp, Homo sapiens
ttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtaaatgaaaattttaatttatttaattgatatgaatattcttttaaaaaaagaacataggacagaatggttgggtttttcttaaacttaattttaagtctaaatatttttagttacagactaaatgaaaaattctaacaatcataaaattgtatcttttcatcatctgctttaaagagacttccttattatagatatatgtcaccaaaaatatagatactcaaaagtaaaatcaccacaatccccaccattaccaatccattgtatagatttctcataagatatttagtcttctatgtatttgattatatatttgactgttagtcttttttatattgattatttttaagttatcacatctgtttttataattagctaagttaactataattatcagtgaatgtgttctagtcagttaaattttctggttaaccaatatgtaatgagaattttttatacttattgcaaatatttttaaatttatatatgtacctcagttttaattgataaaatatattgaagttattttatggtaccagtgtgggtaaatccttacagattcaaggtaattataatgatgctggtatatgaagaggccagaagttttaagtgtctaatgttggcttaacaaactatggtccatgggctggccatctgttattgtaaataaagttttattagagcactgtcatgctcattcatttacatattgtctatggctgctttcgcattataacaacagaattgagtagttgccccagaaactatatggtccataagcgtaaaatgtttactctctgacacttttagaaaaagtttaccaactccttagttcagaagaaagaaggaaaaataatttcatagcatattataaaggaactactggagagatgctatctctgggaaagttgcgtatcaggagaagtttcaagaacaagtggtttcagaaagtttaccaggaacagaacgaaactgaagatgtgttctgcaaatctgagtagtaattcactggaatatagatataattggagataaaactcaactgagcagcctgtaaggaagttggtgggagagatgagggttgcccatagactgaattaaagaggaggccctggtttcaactcatgaagattgttcaacaaagacataaggcccacacagtatgattcattatgaaggttggtacaatagggaagattggtaaactatccatgctattattccaaaggaatcattccaagcaaggctgcaaattatcttcccttcacaatctgaggattatgaagtgtagaggaggcatagggacctgcttcatggatatatgcagtataaatataaaatagggtttattggggaataacatacaagcaaagaactggaggacacataaaattttcgagcccttattattccatagatagtcgtgtttaaattggacatagctaaactggacctacctatggaagggattcacatttgtagagagaaagagcagctaggaatgtgtaggtgacggtaatggaactttctgagttgaggaaatgaccttgttgaaaagatagatactgccactaagcaactagaatgaggctgttcttacgttggacttagctgctgtgtcagcttcttgcctagctgccaaatggggcaaggactatctgaatttctgtctcagataattttggcaaagattggagaaaagacataaaagaaataattggacagtttatttttcaggttaaattagacacagaaacaatttgtcacaaactaaaagagtatctttattgattttagaatttgattctgatttaaaagtttcatgtttcttcatgaaagggagaaaaactgtatctttgcagaagaaaagagatgtcatttatttgtccagattcagatatatactatatcccaagagactgtgttaggtcctggaaactcactaaaaatatatagcctacataggagatctaaatatgtggcaaatagaaataatatcagatactgggagagtttatagaagaaaccgctaacttctgatggagtggtttagggactattggttggaggaggtagtagcaaataagagttttgaattacaggtgtgaactagcaagataaaaatcacacttcattattggaacagtacacaaataatcttgcaggtggtggaggggtgacagtatcatagacttaaagagctgcttcactttacttccacttagaagcctctggtgaaaccttatgtttgttcttccttatctagaacacttttaaaaaagtaaaccgtattaaagtataagattaagaaaaattcagaaatcctaagagtgtggttcagtgaatttttgcacaaagaagaagaccgtgtagccagcatatcccagagcaccacccgagaggcactctatcctgtctcccagttgtttccccctgccccaaggaaggtcattatcctgacttctaacactatagattaattacacctgttgttgagtttatatgaacagtgtgtcttctttcgcacaatattacatttgtgaaatttatcagtggtattgttgcatgtagatatatgtaagtatatcttgtacattttcattgatgtataatctattgtgtcagtagaatacaatttatgtatttacttttttctattgtaaatggacatttggattgttttctactttggtactattatgaagactgtaattttgaatattctcgatagtatacgtgaacacttgggtaaataggagtgcggttgctgagtcataagggtatgcatttggttagtagttgacggaagttttctaaagtagttctactggtttacactctgctggcagagtgtaagagttctagctgctccggtcttgagcaatactgggtactgtccttttcattttagtcattctggtaggtgaacaatagtaatttaatgttaagtttccatgatgtctaatgaaggtgctcactttttcatatttttattggccatttagatatatatcttctgtgactagtctgttcacttcattttgttttcttctaatgggctgcctgcttttttcttattaatatgcattctatataatcaggtgagtgttttgtccatgatatgcattataaatattagctctaaaactatggcttgccttttcactttcttttttaaaaattttattttagagacagggtcttgctgtgatgcccaggctggagtgcagtggtgcgatcataggtcactgtaactcaaacttttgggctcaagtgatcctctcatcttcacctcttgagtaggttggactacgggcatgtaccactagggccgacccattcttttatttttttgtagagatggtgtctcgcctagactggtcaggaactcctggccttaagtgatcctcctgccttggcttcccaaagcactaggattacaggcatgagccaccacaccaggcctacactttcttaatgttttaaaaaatcaataatattttaatggtttcccatttacctttttttccctttcctttatgagtagtgccttttgtgtcacgtttaagaaatctttacttaccataaggccataaagatattcttctatgctttcttctgtaaggactctttttttttaacctttcatgttttagacctgttatccatttggtgtttatttttgtgtttggtttgaggtgtaggggtcaggatttgttattttccagatggatatttagttgtcccagtacaatttattgcataaaaccatcctttcctcactatatgacagggttgcctttatcatgagtcgagtaaccatatgtgtgtgaaactgtttctaaattctctgttttgttccatttgattatttgtatatccttgcttaattctgcactgttttaattactataatttgatatctggtggtgtagttctgcaccttttttttttttttctcagaaccagctgactattcttgccctttttcagaatatccaaatgaaaccaagtgtcattgttcacttaagaaaacaaaaaacctactggaatttagatattttttttccactggatgtagggatctatttagggagaattgaaatctttacagtgtcaagtcttgtaatctatgaacatgtttgtatttcatttggttttcattaattctctccataatggctgatagttttcaaaataagtcttctacatttttgttatatttattagtagatatttgattttctaaagcattattaacatttcttctcaaattttattttctgcatatttgctgctaagtatataaaagtatacttaagaattgctagatgacatggtaactcttaagtttaacattttgggaaatgccagactgccaaagtggctgcaccattttgctttctgcctgccatgtgtcagcattctaagttttccacatcccagccaacacttgttattgtctgtctttttttttttttctgtgtaagacggagtctcgctctgtcgcccaggatggagtgcagtggcacgctgtcggctcactgcaagctccgcctcccgggttcgtgccattcttctgcctcagcctcctgagtagctgggattacaggcgcctgccaccacgcccggctaatttttttgtatttttagtagagacggggtttcatggtgtcagccaggatggtcttgatctcctgacctcgtgatctgcccgcctcggcctcccaaagtgttggaatcacaggcgtgagccaccgcccccagccctgtcttttttattgtagccatcctgatgggtataaactggtatcttgtggttttagtttgcatttctctgatggctaatgatgttgaacatcttttcatgtgcttattggacatttgtatatcttccttggaaaaatgtctattcaaatcctttgcataatttttaattgttttttagttgtatgatcattttgaaagctgtttttattggttgtagaattctagattggcagttttattctcttagtactttgaagcagttgtcttccaacttccattcatttctgttaagaggccagcttttgatcttaaaaaaaattttttttttaaagataatgtgtctttcttttcttttgttgctttaaagccttttgcttttcctttgttaatatacatttttactgtgatggacccacaaggggcatgtgtcttcagatattgcttgtgtcccatttttttccttctctgggattctagttacatataacggttttgtatcccatacatttcttatgtattttgtcctcctgtattttttactctttttttctctgtacttcagtttgaatgttttctagttattttctagcaatctattttctagtaagcctttctcctgctttttaaaattaactgataaaacagcctagtacgttcttaatttctgataatatagtttcaattctagaattttttgatttttcatttttatggaaatggcccatcttgtcatccattttctccatttttaagcttttttttaaatattagccatagttatctttaagttcatgtctgtgaatagctatatctggattacctgtaagtccatatctgatccctttttctctttgttctcaattatacgatgcagtcttttgacatgtctagtggtttttaatgagccttcagaccttgtatgtgaaagagattatagaatcttagcatctccagtcttcctgctttagcagctttctgatgtctttaaagaggtatttgttgtatttcatcctgttttactagttgatttcagtgggttctttggtcttccaacaactactccctctaacctaaaagcagacatcctcatatacttaaaaaaaagaaagaaagcagtttaaaaataaaagttttttccaaaggttccaaaggtagagtacagagaacgatacttcaaggtttgctatattcattatccagaagtaacatatgtcagtgctgacacatttgttatatgtatttttatttttattcataaagtgaaaaaaattagagatttactgtcctctttataatttttcctggtctcttcctactttccttctcataaccactatcatgaatttacattgtgttttctttatattttttaacaggtattatttaatattgtttcaacatgggtttaaagttttacatagtgacgttttcatttgcacttgctttttcactcagtgtagtgttttgagatccatctgctctcattcaatacagctagttttaggaataaatattcttaattcatcaatacttctatcaaagaacaactatgttgtttctaattttttactgttataaatggtgttgcagtatacatctgttgacctgtctcattatacatgggtaaaagttgctctgtgatagtttcagaaggaattgctaggctgagtatgtccatcatcagctttaccatgttttcaagttgctttccaaagtgattgtactagctacactgcagtaagtttgtatgataattcctatttgcccatatactttgcctttccttctttctgtcttgtctgcctttcttttctattttttctgtctttgtccctttttaaattttattttattcttttttctggtcttaggaaagtgaaatgcaacctgtttttgtggtttgcttattttgtgctgggttgttggttttggtttttttctcttagaagttctttacatattctggatattaattctgtatgtattgtctctgtttcagatagtatctttcagtctttaccaaaacactttgtaaacacttttatgacgggacttaccatagtgttgtatattgcccttatttcagtagattgtgagcctttttaagtgtgttaagacttgctttatttcctaaatcaagattggtttttttaaatgttccgaatggagttgggtaaatatgtattctttgattgttggatgcatgcatctccatatatctttcagataactctcattgttgtgttctaaccttccgtattctttgtgactttttgttttttgttcattgagacttatcaataattgtatgtaccacaatggtggatttgtcaatttctctgtatattttattgatttaataatactgttttatacattttgggactatttcgttaggcttgcacatatttagaggtgatgtaccttcttggcaaattttgcaatacatattgaccatctttatcctcagtaaggcatgtttgtcttaaatctaccttacctcaccttgatatagctacatatttcttcctttccttttctttttttcttttccttccttcctccctctctccctccttcactccctttctcccctcccctcttttctttcttttctttttttttttttttgagacagggtcttgctctgtcacccaggccagagtgcattggcatgatcatggctcactgcagccttgacctcctgtgctcaagcaatcctcctgcttcagcctccagagtaacatgggtatgcgcaccatgcctggctaatttttgtactttttgcagaggtgaggtctcaccatgttgcccagactggtcttgaactcctgagctcaagtgatcctcccacctggccctcccaaagtgctgggattatagtgtgagccacggcgcccagccagtgttttcttggaggtctgaaactctgtgttatctttcaaccttactgtttccttatgttttaggtatgtcttttatagatagtatgagaggctgcatattggttttttatctagtttgatccatctcttaacccaccagtctagttgatgtttattccctgtgatctcgcacgtatttgcactagtttgcgtgatcccagtcgatcatataaatgggttagcgggtcccagccgtcgaaaaagccatagtgtccgcaaagaactctgattgcagctccacacagagccccccagggaagaggacatcggaagaagatatttcatctacctggcaatccaccaaacgtggaggttctgagtaagaatggttgagaagtcaccctgccagaggttagtcagtttctacctgatgtcttcaactcctatctccagcagagcttttgtactgcccaggtttcattctggagggcgtctgtctgcatcagcatggctgccagttctcttgtgatgtagcaggcattgagtgttccaggcagcggaggtgagaagcacaagctgaacccaaactgctgttttaaaaatttgtcttctcggccgggcgcgttggctcacacctgtaatcccagcactttgggaggccgaggcgggcggatcacgaggtcaggagatcgagaccatcctggctaacacggtgaaacctgtctctactaaaaaatacaaaaaattagccaggcgtggtggcaggtgcctgtagtcccagctactcgggaggctgaggcaggagaacggcatgaactcgggaggcggagcttgcagtgagtcgagatcgtgccacttgcactccagcctgggcgacagagtgagactctgtcttaaaaaatttgtcttctcataatcccactggccgatttcttctccaggctacaagcctccacatccctgaccccgtacattttccagcataccctctggggtttctcactttttcttcattattcctttacagatttattcaacaaatttgtttagcaccgcctcactgccacacagtagctttgttttagaagctgagcgtgcagcattgaacttttttcaacttatgttctactcagatgactggttttttttgtttgtttgtttttgttttttcagcaagtaatgcttgttggtttttttgcccctaacaagggcttgtaggtgttatacttcctgagtttttttatgtttgaaaatgtttattgtctttatacttgaagtctgacttggctaggtctaacgttctaggtataggccctatttcttttccccagaacatcgtagagatttggtcttctgactttgaatgttgccagaattctaacaccagactgagttttttcccttcttaaaagtcactcacttccttccttggtgtacatggtattctttctttgaccttgacattcagtaacttaatctgaatatgccatgaatttgattattccttatcacttttttgagagattgtatgcctttctgtattttattttttaataaatatttttcctttgctaaatgctctgggcttttttggtatcttcattatctgtcaacaatacaaacaacttttttctattcattttagttttctgttttgattctttgattttcattattgtgctaaaaatctctgttatgatttgattttttttctcttctcattcatttccgagccataccagctcacattttagatctgttatctctgacagtttttggcaattatattaagtatgagttaacagaaatagctttcctataaaattattttctttatttattttggtttcaccttccctggcattctacatttagaacaagattcttcacttatttcatgggcttctgatacttgtgaatcttgtagcactaatcagaggatcctctcagaggacactgccacttttgtgaagaactcagtgtgaattctctgaatccactttcattttcttctaaatttcaccaaatctggcagatgaaaatttgtagttagggattcttactttccttgaagaaaacccagtctcttttttagtattatgtatgtgtatgtatgtatgtgtccatgtttttagaggagtagagaggagtaaacatgactttattccattttgaatttaaaactaacttttgtgatttcttttgaagttaatataaagaatttacatcattttaatgtaattgaaatcagtttaaaaatattgtcttagaataataaagttgagtcttgagttttaattatgtagttagtattctgtagcctaattttagattacgttacctctttcatgtcaaatttatgaactgaaacgtggctgtattgtaaaatactaattaacactctactaattagttggcttttactgatttttcacttttagatgtcttagaaagctagtatgtagaaggaaaatctctgtatgacaaccaaaaacttactttgaactgaaaacactaaaatcaagggaaaatgtactcttaacagcttgttttcttgctttgtgacttgttatattttgttataatctaatcttctaggcatatactcatgtcataagtgatagtatttttcattcctttccttattgctttcctccattgtattctattttgtttttgtttgttcccaaatgtatttgtaaaaacaagtacatcaacagatgcggaggtttttctacttgtaatttctgttttatattgagaatttttttttttttttttgagatggagtctcgctctgtcgcccaggctggagtgcagtggtgcgatctcggctcactgcaagctctgcctccagtgttcatgccattctcctgcctcagcctgccgagtaggtgggactacaggcgcccaccaccacgcccggctaattttttgtgtttttagtagagacggggtttcgtagtgttagccaagatggtctccatctcctgagctcgtgattcgcctgcctcagcctcccaaagtgctgggattacgggcgtgagccaccgtgccctgctgagaattttaaagtatcaaatatagaccagtattcaaagatgattcataaaaggtgatttgggtatatgacacaatttacatgtaaatatgtatcatgaacagactagatggtattggctagttaaattttcttgttaaatgaatatttaaagaaccttctcaactctattttcattcagtttactagctaacagaatatttgagcggtcatataatacgtggagtattgtgctttgtgcacttgacaaatacagagaaaacataaggttttgagactgttaaagagattagatctacataaaattaagagggattaaggtgattaaatgctaagatgagtagatgttaaatgcatttggtgttactatagggagaaaacagatactctgcttaaatttagtgaaaaccattgaactactataccactgtttaattttatcatgctacataggaaatagactgaaaaaatacagaaacatcattgaattgtacatgtgaaatgaattttgttgttgttttgcttttacatgtacgtattgtatctgtaatgaaagaggatattaaagtcatgcccgtgaaaaaaatttctagtggtagtaattgcttttcatgatactggagatcctctacttctttaatagctactgcaataactgattttaagtctaggccagtagttaaagtttataggaagaaaatcgtatgataggtatccatggggaaaattgctgaactttatgttgttgcacaattccaaagattattcaaaagtatattcttactgacctttcaaaaactgttttttaaacagactttatgttttagagaagttttaggttcacaacagcattgagcagaaagtaaagagagttcccttgcattcctttcccatcccgtattagaagaagagggatcaagggtaactcttgctcaccccaaggagggttgttgggtggtataatttttgtatggcatgagcttcagagtatttgaagtttttgaaggggagggaaagaaaagtagtgtcgaagagagaatacagagcataaaaagacatctcttttagggccttcagtcaatataaagggtgtaaataaaaaaattttttgggggggtctctgttagagaggatttcaggtaacaggtttcagttaaagaaagaaacagttaaagaagaatttgaggactttggggaatttgctgatcccagactgtgaatttcagtgggtacaatagagaagggcttgagagggaggagaaatacttcagattagtggatgtatttagttgtttagggatcaaagtctggctgatgctacattacctggctgggatttggggtttctgatggtaacaattttaactgaatgataagggaacactgatcaactgttccttctgtggtgcttcaccctctgtagtggagtggcagccaaggataaggaaatacttccccaggagacagctctgtcggagaacttggcatatacaaaacaaatgtaggactgtagcacaacaggagagggaaggctcatatggaggacaaagctgggaaccttttccatctttgaaatctggctcagtattaagaagaagattcatcttcagatagcccatattcaagtactactaatgcttttaataaaaatataccttttttattgtttaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggtaacacatatctagtaatacgtgaattgcaagtaatactgaaatattttgtttaatagcattaactgtcagaatgacttgtacatctaaaacataaattaggtgtatatgtatcttttctctaaatcatttcttagaagagtgattgctgtatggcgactcacttgtgttataaacatactctattcattcagacaaagtaaactatgttgttttaccatgtataccagcataatcttaacatttcatctatgattacttattttgtatgagttttaaaattaatattgtaagagactatcatttttggacagtatgaagttacagttttggtatgtcttaatcatttcattatgtcattgacagctcacaactttaaacacttaagaaaacaatgacaattatgtaaataatatttgctttgttaatagtgttttagttgggcaacaggagaaagtcctcattttctttgtttatctgctgcctatttgatagctctcatagttctcccaacctaattaagtgaaaaagaaaaggatttattattagaatgatcttctcagaaatagtgttttacaataaaaccttcaaaatggaaaccagtatgcttccccctttttatcttctctctttcaagatcttccataagataacttttccatgtgtatttctaatcacattttaaattagcttcatagttacttttgtctcttttgtttatatttggaggttttatatttattcagtggaggaattttttattacttgaaagatgcatattttggcttagtttgtaatagaaaagtattaggcatttctttggtgaaagtactgaaaccatgtgaggattatgtagaacaattgaaaaagaacaaatggagtcctaatctagatggtatttctaatatttaaaattaaagataatttagctgttttgttgtataggaatctaatttatttgcctcctcaagttgttattgttccgaaaatgcattttaaatttcccctatacttctttgccttaactgtccctcttcaggcagtgattgataccattactacacacataaaaactattacttgtattttaaaaacagcttttgttactttttagtcattttttcaaatgagaagtaaaggtatagcataattacagctaggactcatctctgttgcttgacttatccatagttttatttatggggctcactgctgttaacctcccctgaattgtatatgaaattttttattttgcttttgttgataactttgattaaactacatggttatatctttagctaaaccccttaatgcagttatatttatgtcatttataaattatattatttagcagttatgttatatgttatcatttatttataatactgtatagtagacctttcccctattacatgtcatgaatacattttgtattgtaatattgtaaattagggtatcattcaggtaagctttgttaagagacttcataactggatttccttgaaatggagagtaaccctgttgtgtttaaaatagcttcttatcttataaatctatatgtctcatcaaaagttacactgcctcaactcaaaccaatggagctgactttgataatgtcagcaaataagtattctagctaatttcattatagaggcaaccacctccttaaccctaactacactgctctttcattgcagcagttgttattcttggtccgtggaggttgagggtacttcacactgcctaaagcttacttccctagagaatacggagaatgtagtctgatttaatcctcatagaattttcagactacctcaatcttcatctctgttgtggacagcaaagtgtaagagagcagatcccaaacatttttttaagcagtctcctatattacagtctgtttcaatatgaaggaaaacttttgcggctcaattacatattgggattttgatgttttctttttaattgcatttcctcaaaataagttaaaatgaatcgtgttaatagttccttgtgaagttctaaattatataaatacagtagatagaagacacattagattattagggattaatttattgtggtaggataaattacaaggcttaattcacacttcttgtatattaatgtcttactgagtcaacttttattaagagagtggttgttaagcttgtgagataggccttttttcacatatgaagatgatgcagcctacatcttcactagtagtgcaattcacatacgagttctttttgccagtagtgtaatggcttacgctaatgcatctatacagtttgctatggttcaaattaaatttacaggataacagtaatgaagttacttacatagagcttcctatgggtcttagtttttacaaagtactttacagttgcctcattgaaggatatttttggaataccattttttccttttcacagtttcctttcaggcagttgtattgatgggaagcaggctttttgatgcccatttactcatttgacaaagatttgagggggttctatgtgctttgcaagttgatcttatttagagattcctaattcaggccagaagaatattcttcctacccatatttttataaaccattgaggtatacttttaccaactgaagattttatgtatatttataagaactttgaacaagttggtgataagcttctggactccttagccatctcatgtggttgaaaacatcaggataaaatagaggcatgaacagttataagtgatctactttagagtgatttctaaagtatatgaccaatatacttaagagtttgtgtcattatgtaagcaataatgacacaaactctgaaaacaacaacttccataaggcctataacctgactccacatatttccgtttgcatatatgttagtctttaaaaaatcagcaggattttactttccctatattactgaaatatgctttgacagagtcttgagtatattaacatggcgtcttcattagatgtgttcctcttctgttgcatccaatacacaagccctttgaggatgtgctgtgaggatgtgctgtcagcctcacctgtgtagtctgtagtacaggacgcacgtgtattaggtctgcggagttagatatagtgtgttttgtgggagtactgtaagattaatataatgtattaaaagtagttggtatttgaatattgttgattataaataggtagaaatggtgctcttatttttctgtgtttcaattttatgtataaacttaaatccatctatctttgttctgcctcattttatattaattatgtttttaaactagttcttaaatttaaaattttaatcaattttttaaactttggttagagttgataaaatttaaaaaattctatacaggtttatttttttaatttgtacttacatattttaaattgcatttaggtattttaaattaaggtctgcagtgtcttgaggatgtatatatcccctacattaagaaagctgaatatatgataaagcagacttacacattagtaaattaagagattgccattagggtaagattcataagagacttcataactcaatttctctgaaatgaagaatatcattgctgtgtttaaaatgtttccacactgcttttcagtagtatatttcttacaaaacatgagttttataactttatttcccatatttcattaggtgacattccacaaagaatgttgtcaaaaacacacattttatcttttcaagttattaagcattgatacaaaaataggtggcagacttttgtttggtcctataaaatgtagtaatttaatttaaatgtatgaagaaaatgttataactccttagtttttcttttcagtaaaattaagattaaaaattatgaactatattatataattttacaggaatactaggtatgtcctagagtgtaggaaactacagatggaaattaccaacacaagcagttgccattgttcatacacatgcatatgtgtgtaatttgaatttatactaaataaaagcctagagccaatagaggctttgggattctgcatcaaaagaacaattatgctaaaaggcaacaaatgatacctaaaaaacacctgagaatacttttgtatccatgttttttcctgtcatttggcagaaatattgaaaatactaaatatttctgcttataattttttaaaaatagccgtgacttggtaacattcagaaatcatttgtatggcaattcagattattgtgctgtcatttaaggatgtaaataaaagggtcatggccgtttgtctctcttgttaatatctggtgcactattcccaaagagaggaggttttcaccacaggcatactacggtacttaaaaaaaaaattcttctcgcagtatctcatttaagcttcatattcaaggtaagctttttcagaagcaaaaattgggatgcacattaaaatgacttgcccagagtcatgtagcaatgtagtggcagaaccaggattaggacccaggtctgtgacattaacctttccccttgctccttagttcactgcatccaggggagctctggagcattttaccgtaagtagataagattttatacatacaccaatcatgtacgatctatagcagtcacgaataagttttcctcagtaatgaacagaaaactagtgaggataatagcagtaagaatgataggtattattaagcacttaacatggtctagtaaagacttcatttgaattatcttattgaatccttactgttgcccttatttcacattgaggcaatggagacacagtgataaattaagtcagatgttgataatttggattctgaagaaagagaaaatctgtttgagtcttaaaaatcccttcctattttcaaattacaaaagaatttggaagtaacatctgaaagaaaggaagatagggaatcagtataagatccatctatcaattagaaaataaaagcagatggtagtgaaagtgattatacttgagagtaccttatttaaaatcactggtcctcacaatgtgtagtgccctgaccagcagcagcagcagccccagaggcttcctagaaatgcaagttcttggtcccaccttagaccttctgaatctgcagcttttgagatgaagccaaagcagtcatgaattaatttgaattaacttgccttaagtgcagttatagactaaaagtttccagttaacagtttcttgggagtggttatccagctttttaaacatttttatccccaagaatatcccctgaaataatttcaaacaaagagcaagcacaaactgtaattttttaaaccctctaaaaagtaattcaaactatgcagtatttgtgtgaattgcacctaaggaatacatttctaatgggttacatttcagttcgattccacatggttataagagcttgtgtgagtgtggtttctttgaggggtgcttctttgagaggtgtggtggggatgagtcggaggtggaatctggctcttcagatgaacaaaaaagaaagttaaatgacctatctcctgagatcatctagtgcttgaccttacaaaagtagaagcatgattatgcttggattttctgacagtatcatgatattctcaaagaggctttttgagccagtcctcttttctccccatgttatagacgaggaatggaacagacagggagtatttaagaggcttgcctaatgttttacagggctgcagtggagcatcagggaaagggaaaaaataatgagacatctgaagacaagacaaagctttcctccacctccagtcccctgccctgctcttttattcctaacagagcctgaagcagcaggatgatgattcacagggtgaggcacatagtcctcatggctctcctccgcttcccacatgtcactgcaccatcgcctcacacagcagtcaccatagctcttgtaatttcagttttactacttttattttgctgtgcatgtgaatattatttaatcatacaattattggttttcatttatgtgctttgtataagggactacacgtctctaagtgtggtttttcttgaggtcatattattctccattagaggttcatgtcattgatacacaaatgagagttcatgtggggaggaaaagatgatagatatcacttgtatatataactgaacttttttctgtaatacatttcttgtgattattgatggatacctccctatgtgttctttttatgtcatatgtgtcagggattgaatattttattaatagtacttaccatcagataaagtgttcctttttctccagaagatatttgatgctttggtcaaatttttgaccaataagaagaggagataaagaggatggagataaagttgctctagaggtgatgctatcaccagagttctttaaagcagcagtccccaaccttgttggcaccagggatgggggttgggggtgggaggaatgtggacagggagatggttttgagatgaaattgttccacctcagatcatcaggcattagattctcataaggaatgggcagcctagatcccttgctcgtgcagttcgcagtaggtttcattctcttacgagaatccaatgctgctgctgatgtgacgggaggcagagctcaggcagtaatgctcacttgcccaccacttacttcctgctgtgcaacctggttcctaacagggtctgtggccccgggggttagggacccttgctttaaaggttatggtaggtggaaaacaaagatgctctaggtcagaggggcagcttatatggaaattaggaaatgagacactgcagttagtgtacgaagttgaaatcagccaagtgtcactgtagtatactgtgaagagtggaatagctaagacctgagaagtaaaccaggtccacatgagctatataaggcccttcactttatcctgcaggtttggatagccactgaaagagctgaataaaatagctgcttaggtttctccttgcatttcccaagcagtaagttgtgttagaactgcgtggtaattttttgaagggagttgaagaaaaaggaaaagaggtaaaaatattgaatgtaatagttctacattttaaatttattgtactgatgtttgtcgtactatgtaccaggcattttgctaaacactgggaatatagtggtaactggccctattgctgcctttttcctaataagatgatatgctggctattttattatcttatggcagaagtgcttttgttagatacacttcaatatcgacttaagacccttagaatgccaagatttttatgtttctcatcagatattaatcattaagcatataactattataagataagatattatactgctattcaagccagaagttcatttagggcagaagatactaggtgcttcccgtgtttctcaatgttctgtgtcagcctgtaaggtgagatgtatatagtctaaatgatctttcagttctcttatatatagatgggtaatgcggacatgcagttttgtgaaacctggcacttcaaacacacaatttaaaattaaagagacagctgtatagttttcatatttattttgaagttatttttgtggctctgttctcagagagagactagggatctagattctacagaaagacaccttcttgcatagattagtcataactcaactttttaatttacaattatgcaatcagtgctgtactggtaaaagaaattccaaatgatagtatgaattatattttagaaaatgagacataccttataattttctaggtttttgtttagttggttgattttcaaatttctaacgtgtttcactgattgtgtatgctaagggtattttataaagaaaatttgatatgggattatggttttttcctcaaataatgtttcttgtagttctcattttaattcattagcagtaaaacatgagaaggtaaaccttccatattgtttttaaaatgttagtgatttttaagacttggtaaataggcactacatgcttaagccttctagaataacccaaagctttattatgcacgttggactttatctcctgtaactcagtggagaatatttttctgtcatgctttgtttttatataaattttcttttcaaatatctggtttattttgtggtaatttctgggcttaagtgttatttccagaatgtatctcgaaaactttaaaaatgtttatgctctgaaaaaagaacgtagaagtagcaactagtatttgtagaggaattcaagacattagcttgctttttttgcgccacccacgttcatataggattatcccataatattatataattaaaatatttttattgtggttttccacatttatgtagttgaattaagtttttaaaaatggtttcgttactttggtctcttataaacctatcagttttgtgctgtaggacagtataaaataatgttttagatattttgtgaaagttatttgatattagactctcaaatcctacttaatatgtcacttattagtaaagtagatatctgtatttaatattctaactagcatatatttgctatattatccatttatttattgaatggttagtgtactgggttactaagctcaatgtttaatagggcagagagaacagtattaaaattttaaatcttattaagttttgatgatcagttaaaataatgtatgtgaaagcattttgagaactataggttgcttctggatgcaggcaacagaagacctcactgaaattggtcttaaaaataggggtattgggggacagagcgaggctccatctcaaaaaataaataaataaataaataaaaataaattaaaaaaaaaggggggggtattggttatttcatgtaagaaaaattccagcagcatggtagagatttggctgtgttcaagcgggctccaggtctctgcctttgcccatgcatcattgtcttcacactggctttttcatgtcgataaaatggcagtggtagctctaggccttatatgtgaacacagcatcatataaagcagcactatctaatagaatttgttccatatttgtgctgtccaatatagtagccattaactatgtgtagttattgagtgtgtagtgcaactgaaaaacctgagtttttaatctttttaaattttaatttaaccacatgtggcgattggttactatattgttgagcatctatctaaagtatcagagatcagttgtgtcccagaatccacagcagatgttctaaaattaattctaattgtactgtttaaatcgcttgcctctccatctcccactctgaaaacactaaacacagtggtagagaaaggatagaatatcctgattggcttattgtagctagatgttacacccctgggatttactacaaaactaaagtaattcagtgtggtatttgcatagggataggcatgtagttcaatagaacagaatagagagctcagaaatgtacccacatatacatggttaattgatttttgacaaaagagccaaggtaaatcaatgagaaaaggacagtcttttcaataaatggtgctggaaaacctggatatccatatagaaaaaaaataagcctcagtatttaccttacatcatatacaaaatgtttatggaatagcggctttgcataggggagtaatcaaaggtaaggaagagacaaattgaatatagttgatagatggtcttgaatacccagctgtggtatttaatatttgtcctataggcattgggcagcctttagaggggtgtttaaaagttttaagtagtcaagtcattgttacaggaattaatctggcagcagattagcagtattttaaaagaagtgtgtagcttttaaaactaaactaaattatctcacttattactcatgataggctttagtaatgttgagaattatagaaagaggaatgcaattccatttggtttgaatggagaggggagattaaagtggggggttaggccatgttctaaggaatagaatatattgacacatcatgctgtttaaaaattgatttatagaaaatttgcataattgtaaaacatatatattattatagagagagagaattgacctaataatgctgtgaaaagtggtttgtgtgttataaaacagttaggaaactctgatctggctctctctttcatttaactgatgaggaagccgcgtccaaattgagcaagaaagactgtagatcctttgaggcaaagacttcgctaaggaacattagtatttttcacagtgctcagtaaagattcagcacacagcttaataatgacctataaaatggaactaaaggtagtgttgtgtacttccgcattcacttaatcataaattaagagtatttatgatactcagttaaaacttcatcaaatattacaaaatctagtagggacaaaaatataaaatatgtttaagttgaaggaacactcagtgtgtaggaggtgattctttttactctgttaacactggaaatgataactttatttccttatctccccatcctccacatctactaacatatattacttccagcctttagagaagtaaatgtacttaaaaagataagtatagaggcctctgctgtattgcagtgtatgcattcttgaataatctcataaaccgcaaaacctatgcagctttgtattctgcacatgaacataaatgataattggagggatagcttgaaatgctcaatgaggcatcttagtagctagtggccactatggtgggtcctgtaaatacacaaaattacttgaatagaaatgctggcagcacttgaattaggatgggctagtgcatcttaggacaatatgatatgatttccagtgtgataacttcatgattggagtatacattcccagagctttcagtaacctaattaatcaggttaatactgtagtagtactgtcacattaccttgtatctttataaataattgctccagacatccttaactatcatgtgaaattgaatgcatattttaattgcttattgaaatgtggtaggcatacctgagattaacttttttgctcttcttttaaatgagatataattcgtataccataaaattcaccagtgtagattatgcagttcagtggttcttagtccattcacaagttggtacaaccatgaacgctatctaattctagaacattttcatcaatccgaaaagaaacccagtacccattagcaatcacttaccaactcctccttcccctacatcctggcaaccactaatgtactttctgtgtctatggatttacctgttctgggaatttgatatagatggagtcatgcaatatgttcttttgtccagctttttcacttagcataatgttttcaaggtccatccgtatggtagctgtatcagtccttcattctgtgaccaaatagtattccatttgctactgtgaagtttgtatacaagttttggtatgggtataagttttcacttctcttgggtatctagttagtagtagaatttcctggattgtgtggtaagttctgtgtttaactttttgaggaactgccaaaccctgtcctacatctaacttaaaaaaaaaaatagcaaaaacatcaactaaaaccaataactttatggatattattagaaaatggttgattttttttaaaattttgatattgttgggctaggttatctggatcaactcttctgttgaagacatctaaaaactagataaactgtaaaaacagaacaaaaaaacttttttacgttatcaaagagctcaaggaatatgccaggccaaaatttaagagaaggtaagaacataaaggtaaaaaagtatttaaagttctaaccaccctgaatcatttgcccatctggataaagcagtttgtaaaactgagatttgggttctgatagatttgggttctgatagattcagaatcaaggggaaaatgatcacttctaggtttatgagcctaatagatacccccaaaaccctttaaactggggccttaagaaaagaggaaaatccactgccttctcctgctcccaaaggattccaaggagagttatttagtactgagcagataggggaaagaagagaacacgaaaagaaaaatagaacatatctgacagattgtaaaccaagttaccagcattgtgtggaatcgtagttccaagtcatataataccagacattcaagaaaactagtgccctgttaactgggggaagcaaatttatatcctttttgaagaaagtcaccttattctgtgtatcagaaatctctttcaaataacctttcagaactatagagcatcatacaaagatgaccaagcatacaagaaaacaaggcacagtgaggaaaacacagcaggatacagcagaaaatagctcttatatatttcagatgacattgttattatatgtagattatagaacagtttcactttctatgttttaagaaataagcttgaaaatatcagtaggaaacaggaagttatataggaattgacatagcagagttgaatgaaatacttcaagatgtgaaaaaatacgatgaccaaaactaattaatgcagtaaacatggtggaagtagattttccataaccgcagagagaatttgtgaaccaaagatagaagaaattatctagaattcaatgcaaatattaaaaggcagaaaatatcaagaaaggtttaaagaaaaggaggatcatgtttagaagttctagcttatgcttaattggcattgtagaagacggaaacagagaatcgggtagaggcaatatttgatgagataatgacacaattttctaggattgatgaaagcccaccatccttagatttaagaaattcaaatcccatgcagagtaaatgtgtaaaaaaaaaaacaaacaaaaactctatatagacatagtgaaactgtgcagaaaacaaagacaagaaagacgtaaagaaactatcctcaaaagagtgctatttccaaataacaaatgaaatctggagtcaatgaaatgatatcctaagtgtgctgtttaggaagggagtagaatgcaacctagagttctatacccagagaaaatttcgacagggaaagcataacacctgtatatcagtgttacaatcaaaccatctactgctttggaagaaagggccaagaccaagtcaggctgccatggtaagcagtcttcatcgaatgaccagatgatctctacagtcttcatgtggacgatgatctatgtctaatttatcagtaaatatcagcatctagtagggtgctttcgataaattttgttgaatgaaagaaaaaaggcaaattaaggtatttattcagtaaacaaaaagggatagtgaagaaccaagctccaggacttttgaagatagactttcttgtctgtggtgcactgagaatcagctctatcttagtattcatttacgtgtggagatctagaacagagttacattctttctggtgacaagctgagactacctggctgctcaatatccagctcctgggagacaagggcctcaaaactgttgggattggggggtggggcaggtagggaatcttactaccatttgttaggatttttaccatcaaacctaggagtagcttggaactgggtaagatcttagaatttagagaagccatagcctgaacaccacacacttctcactgaggaagataggggtgataagatcatggaggaactggagaggaatatgaagacagtgcctacaaccaccacatacacagtaaacattctctcttctcagtggttgaagttgttcctgattacagctctcttatctgttctccctttgatttgctgactgatggatgcagtccatttaagaaatgagcatagcatattggaaagagcactagacttagattctagtcccagttctgtcacttaacagctatgtgttgaggtgaggtgagggaagagtacttggatctctggatctcttttaactttaatattctcctctataagggtagaagatgaactagaggatcacaacagtaccatttagttttccgttcagtggcaattttgacatacttttttgagcatacataatctcagaatcctatgcctcaaaactttgattcattggacagatttcaagaaaaatataatttaacaaatgtaataaagaaaaaatagaaaaattgaataatcttgtcaagttttccacaaaactacaagtccagatggctgcataagaaaatactagcaaatttttaagaaggaagtaattccagtatttcacaaacccttccaaagaatagtaaaaacaaagagctttcctttcctcgttatctaaaattagcctaactttgatagcaaaaccagctaggagagttgcaaagataataatcagaagccagtctcactgaacataaatgtgaaagtcttcagcaaaatattagtctacttcgtgttcacatctttcttatgggagacttttttgtttgtttgtttttgagatggagtttcgctcttgttgcccaggctggagtgcaatggcgtgatcttggctcaccccgacctccgcctgggagacatttttattttcagaatgacccattttctctactgtttgggcacaaaactagactctgtattagcctcccctgtggttaggagtggccatgtgactgacctctgaccaaggagatgtgagtgaaaatgatgcaggctgcttccaggtgtgaccagtaagatacttcccacataatcttcgtactctttcttccctgtttggcatcccatgtgctaagaatgggaaccctgaggtcctatatgtggaaccataaggtaaatgtctttgggctctgaatctcacacagggctcactgagaataagaaacatccttcttgggctttgtatgaataagaaagaaataaactttcattgtgttaagccactgagatttatggatttattaaagcatctagcattacttatactaatacagagattaaatctagtgatatgtagaagagataatatattatgactaagttgaatgtatcctagtagagttataccatattcatagatcagaagtctcaaattatatatatctgtgccacataagataatctctgtagagttgatgaaatatcaatcagaatcccaagaaatactttttgaaagaacttcaacaactgattctaaagttcacagagaaaatagaacagaagacactgaagaagaacaaggtgagagggtttgcactgcaatatattgagactaattttaaagctataataatgaacatacagtggcagtggcacaaataccaaatgccaaacgtaccaatggaataatagctcagaaacaggaccatgcatatttagatacttaatatatgatagagtggcagaacaaactccttaagcagtggtatagggacaattgggtatccatgtagaaaactcatgaaattggacttacctcagattttatacaaaattacctccaggatgcttatagacctaaatgtaaaaggcaaaattataaagctatttgcaggataatataggagaatatcttcataattttggaaaggatttcttatataaggcataaaaatcactatcatatggataactggaaaggaaaaaactgataaatttgactccgtttaagaactctgcatccaaagataagcgtttttttttttttttaatgctacataatgggaagatatttttacaatgtataaaattagccaagggcttacattgactacttataaaataattactataaaaataaataattaaaagaactactataaaacaattatcaaaaggcagtagaaaacttagcaaagtacttgaataggtgcctcacaaaagagaacatccatgtggcctatagatatgaaatgtgcttcatttcattagtagttggtattgcaaattaaatcccacaggtaggaatgcatattgatacaattactttaaaagacagtttggcattatctagtataactgaagatccacatgttttatgaactaatacttctattcctaagaatacatacccaagagaaatgtgtgcacattatgcagtagactatctacagaaatgtccacagcagcatttttatagattcaaaagattgaagccactccaatgtctgtctgttgtagaatggataaagcttttttttcaagccatgtaatacagtatttagtgaaaatgagccagctataattctgtgtaactctatggcggaatctcataaacagtgttaatgctgaatagtgtactgtgtgtggttccatttacatatcattcacaaataggcatagctaaattatatttttagggatatgtatatatgtggtaaatgtataaagaaaatccagataattgtcatcacagagttaggatggtattaactgtaaaggtgggaggagagggttatgggatgaagggagatagggagggttctggccttggtctatttttttgacttgattgaaatgactgatgttcactttataattatttgttgaattttatataaacttgtacataccttacatatttcacaatttttaaaaattgtttttatgtgttgtcagagtagctagaaagaatagtatatgtttcaaaattggaaataattatttacaatgaggaaagacaacttttctcatttttaaaatatcacaataatctagtttcaatttcctgaaacttaagacatgatttcttttttcctcttttttttttttttgagacagagtcttgttctgtcacccaggctggagtgcaatggcaccatctcagctcactgcaacctccacctcctggggttaaagcgattctcctgcctcatcctcctgagtacctggaattacaggtgtctgccactacgcccagctaatttttttgtatttggagtagagacagggtttcaccatgttggccaggctggtttcaaactcctgacctaaagtgatctgcctgtctctgcctcccaaagtgctaggattacaggcatgagccaccgcgcccggcccaagccatgatttctttattttacaagcacttgcttatacttatgctagatttactgactacttagccggtgtttatggagcatgtactgctcagctgtgtcatagcaatgagatttaaggtgggtggtcaaattttttgtgggtttatttaattgatttaaatcagttaactcctcatgcatttaaaaaccatgcatttataccttttgagtagttttaattccatagtttcacttgtaagtgctatgattctattagcttggaatggaatttggcaataataaagttgagcgtatgttaattttttttttcagttcttggtaggcaggagttaaaagtgcaggcatgggctctagcagatactccagcagtataggctcttcgatccaaaatgtagtgtcatatgtcaagattccagaaaatgcaagtcccttgggatatttataagttcttatttaagagcccatatgctttaaatatttattaaacatatttagaaagataatcctgatttatttactctgtaaacagatgccaaagattatagtaatatgcatttgtgcacgtatatatatgcacacattatatacggaaatggactgcacttttaactcctgactaccaagaactgaaaacacttttaacatatgctcaactgtataattgtcaaattccattccaaacaaatagaatcacatatatatatttaaaattttagacaagcttattttccatggaagtttttatgtatataaaactttttatattttatgtataaaagttttatatttaactattttttatatatgtataacatttccatggaaaatgtggctaaaattttaaatatagaatttcttgctgagtatttaacatgaaagagcataagctaaaagaaacgcattttaaatgagttgccctgcctaattagtaattcattttgaaataaatttttgtaagtttattatgtaaaagaaaacctcaacatacttaaaaaaaagtttatacagtattgtttttgtcctctcaagtatcttttttctttcttttttcacctcttcccttaatcctttccatctctagtttcaccaagaggtttagtatataaaccagaaaatgagaggcagatgtacagggtcagccaagtggtaacatatacccagaattctgtaaatgtttccttgaatttgaaaggtaaggttgtcagtactctataagtagaatgataggacgtatgactttaaagatttttgttggggtagataccattgtttcaatcagttatctttgaccaacaacagtaattaatcatcacttctaggtttgagactctttctggattctatgttgtagaggtactagccagacttattttgagaaatatgtgacttgggtaaagagactaataatgtgttacctaaaggatcactaacagttttcttcctcatgcttctttgattataagggatagaaacccatttaaagtagctccaactaaagaaagaatttgttgaaagaatgcagacagatagcactcaaaggcaagaggcaggagtagctggcttcctgaaggccggacaccaggaacttcatattaagggctccatggtctctcatctctgccaccaaggctggtttgcaaaataactctccttgcaagcacaactgataatcttcatgtagaaatgaattgatttaaaacaggtgagaaattcaaaatgatattgaggggaactgaattggtaacaatttatggaacagatagaatggagagagagaaaagtggaaaaaagatataagagtctagacataagatagtgcaggcttgagtgagtatggggacagtagaaatggaaataatatataaaatttggtattccatgtgaatgtagagagagaacaaagggaataaggtcgactaggttggtaagtcccaaggagagaccggtttaataaaagataatgaattctatggcagttaagttgaaatagaaatgttagtaaaatatccaaatgaaagtgtgcagcaggcagttgggattataaatcttccaagttgcagattagatttggatgaaggcataaacattactatcataaaattataaaatgaacatattagagattttatttgagtcattaatgaatgagggaacagtaagatcataaacagaggagaactcaaaaatataacacatttatagttaaagaatgcagaagtaaatttataaatagaaacaaaagtggccagtatccacagggtgacaatcaatggtattccacaggaaacaatttctggaaacaagaattatttgcagctactacaagttttctataagttaactaatgtccatctctgcagtgttgtaaaatagcctcatcaaagaaacggaagtggatgtaactaacctaaatggaggttctagccagggcactcactaagtttcaggctttcattgtttttccttaaattggtatggaaattttaaactcaagagccttcctactactggagtgtttggtcagcagtagatagaaagaaaaacaagcaatggggaaaggattccctatttaataaatggtgttggaaaaacgagccagccatatgcagaaagctgaaactggatcccttccttacaccttatacaaaaattaagatgggttaaagatttaaacgtaagacctaaagccataaaaactctagaagaaaatctaagtagtaccgttcaggacataggcatgggcaaagatttcatgactaaaacatcaaaaacaatggcaacaaaagccaaaatagataaataggatctgattaaactaaagagcttctgcacagcaaaagaaactttatcatcagaatgaacaggcagcctacagaatgggagaaaatttttgcgatctatccatctgacaaagggttaatatccggaatctacaaagaacttaaatttacaaaaaaaaaaaaaaaaaaaaaaaagccatcaaaaagtgggtgaaggatatgaacagacactgctcaaaagaagacatttatgcagccaacaaacatatgaaaaaaagctcatcatcactggtcattagagaaatgcaaatcaaaaccatcatgagataccatctcaagccagttagaatggtgatcattaaaaagtcaggaaacaacaggtgctagagaggatgtggagaaatgggaacacttttatactgctggtgggagtgtaaattagttcaaccatggtggaagacagtgtggtgattcctcaaggatctagaactagaaataccatttgacccagtaatgccattactgaatatatacccaaaggattataaatcattctactgtaaagacacgtgcacacatacgtttactgcggcactgttcacaatagcaaagactgggaatcaacccaaatgcccatcagtgatagactggataaagaaaatgtggcacatatacaccatggaatactatgcagccataaaaaaaagaatgagttcatgtcctttgcaaggacatggttgacactggaaaccatcattctcagcaaactaacacaaaaacagaaaactaaacaccgcatgttctcactcataagtgggagttgaacaatgacaacacatggacacggagcggaacatcacacactggggcttgtcagggagtggggggctagtctagggatagtggtagaagtacgtaatgtagatgatgggttgataggtgcagcaagccaccatggcacatgtatacctgtgtaacaaacctgcacgttctgcacatgtatcccagaacttaaagtataataataataataataataataataataataaaaagatcagcaaagaaaaaaaaggaaggcttttaaagttcctcttcttttaggtaaaactggtttaattaatgctagacaacaaagcaaaaccttctaagtttgatttgggcatttacaacacagaaatagtgtggatatgatgtagggattccttttccctagaaatatttttaggcagtatgccctcctctcttcctccaccagcttgaatttcattttagatcttaatagcttccgacagaaaggaaggttgtgggatttgctgttttagacagttaacattcttaatgctgcaatataaataacaatttatgaattaccacaagaagattttgaagatgagtattgaaaggccacaggccctgtcttgtcatatttcatcgatacttgatattataacgaatacagattaatcaaatatttttagaaaattttaaagaacagcatactacttcttccttttaaaaaccaatacttgctccaataataagttctatcgagggttactaggaatctcttcctgagtttagatctgaaatcagtgagttgggtggtttcacactcgtaagtggtaaaatagttttgttttttggtttttggtttttatttatttatttatttatttgagacagagtcttgctctgtcgcccaggctggagtgcagtggcacgatctcgctcactgcaagctccgcctcccgggtttacgccattctcctgcctcagcctcccgagtagctgggactacaggtgcccgccaccacgcccagctaactttgtttttgtatttttagtagagacggggtttcaccgtgttagcaggatggtctcaatctcctgacctcgtgatccgcccgcctcggcctcccaaagtgctgggattacaggcgtcagccaccgcgcccggccgtaacatagttttttataaaggtgattatatcaagtgaacatgagtcaaaaattttaagtaattaattagtgagggagcctgaaaaaaatgttgcctttgtaaattcaaagatcagacaaatgtataagcccaccaagaaggccaaatgaatttgcttcataaatacaaaaactggctcttccacagttgagagaggaagtcagttgaacttccaccaggcgggatttgtttgcacatctacaaacacaaattatttgcattactctcacttttctacacattatcttctgtttacagagttggaaaatagctcagaaaccaaggtacaaaccccctagaatcagataacttggcatgtgctctaaacaatacagagttttaagagatatttagttttttgggtttcatttaaaaatatttcagtatccttacataactagcgttgaaaggtaaatattagctaagtttattacttaaatcctgcgttttgtaccataaatgacaatgtgcagaaagtacctgaattggcccaagtcaaaaaaaaaactgttaaaataataatggaatttaactttgttgtgacataaatagaaaaatgattgtttctaacaagtgcttaactgaccctccaaaaataaaattactgtcttctatagacgtgtactgatgaaaaatataggtgtgttaattttaggattttatttaagtaatattgccaattgggacctttaaattagtttggaacatgtatagaacagggtgtatcatcggcttaaattgattaataattactcattaatattgatctttatagcagcctgtaatgtatgttgtagaagacatttctttaagaaaagcaactaggataagtcaacttaaatgggtacacaccattgaaatttgaaattattttggcacaattgagttttctccttaagtttgttggaatggcattgaaaaactcaatcacgttatttacaaggagtaaaatatctttgaagttttatttactttagaatggattataatgactagtaatagctatagagagtactcagtgctagcactcttgatgcatttttctactttttctttatgaggaataagcagatctctcatagtggtgacctttcacactgtgttttcctcattgagcaagtgtctttattgtggctaacttgtgtgtgagaaaactgaagctggccaggatcgtatgtacctgggcctggccttcttaatagattacggcattccacttgataataccagtggcacaggagaaacttctactgttgtgctatttggtaatgtgaagacagaaaaagtctttttatggtagttgggtcctcaaaacaactcttcatggtttagtgataaggagacacaagttgcctatcaaacagaggtacattagcttattatctacaaagctgatagagcctcttaaattctctcatggtgacagaaaccccatctgaagtgaaggcttgcagagctggagataccagagcactttccttcctcataaatacaagtagagttaaccctactcttgtagaataaaaattgcatgtaattgttgaacaaaagctgccttcttttttctctggcaattaaaatgtggtcaaagagatatatacttggtgattgccatttgtgaaaatttcagtgataagcattacagcttactaagaagagcaagactaattaactagtcttaaaatagatgaaaattgaggggaaatatcagagatttaggactagaataagtcaacaactttatgataagatctgtgtgtaggcacctactatatttgttctgtttctagtgctgtgtaggttttaagagttcaatgtgttccagtgttctgagtgtctacattttcactcctcatagctacttggaaagatttggcaagtaaacttgctaccatggttgggggaggataaatgcctttatcctttagtgctcccaacaacaggaccttttatggccaagcacacataaaagtccatgtgattacttaggctcatagagcctagtgccatggagaaaatgttggagaaatagatgttgtgtttgctatatgcacatgccaagtaatttaataagctaacgtatctgtactaatgattgtttatgattcttcatgaaaaatttttaaaaatcacattgaataaagtgaattttaaaaataatttgactttggagaatcaaaaaaattcttgaatcttaatgtactgtgcttatgttctacttcattcaagaaaaaaggagtaaaataaacatccataattattgctaatcatattttaaaggatactaagatctgctatgaaataatcaaaaatatctttagatctaatttaatcgtttattgatgaacttctctgggactagttcagtgatcaagctttgtttcctaactaagctctgttagttaggcttacttagaaattttaacttcctaatccttctctgcagttggtcagaaaatcaagaagtctcagccatttcagtgttgaaccctgtaactctactttaaaatacgacccactaggattttttaaaaaagaagaaagaaagaaataagacattctgaaagtaaaggaatattccatatatcttcaagctcttggtttttaatttatccttttaagtactggacaagttatttcatgatgaatttaagttaaaaataaaaatcagaaaaccaactgttttttgcattatactaagaaaaaaaaagtcagtataatccaggagatattttaatggcactcaagaatattctccagaaagggctgggcacagtggctcacgcctgtaatcccagcactttgggaggctgaggtgggtggatcacgaggtcaggagatccagaccatcctggctaacatggtgaaaccccatctctactaaaaatacaaaaaaaattagccgggcgtggtggcgggcgcttgtagtcccagctactcgggaggctgaggcaggagaatggcatgaacccaggaggcggagcttgcagtgagccaacatcgtgccactgcactccatcctgggcgacagaacgagactccgtctcaaaaaagaaaaaaaaaaagaaaagacagttctccagaaagtcaaatcagtggattaaatcaaaccatgaaatacactctgaataacttttgagtgcaaattttaaaaatatgtaaagtcactgataatttgtacattctacataggagtcattgcagacataaataattatcaagtttgttgtatttcaaagttatacaggaaagtgaataataggaatgaaattattgggatattgtgctgattctttctgttgagtaggataaaaactccgataggcagaaaggaagaatacgtgaagttgctgaaatgttcaatttataaaggtacgataacttctcaaagcatcatttttatagatttctatcttagttctttcatgcattggttatatcatataaattgatcaggctttaatcagatttgagttttaactgtgagagcagtgagtcatttagtattttgagaagtttagaaaggaagaatccaaacaaatattccttttctcttaacatacaatgggagaattaattttacttatatttaatgtttatcttatttgaagaagtaagtacatttgtgatcatttagaaaccgtttcagtggctcttgtataattcagttcattccgtctgtgctctcttaataaattttacagaaaaactcatggcaagttagcattatttgtgtgtgaattttccaattgtatttcagactttaagaaagaaaggccttaatggttgtgagagccctgatgctgacgattactttgagcacagtccactctcggaggacagattcagcaaactaaatgaagatagtgattttattttcaaacgaggccctgtaagtacttttactttacctctactttttatttgttgatcctttttgttaacttcattatttaggctctgaacaagaaggaacacagagggtgcgacagcccagaccctgatacttcatatgtgctaactccacatacagaagaaaaatataaaaaaattaatgaggaatttgataatatgatgcggaatcataaaatcgcagtgagtactaaagtatggtttgtgcttttatcttgtgcatgaagagattgaccaaacatcttgttgcttatttttatagtgggtgatgacaacaataagtagaagggaagaaatgcattttattagtattttttataaaacttcaaaataaaattgctgaaatcttatacatgttcagtatcttaaatgtagaagtgaagagaaaacatgccgatccagactttgctacttcttaccccaatacctttggatagggcacctaaacattttgaattctttctccatctatagtgagttggctctcatgatttttaaggtatcttccagctctaaaattctatgatttatagtatagagtatgtataaaactttccctctactcccatgacttaaaaacatatgtgttcttaaatagatcttgagaaagcaaaatgtaaggtagttaggtttgttgcgaaacttgtttttttcctaaattatcttcaattattttgtatagttgctataatagcagagctaagcttactgctttgcagtttgtaaatgtccccaaatcacttagcaacaataccaccagacttttgttcttttcttatgctgtagatactaaggaagagcagcttggcttaattttaatttagggcaacaatgttcttaaactgattgcaaaacaaatagtgactttacagtttctgtatactcattcatctaaccatagtgaaagagtatttttctttgagctcatgctcctagacttgatagtttttcaaagaattctcactggaagctccattggcaagagctacttaaaacagttattctggatctgatttcctaattctgtatatgtaggtcagccgcccttgaacaaattagtttcaatgctgatatttattttagcatcagagttaattctttcaaaactgtgccctaaagtatgcatgatggatcatttcttcagagtagtcctgtattacaggttgggtattccttattggaaatgcttgggactagaaagtgtttcagatttgggatttttttcaaaatttggaatatttgcatatgtatagtatcttggggatgggacccaagtctaaacattaaatttattaatgtttcatacataccttacatactcatggactgaaggaagttttatacaatatttttcataattttgtacatgaaacaaggtttgtgtacatggaaccatcagaaagcaaagatgtctctgtctcagctacccatgtcataggtcttggctccatgtggagcatcattgggaacctgctgttagcatgtgtagcctacacacgtgccattttattaccctttgtggatgtgcttgtgtgagggaatctgggtgtgcacagaaaagatatattgaagctgatggcagactggaacggtccttttccccttggagacactgaataaactgtgtattgtatgcctgcatttccacatgtcaggtttggaattctctatggcatcatgttggtgctcagaaagttttggattttggattttcagattagggatgctcaacctgtataagaagccagctcacaaaaaaatagccttaaggagttacttttgggcaaataccattattattcttaaaaacaatacagtagcaaataaagggatgttgctgaccttgcagttaatgttaaagctgcaaagatatcgcacaaataaaagtgttttacttttgaaaaaaattgtcatatacccactgtttttatatttgttgatgtataatttttctacatgaaataaactactattgaataaagtacaataaaatatattcttccaactttgaattagcagtgttaccttatttttgtatgttagtcttttaaaatgagggcagagtaaagttgttttattttctcccactttaaattgtaaagagcaacatatatttatcgtggttaacaagcatattgtaaatggtgtgtggaggaaatgcaagatgaaaatagaaaatagaaaaaaggggatatggaataatttggagggagggaaggttagcatttataatatttgtaatttaatctttatacaatttaaagaagataccaaaaactttattacttttattactggcttggttagtagttaattttgttgtttagattagatttctttgcattttcattaaactcaaattgcattgttatgtatataattactttttttttttcttagttttgccctttagaaagttagtcaattaaatcagaatggggaatatttatgatttatcagatttgacatattaagttaataatatgtgtacacacttttctccttccgttatatttgggatctctcagtagaaatgtaatgttattaaggtttacattgaagtgccaatttatgcttacttggtgacagtgatatattttgtaatgtctaaatatgacaacactacttgattatcaggtttatcctcttaaatttgtctttatgaatatttgaaatatagaatatagacattagtatatattaatgtataaagttgaaattgaaaaggctcatgtcagtcatattcatgttcaaacataattctaaagaaaatagctttaatctgtaaattggttaagaacctatccctatcctctacttttagtaacttgagttaccttgccaaattaaagttcaaaagttactttgtagatgaatacgaaaccaacagttttttccttctttttctttatttacagcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtatgtagtgatacctattatgctggttctttaataaagagggtgaaaaaattcattgctaacataagcagtttcttattttgctattcttttattgctttgatgagcaagaatcactgatacataattggcctcattttaaagtatttttttgaaaatcaattgtgggtgtagcattgtgtcatgcaaagtagaacagtactgagaacctgccatttatatgctttccttctcatgggaaagccatactttgacaggcagaaaatttagttagatatcagaagcaaggatttaaagtagagtgtgagccattcatgttagaaatatgggtgatagactacctgattggagttagagtatcttttacatctcctcctgcctgaattacttcattaattcagcaaaatttatgttacatttattgtattagtctatgaaatgcagtgtctcctctctcttaagtcctagatttaatttagtgatttaatcatactccttacacactgcccccgtttttatcagtatgtactattttggtattgatgcaataccactatttggtattgaaggcgacatcaagcttgaaaggtaaactcatatatatgagatataataactacatcagattacatgttaatgccaacttcagactgagctagtttttatttttgtgtctttttaggattagagtgagagttatctctattcagttcacgttcagttaggtaaagagagctaattcatattcattctctgccctctgtcttctctccgtaacgttgttaggtgggatgttgagcactacagacctcacagtgccaaatggagctggaagcagtccagtgggtgagtgaattcctactcttctgttttgtaggtatctatcctatatgagatcaaaggaatgttgttcctgaaataaagctttctgggaaatttccttctgaagggtactttcactaatacatcaagataatttcttaaggggagactttctctaacttccctgcttaccaaagttagactgttaccaaactactctatcttacaacagcatgaaatgttttcagagagactagaatgaaaagaaatggtgggtctatctacttctacagatagaaagataattaacatatttgtcttggccgggcgtcgtggctcacacctgtaatcccagcactttgggaggacgaggtgggcagattgcctgagctgaagagtttgtgaccagcctgggcaacactgtgaaaccctgtctctactaaaatacaaaaaaatttagctgggcgtggcagtgtgcacctgtagtcccagctattcgggaggccgagggaggagaattgcttgaatccgggaggcggtggttgcagtgagctgagatcgcatcactgcactccagcctgggcgatagagtgagactccttctcaaaaaaaaaaaaattatggagatgattgaatgacttaataaaaatgatgaggaagaaataaacaaacatcaataaagatattattaagacaagttacaaaatatttaatgacaaagtaggaataaatgcctaattatatctgccacagtattaaatattttaatggaattaaacagataagacctattgtggagtcttacttaacagaaaacaattaaatgtgggaaaatacataaaggttgtaccagttaaacactagggctgctactcttgtatgtgtatttccaaatatttatggttttttttcagctcttgttttagttgtttgtatgcctacatactgtttttgtgtccctttttttttttattcccccaacagaataataagttcagggcccaccaagaattgtgagagcctaatatgcttctctcacattgggttgacaccccaaaaggctggactctagaagtaaagtaaaccagagataaacagttcttctcagtagtgacatcttacagatgcatcatacagttttgtttttttttttttgagacggagtctcgctcttgtcgcccaggctggagtgcagtggcgccatctccgctcactgcaaacttcacctcccgggttcacgccattctgcctcagcctcccgagtagctgggactacaggtgcccgccaccacgccgggctaatttttttgtatttttagtagagacggagtttcaccgtgttagccaggatggtctcaatctcccgacctggtgatctgcctgccttgacctcccaaaagtttgttaaaattagatcgtagtgattagaaattagatttaggggttccagaatgcccggaaaagcaaatagtctctggaagaataaaataagcctggcccacatggcaaaaccccatctctactaaaaatacaaaaattagccggacgtggtggcaagtgcctgtaatcccagctactcaggaggctgaggcaggagcatcacttgatcccaggaggcggaggttgcagtgagccgagatcatgccactgcactccagcctgtgcgacaagagcaaaacgctgtctcaaaaataaataaataaataaataaataaaataaaacaccatctcagaccttattatttctaacttggcacataagctgaactaggcacacacacaaataaagcaaatgaaaacttgcagaaataaacaaacaatggaatcagcctcctgggaactccagaatttggagttactaggcacagactttgactttaatataacagtgtttactgtgttcaagggtatttaaaaaacaaaaagattgagaattttagcagagaactgaaatttatttaaaaaatggaaattttagaacaaaaaaaccccgtaatgttaagaacttaacagatgggcttaaaaacagattggacaaagcaaatacaagaattaagaaactaaaagataagatagaagaaaattatccagaattttggagacacaaagggatggaaaattaaaaagaagacccagagcatgcaataaaaaggactagcatacgttaaattgaagtcccaggaagcaaagtcagagaaaattgggcagaagcagtatttgaagagataatcactgagaattttccaaaactaacaacaacaaaaaagccacaaattgggaaggcctataaaactcaacgtggaatacagataatgctgtgctttatgagaaatttaaacctttatgaacaaaagactggagatggtgagctaaacctccttctcaggaagtcagaaaaggacagcaaattaaacataaagtaggtagaaccaaataacaaagatacaagcattgaaatagaaaatagaaaattttctatttcaggcatggtgaaacagatgatctcatacgtgcttttgtggtattgtaaatcagtaacaatctttctggaaaggttttggcaagatgtttcagtggtcataaaaatacaagtattgatactgaaatagaaaaacaaattgaattaacaaaacaaatactgattatttaaaagactaataaaatggaatgttttcactaatattcaattcgaaatattttctaatttccattatatctttttctttaacccaacttgtaagttatttagaattatatttcttaatttcaaatacatggagattttccagttatctttgagatattattttctagccagattgttttgttaccagagaacttacctctatatgattaagttctctgaaatttgctgatacttttttataggccagcatgtgctcaatttttgtctgtgttgtgtactggaaaggaatgtttattctgtattataagcatggattgcaaattctacttgttttaaatacgttttatctgtatatatgtcataacttactgtatcagctccagtttagaaactcgtgataggtcagttccagatagttttgcgttacctttaaaccatatcatttttaccaatattgtcattttcaaatacgtaatttgtttataggcgagtcttccatttgccttgttcgtattttaatttttgttgcatcttctgcctgcttccctaaaattggaatacttcaggcccatgtactgctaaaagaagaggcatccttgagacttttaaagcactgaacgaactcaggaaaggcaaagacttcttaaataagaaaccaaagaaagtctaatggaaagactgattgatttgcttgtgtgaaaattggaaactttgtgaatcaaaagcactgtaaagagagtaaaaaggcaagacagaatgggagaatatatatagtatgtatacaatcaatagagaggtttttttttaagaatacctacaaatcagtaagaaaaagaaaactcgacttttgaaaatgtgcatgagaacacatcacttcacaaaagaaatgtctgataaatgtgaagaaatgctcagtctcagtagtcatggaaatgcaaaattaaaccacaaagagagaacactgcacacccaccagaattgctaagatgaaatagatggtataccaaatattgacaaagctatgaaaaagcacaaactcatacactggtaatgggagtacaagttgttgcaaccatttggcattatctgcctaagctgcagatacgtgtattgtgtgacccagcattttcactcatccttatgtactgtagagaaatgcatttgtgcatcacgagtaccaagagatatgtaaaagaatgtgtacaacattatgttaaagtcattgtctagaaatagtacagatctctgtcaacagtagaatggataaatataagagtacattcatatgaaagaatattatactgcagtgaaaatgaaatcacagcagttctcaacatggatgaatgtcaccaaacattatgaattaaagaagatagatacatactcaagattctaactatataaagtttgaaaagcaggccaaaaaaactatagtgtttgggatgcttgtgtagatagatggcagagccataaagaaaaaccaagaaattactgtaaaattcacaatagtggttactttgggtaggtgggactctcggaatattttagggggcccaattatggaaacttctggggttctggcagtattcttaatctgaatggtggttacgtggatcttcactttatgataaatccttaacctatacgtttttgttttgtacattttctgtttatgtgttacattagcaagaaaacagttttgaaaataaaagaatacactagatataataataaaggaactataacaacaaatataaaggcactttttaaattataagagaaaataatgtacattttgtggtatttatactattccaaaattcagagagaaaatgtatagacactcaacactcacattcatgcacaaactagaggtagcctttgagtctttggacattgttgtctgcatgtggcagctggaactcagcacccatcttaagatcatgagacaagtcagtttaagatgacaggtcaaaatgccaaggttgatgaagtgaaaagctggtggccctcagtgttgagctgctgaagcagctgagtctgggaccactcttcccctagtctttttatgtgagataatacgtgttgctcattctccagaggaaaaaagcaagataaaatccaagcaacagataggggaatgtttagtaatgggcatttaattgtaccaaaatacacaattcaaaaaagaaacctaactagtattttaaaaactgaaaaggttgttcatcattggtagtattcatgaaattcaaattaaaatgacaaaaaaaaatactactcttacttactaattcccaactattagcactttttattgtgatattcagtgctaatgaaggcatggtgaaactgatgatctcatgcatgcttttgtggcattgtaaattagtaacaatctttctggaaaggttttggcaagaggttttagttgtcataaaaatgtttatacctccaagcccactaatcccatttttgggaatctctcctgaagaggtaagttagaataagcaaagcttcattgcaactttatttgtagtaatgaataataggaagaaatcaacatattcaacaatatgaaaatgaagtaaatgaaatttcaactgaatttctttttagttgtgatttaaaacgagcaaaaaatatgagcatggaaaacaaaaagggaaaaatccaaagagattataatacttaagatggtgggactgtgtttttcactctttttctagtttcagtgatgctgtattaatacagttacctctacagtcataacatctttattgtagtaaattagaatatttctttatttattacttataacttgttttccattgtcatctgtgcaaataaaacttggcagctttgtacatattgtaatttgtatagatctttcatagaggtaatttgcttatttgtttatgatttactaggtatatttctctatggggagtttaatactgggtttatactatagttcaaatgactttggggactttttactttgggcacactttaaaatatcaagcataaaataaagtcagatatccaacaacttcactttttaaaaacacgttgagaaagagaaaaaacatatatggtactagacatagaaaggctcaagatgctcttggaattatttggggttaaatgaaggtaaaataagggtttgcattgtagcaggcacattggcagttaaaaagaagagatggaagaggtgaaagatatcatgaagaaagcttgattgctctgaaggtggggatgggatggcggaggacagcagtagttgaagtctttagaacaagctgagttgagatgacagcagcatgtctgggtgaaagtggccaccagattattgaatatgtactggaaattaggaaagataaagcagaaacccagttttcagtcattcacatggaggtgatagttgaagttgtatatgcttcagcattcatgcttcatgaagatgctgaagtttctgaaagagaagaagatatgttgccttttgggggctgcccacatgggatagagatggggaatacagtattcagaaagaaaagaagcagaccccatgagcattgcctatttttgttataaatttttattggacaggatccatgttgtccatcttacaagacatttcattgaatcaagtacacatgcattcaattatttcaaaacctgtgatctttattattttattttattttagactagtcaggtgcagtagtgagaagggggtaaagagtagaacaaggagttggataagttgagataactcactgccttcgaaccagccctgtaatcttttctactttcagaaacctcaaacagttctttgtacaaatgacataattttataactgttagaatgtatttttgtttattgaataatcagctgaatgtcaaattttatgaaaattttgccaaatatgattgaactttgctttggatgagtttttcagaatcctttgaagtttgcacatcagttggacttctgaaatgaattcatagtgaaatattagtgacatcattgtctgcagtttaaccctagaagagtagtatctaaggacacagagtacttgccagctacttgaatgcattatttcagctgatgtgatttatattttgaaatatgagccagactgatggaattgactgacctatcttacagctataggactgtaattgagatcaagttctgttaagtttctgaaggcatgggtatgcggtttgctcaagagcattttttcacatttgtgttaggatagtaaattaccttgaaaactggaaacacattttaacaacattaaattggatttattcatttagtgtagatactgtagttcctaggtttgtaaactgtggcaagatgagttatatactgaaagtatttacctcaaaagtctatctgaaaaatatcttcatttttgtaataaaaattgagctggaggtaagaaggtacatattagggtatatatcactgcactctacaaaataacaagtcgtgcataggagattctcttagcttcagcctggcaagttaccaaacacttacatcatcctttaatcatcatctgctactgactcctgactttacatcaagaaatactgtgcttttaagtcccctcttactcttgaaatttggttctcatgagttaccatcatgtcatatctatctaaagcaccatagactgcacatgggaaaatagtatttgtgcttcttgatgatgtgtggctctgaattatatatttttgtctttgagaggaaattctactttcttcttcagatttgagtataaatcaagtaaagaagaatcttctaaataatatcagaatcagaacacatattcatgccattgtatatttaaaaaattattaatctgacattctcatactgttaacgcaaaatgaagtttctatttaaccttcctatttttgaataaaattatttaataaacatttttaattcttcaactgtctggcttagcggttacctctgtccaagtcatatatgatctctactcgacaggatggcctggtgaagtggttgttttttaaactgcactgctttctgaagcttaacaggatgcaggaaattactctatggggtgtggaaaggatttaattcataccccttcaagataatgaaagcagaatgcaggaaataacctcatgaggttaactgaaataccagtccccacagcaaaattagatcatacatatgaattaaaactgagtgggtcacttggtaaacgttttggaggaaacaagaggaattgggtgagggtaaggaagaaaaaaccacactaatcatctggaactcagaaattcttttgtttgtttgagacaggatctcactctgttgcccaggctggactacagtggcacgatctcggctcactgcagcctccacctctgcggctcaggcaattcttctgcgtcagcctccctagtagccaggattacagacatgcaccaccatgccctgctaatttagcatttttttttagtggggtttcgccatgttggccaggctggtctccaactcctgacctcaggtgatctacccatctcggcctcccaaagtgctgggattatacttgcgagccaccatgcctgggccttttattaaaaaaaaaaaaaaaaaaaattatttcaatagttttgggggaacaagtggtgttttgttgcatggaaaaattctttagtggtgattttggagttcaccagagcagtgtaccctgtacccaatatgtagtcttttatgcctcactccctcccagccttcctccttgagtccccaaagtccattgtatcattcttatgccgttgcatcctcatagcttagctcccacttataagtgaaaacatgtgatgtttggttttccattcctgagttacttctcttagaataatggtctccagttccatccaggttgctgcaaatgccattattttgttcccttttatggcttagtagtattccatggtgtacatatatgtatatatatatattacgttttctgtatccacttgttggttgatgggcatttgggctggttccatattttcgcaattgcaaaatgtgctgctataaacatgtgtgcgcaagtgtctttcatatactgacttcttttcctctgacccagtagtgggattgctagatcaaaccatagttctacttttagttctttaagcaatctctgtactgttttctttagtggttatactagtgtacattcccaccagcagtgtatgagtgtttgcttttcaccatatccatgccaacatctattattttttgattttttaaatatagctattcttgcaggagtaaggtggtatctcattgtgattttgatttgcatttcactgataattagtgatgttgagcatttttcgtatgtcttttggcaatttgtgtatctgcttttgagaattgtctattcatggcctttgcccactttttgatgggattgtttttttcttgctgatttgagttccttgtagattctggatattagtcctttgtcagatgcatagtttgcgaagattttctcccactctctgggttgtctgctgattatttcttttgctgtgcagaaggtttttagtttaattaggtcccatctatttatttttgtctttgtcatatttgcttttgggttcttgatcatgaaccctttgtctaagccaatgtctagaagagtttttccagtgttctagaatttttgtgatttcaggtcttatatttaagtctttgattcatcttgaattgatttttgtgtaagatgagaaatgaggatccagtttctttcttctacatgtggcttgcctattatgccagcaccatttgctgaatagggtgtcttttccctactttatgtttttgtttgctttgttgaagatcagttggctgtaagtatttggctttacttctgggttttctattctgttccattggtctgtgtgcctgtatttatgccagtaccttgcttttctggtaactatagtcttgtagtatagtttgaaatggaaataatgtgatgcctccagatttgttctttttgcttagtcttgctttggctatgcaggctcttttggttccataggaattttaggatttttttcccccctagttctgtgaagaatgatggtggtattttgatgggaattgcattgaatttgtagattgcttttggcagtatggccattttcacaatatttattctacccatccgtgagcatgagatgtgtttccatttgtttgtgtcatctgtgatttctttcagcagtggttcatagttttccttgtagaaatttttcacctccttggttagttatgttcctaagtattttttttttttgcacctgttgcaaaaagcgttgagttcttgatttgattctcagcttggtcattgttggtgtatagcagtgctgttgattttgtgtcctgaaactttactgaatccagtaaagatgtcatagatggcttttattactttaagatatgccccttctgtgccagttttgcttattgacttgtgtatgttaaaccatccctgcatccctagtatgaaacccacttgatcatggtgtattatcttttgatatgctgttggattcggtcacctgttattttgttgaggatttctgcacctgtgctcatcatgggtattggtctgtagtttacttttgttatatcctttcctggttttggtattagggtgatactggcttcatagaatgatttaggaaggattctttcttactctgtcatttggaatggtaaaataagattggtactagttcttctttgaatgcttgatagaattcggctctgaattcatctggtcttggactttttttttattagcagtttttaaaattactgtttcagtctcgctgcttgttattggtccatgcagagtttttatttcttcctcatttaacctaggcgggttgtatatttccaggaatttatccatctcctctagattttctagtatatttttccacccctttactttatgtgagtccttacatgttaggtgagtgtgttgaagacagcagatacttggtggatttttaaccattctgccattctgtatattttaagtggaacatttaggccatttatattcaacgttaatattgagatgtgaggtactattttattaatcattgtgttagttgttgcctgaatactttttttttcattgtgctgttgttttatgggccctgtgagatttatgatttaaggagggtgtattttcaggttttgtttcaagatttagaactccttttagcatttcttggttgtgctggcttagtagtggtgaattctctcagcatttgtttgtctgaaaaagactctctcttcttcattcatgaaggttagttttgctgggtacagaactcttgaccggcaattattttgtttgaggaagctaaagataggaccccaatctcttctggcttgtagggtttctggagagaaatctgctgttaatctgttaagttttcctttgttggttacctgatgcttttgcctctcagctcttaagattcttccctttgtcttcactttagataatctgattactgtgtgcctgggtgacaatctttttgcaatgaatttcccaggtctttgagctttttgtatttggatttctagatctctagtgaggccagggaagttttcctcaattattttctcaaatatgttttccagacttttagatttctcttcttcctcaagaacaccacttattcttaggtttggctgtttagcgtaatctcaaattttttggaggctttgttcatttttgttttttgattttttttttaatttgtctttgttcgattggattaattctgtcacctaggctggaatgtggtggcgtggtcttggctcactgcaacctctgcctcctgggctcacctcagcctccttagtttctgggactacaggtgcacaccaccatgtcctattaatttttctttttttttttttttttttttttttgtagagacggggtttcaccatgttgcccaggctggttttgaactgggctcaagcgatctgcccacctcagcctcccaaagttctgggattacaggcatcagctaccacatctgacccagaggcaaaccattttacgtctcagaatgcagtcttgtcaggatgagattattaggacgaattttagaccagtgttaagcacacagcagacactcagtttttgttagtccttgcacgtgtattaatacaggggtgtgtgggtgtgtgtgtgtatttgtaacacctagtgtctgcttatttttcgtgaattctgaagttttctttttggctttatactagaatgaaaggagcagaacaaatacagctactttttccttctgatggtccctgaagctgtggattatccaggcttatctgctctgccattcctcactcacaccttgttcattcgtgctttaacgtgtttttctcacatttatccataatgcctgccttctcttttcttctgttcttctctcatttcagactgctcagtagttaatcccacaaaggctttcctaattaagctgatagatttgttatcagtgctttctatttcattgtaaattttgtgtggttacctctagtttgcccatattgtgagtataattttggtatattcatgcctatgtgatatgcctgctcttgctaactagatgaaaagctacttgaagacctgtaggctttttatggtttctctacatataccctcccaggggcacagtactgtatacataatagatatttgaatttttttaatttccaaatagtaaaggtacttctatgatttccaattttaggcagttgctagtcttaatgacatgtgaatgctgagtcctccccagagaacttaagaggcctgtttggctcatcaggaacctctggttcactattctgaatattttgttctttgccagctttgtaataaacacttatcttttattcttctctgctttatttgtgatttactttgaaattgaaataccacactgtaatctctgttttataaatgcacattatatgtttctgtacactggttacttatctactttttacttgtcattatctctgctgttggactgcaagctggtgaataatagctgtttctattaggatagtatcagttgcaactaacagaaaactacctcaggcttaaattgtataggggatgtattaacttacatgtaaccgaaagatccagaagtggtacagactacaagcatggtttaatcagggattttacatcatttgtttgctgttctcctttttgtatcagctttttcctcattctggccttcttctgagtctcaaaatgacttaataaaatgctggccggacacgttggctcatgcctgtaatcccagcactttgggaggccgaggcgggcagatcatgaggtcaggagatcaagaccatcctggctaacacggtgaaaccctgtctctggtaataccacaaaaaattagccgggcgtggtggcgggcgcctgtagtcccagctactcaggaggctgaggcaggagaatggcgtgaacccaggaggtggagcttgcagtgagccgagatcgcgctgctgcactccagcctgggcaacagggcaagtctccgtctgaaaagtaaataaataaataaataaaaataaaatgcttcctcaggcacagtttagggaatgtgagagcctcctgataatcatggaagagttgttttacccgggttctgattggtcattaccacatccagtcactgtggtgagcgagaatgacctgagtcaaatgcctatcactaagttcatctgggggctggagggagggttgcagagagtcagccccacccagtccacgtggttgctatacatgggaagaagtagaatgactgactacagtattcatgaaaacaggatggtttcatacgtattttatatctcaactagtacccaaaagtattatatacatagagcatatatcacaatgtgcatttttcctcatttcattaagggagatggaaggttctgttagggaaagtttaggaataagatgattaaagtgagataaatcagaaatatttaataaggacctcagtgaagctgaagaaacagactcagtagaagtagagccataaggaagaagtacgtggtgaaaacggggcattagaaatgagtgctgaataagctgcagttaagaagctgctctgatacctagttcactactcagaacttagtggtagcagtgcctttgctctcacaagagtgaatgaataggctggtctcagacatttttctataatacctccattattttagtccccagtatgagatgccctcttagaaatgtggtcttttgcttgtttgtttctttgagacacagtttcactctgtcacccacgctgtagtgcaggggcatgatctcagctcacggcaacctccgtctcccgggttcaagtgattctcctgcctcagcctcctgagtagctgggatcacaggcgggcgccaccacatccagctaatttttgtattattagtagagacggggtttcaacatgttggccaagctggtctcaaacacctgacctcaagtgattcaccctcctcggcataccgaagtgctgggattacaggcgtgagccactgcacctggccagaaatgtgttgtgtgttaaatctctttcagcaggtccaaggagtaatgctgtacaagtatcattagtcttaagctttatatgtatttcagactttgcttgtcttcctttgcttatttttaagatatcccaaggtacttcattagttaccacaggttgagtatcccaaatacaaaatgctctaaaatctgaaacattttgagcactgacgtgattctcagaagtgtcaattggaggattttggattttcaggtttagggatgctcagccaataagtatacaagtattccaaaatcagaaacacttctggtcccaagcatttcggacaagggatactcaaacctgtagtgagttttgttataaaatttatttgcaactcagactggggaaaacttgatttgtttgtgccaaagtattttaataactcttctcactttattgaatgatatttttccccccagggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactagtaagttgaacctttcttcaacttcattctttaaaacacatattttatacatagtcaatctgtagcttcctttggaattttctgtgccaccgtagaatctacacctattcctaataaatatttccattcaaaattagtatttgaagagacaagtctatttcaaatacacaaaaatcagattatggaaatttgcttaacagttacttaaaattaaagctaaatacgaacgtggttggaactggaggttattgtgttaagtgaaataagccaggcatagaaagatagatactgcaaggtctcactcatgtgggacctaaaaaaattggtcttgtggagatagagaatagaatgatagcagaggctgggaagggtgtgtgggtgggagacgggatgaagagcggttgattcgtgggtaaaaacatacacttagatacaataaatatacccctgtatttgataggagagaagggtgactatagttagcaacattgcagatggagtatatttcagagtagctagaaaagaggacttgaaatgttcccaacaaatagaaaggataaatactcaaggtaatagatgccccaaacaccctgacctggatcattacgcattctatgaatgtaacaaatattcacatgtaccccattaatatgtaacacctttcgaatcaggtttttttttttttttttgagtcgttttaaggagtgaaatttagtagccaagaaagaaggaaggaaggaaggagaaaacagctccctccaacagagacagagggaggggggattcaaacaaagaggaaacccctcgaatgagtttttaaaaagtaaaatacagagagattattatgtttaattttaattttaccaggctagaagcattaaccatgacttatttattctctgtactttgtatactttcattaatcaattaaacatgcttttctgtgagagaagcactaaactatttgttagaaaattctacataccaggcagggtacagtggctcacacctgtaatcccagcactttgggatgccagggcgggcggatcacctgaggtcaggagttcaagaccagcctggccaacatggtgaaaccccatctctactaaaaatacgaaaattagccgggcgtggtggcgcgtgcctgtaatcccagctactcaggaggctgaggcaggagaatcgtttgaacccaagaggtggaggttgcagtgagccgagatcacaccactgcactccagcctgggtgacagagcaagactctgtctcaagaaaaaaaaaagaaaaaattctgcataccacagaactattgtaggatagggaagaaagcacacaaacttgagtgagttattctccaattaattttatttgcttattccttctcaaataacctatttaactgtataaagaatgcaggtagcctctattccactccttgatgacggctttagggttctagtctcatttgtttttgagtcttaagtctgtttgtaaagaacaggagaatctatttatcgcccttagcttcctgtagaaaaaaaactagaatatataatcaagttttaaaacttcttagtttagcaactgtttgactactaccatactaaatgatatgccaggtgttctctctgctgagcagttgctaaactcaccattagagtttttgctaagtgaaagtgatgctgtcaggcttagataataattccactttggtataatgctttatagattccatagcaccttcatgtgtatattgtctcatttaattctcaattagcctgtgtcattgcaaggtagagatgtggaaactgagttaaaggttattacttgtccaagatagttcaaaatagagctaggaccaaatctctaagtcttacagtccaggtcaaaaaacaagtacttttttatctggttatacagaaatctggaaacagtcactcccagcctcacaattaaaaaaacttggatatacagaaagttcatagttttccttgaactcattatagtgctgagatttcacggcaaccaactggcccagatactccagagtcaaagacactgtaaggagagttgacatttgagcattagacaagacacagatggtaagagttaagctagggtgattggtgaattgctggaggccaggtgtacactgacagaactgtgtgaaactcctgggggccgcagtataacacagggtgagtctgtgttctcttgtatacttttttactccgtgaatcccatggggtgctcagaagctcctgaaaaggtctcgctgtggtacacaactgggagaggggaagagtagccactacactaggggcaaaaagttttgccaggatctttttgtcttctttctctaatatgaaacaaaagctttaatctctgagaagacgaacaacaaacattatcactcttagggcactgttgaaatcctgtttaatggaaaaggcaaaatatctcaaccagtggtgaaggaacaggaagacatgctcggtatggagcgatgccaggagagtggcaggatgactgagaaggccacagcctgaggcacaacaagagaggggatgacttaaagctgagagtggagcaggcactaggggaaaacctggcatgcagatccccacccccagagggatatgaagcttgtggtaggtgccctgatggtaaccagagcaacagtaaggctcaaacccagtccagcttctaatgaaattaactcgattcttgcactaatagcttagcaggagggaaaaacctgtaggtctattagtaggaattacccatgctgaaatacaaagagaaagaagagtgaaaacaagacaaaataaacagaattaagtatccaagagctatgcaccattatcaaatggtataacatatttataattggacttccaaaaagagaagagagaacagattaggagtaatattttaaataataaccagtaccaagtaggataattactactgccaacacacacatgcacgcatgcacacacacacacagatgtatgcacgcacacacactctcactcctagactgctaaaagcaaaagatcaagagaaaaatcttagagatacattacagaaaaacaaagataaggattagtaacatacttttttcttcacaaactaaactattcaagcgagaaaaagggagtaacattatttaatgtgctgaaattttttaaaaattcctcaccccaaaattctctacccaccaaaaatatctttgagaaatgaagatttcctcaaacaaaagtcatgggaatttattgccagcagacctgctctacaagaaatgttaaaggaagcccttcagcaggactgtgatcccagcaaaaactcgagtctacacaaagaaatgaacagtggaaatggaataaatgaagataaaataagtaaactctggttttccctgcattttataaacgttttatttttagaacaattttagatttatagaaagattgcaaacatagtacaggaagttttcatacaccccacacatcattttttctattaacattagtatggtgtatttgtcacaactattgaaccactactgatacgttattattaactgaaattcgcaatttattcagatttacttatttttaaccttgtgtctttttctattctaggatccaatccaggataccacattatatttagcaatcatgtctctttagcctcctcttgactgtgagagtttctaagactttccttgctttaatgaccttgacagttttgaggagtactagtcaggtatttttatagaatgtctctagttaagatttgtctgatgtttttctcatgcttatactgtggttgttggtttgactgaggtaggccatagaattaagatgccgttttcatcacatcatatcaagagtgcctactacatttattatcccttatctgatactcaggaccagaagtattccagatttcagattttttcaagttttggaatatttcccttatactaataagtagaacatcccaaatccaaaaatctgaaatccaaaatgatccaatgagtactacatgcgagtgtcatgttggtgctcaacaggttttagatcttggagcatttcagatttcagattttcagatttgggatgaccaacctgtatcgtcataactattgctgatgttcatttggtcacctggctgatgtttaacaggtatttaccaggtttcttttctgtgaagttactctttctcccgcttttcatactgtagcctttgggtaggaaattaccatgttcagcccacacttttaaggagtggggagttaaggcttcactttcttaagagaaggatatctacataaattatttggaattcttctgcacgggagatttatctcttctctctcatttattcaaccatttatttctatcaatatggactcgtgggcatttattttaatactttggtttataatacaataccacgtttttctgttgctttgttctagcttcagcttttgagggctatctacttgattcctatgtccctttgatatatccttatttttgtgggttttttttttttcagggggagcaggcgcttttttattttccggcactataatatattctaggcttatcttgtgtattttctgccccagtcctagaatcaggcatttctccaaggaacattatttttatggagaatgaaagaaaccaagatccgagtgctttccctctttttaattgctccaaaaggtatctgactatgtaaggcaaaaatagtaactgtattttgtttctgtagcacatgtaaaaataaaatatatgacaacaaaagatgggagggaggaattgactctacacatgatgtaaatattatttgaagatgaactcaaggtaactaaaggtgtatattataaaccctagtgcaactacagaagaaaattttaaagaagtataaataagtcagtagaagagataaaatagaaatataaaaaatgctctactaagtagcccaagaaatgggagaaaagaagacaaaaagcaagataatggtagcttttaatccagtcatataagtaatcacattgaatgtggtgagaaagcgtcagttaaaagattgtcagatttgtgtgtgtgtgtgtgtgtgtgtgtgtgtttcttaaaaagcaatgtggtggctcatgcctgtaatcccagcactttgggaggctgagacaggcagatcacctgaggtcgagagttcgagaccagcctgaccaacatggagaaaccctgtctctactaaaaatacagaattagctgggcatggtagcacacgtctgtaatcccagctacttggtaggctgaggcaggagaatcacttgaacccgggaggcggaggttgcagtgagccaagatcatgctattgcgctccagcctgggcaacaagagtgaaactccgtctcaaaaaaaaaaaaaagaaaaatgctgcttacaagaaatccactttaaatataaagacatagataaaagaagggagaaaatttaccattgcaaacaccaaaaagaaagctaaagcagacctattaatttcagacaatataagcttcacaacaaggaagagtatcagcgataaggagggacgtgacatagtccactttccaagaaataactgtctttaatgtgtatgcacctaacagcaaccttcaaaatacataaagtgaagactgatagaactaaaaggtgagtagaaaaatccacaattgtagttggagacttctatatccctctcagtaactgatagaacaagtaggcagaaaaatcagtaaggatctagatgatttgagcaacactcgaccaacatgacctaagagacatttatagaacacatcactcgacaacagcagaacacacacttttcacaagtgcacatggaacattcaccaagatcacatcctgtgccaggaaacaaactggcaaatttcagtgaattgaaatcaggcatattatattctctggccataaggaaatcaaactagaaatcagtaacagaaaggtagtaggaaaatggccatatatttagacattaaacaacatattttaacccaaggaccagagaagaaatctcaaaggaaatttaaaaatacatatagccaaatgaaaatggaaatacagcatcaaaattttgaggcccaactagagtagtgatgaggtgagatttatagcaacaaatgcctatatttgaaaagagggatcccaaatcagtaatctaagctcttaccttaagaaactcaaaaaagaagagcaaacttaaccccaatcaagcagaagaaaggaaaatgtaaagtgataccaattctacacagtctctttcagaaaaaattaggagagaacactttccaacttatttttttaggtcagcattaccccgctgcaaaaccaaagtaagccaacacaagaaaaaaagtctacaaatccatattcctcatgaactctagacacaaaaatcctcagtaaaaagtaagtaaattgagcaatatataaaaaggataatacatcaagaccaagttggttttatcccaggaatgcaaggctgagtctacatttgaaaattcattagtataatcagtatattaacaattgaacatctattcatcatttaaaaaaaaaaatctcaatgaactagtaatagaaaggaacttaataaagagcatctacaaaaaatatacagctaaaatacttcataaggggaaagcattcagtcttctagcatttggagctaggtaatgatatttttttttctcaccagtcatatttaccatggtagtaaaagtcctagccagtacagttaggcaaaaataaatgaataaaatgcatatatatcgggaagagagaaattaaacttcctctattcataggagatagattctttcatgtagaaaagtgtaaagaaattacaaaaaaaactcctcggaccaatcagtgagtttagcaaggttgcagggtacaaagttaatatataaaaatcgattatatgccagcagtgaacaattggagtttgaaatttaaaaaaaaaaatgataacaccccaaataaaggaaggaaaagaaacatctaggtaaaattctgacaaaatatgtacagtctgtatgttgaagactgcaaaacactgatgaaagaaatgaaagaagacctagatgaatagatagatacatcatgttaatggatttcaagactcagtattgtcaagatgtcatttcttcccagattgatctgtagattaaacacaatttcaaaatcccagcaagctcttttgtagttactaacaagctgattctaaaatatataggtaaagacgaactacaatagctagaatgattttaagaaggaacaaaattttaaaaaaatactactactacccgatttcaagacctactacaaagctatagtaatccagaaagtgtgatattgacaaaaggatgggcacatagatcagtggacaaaacggctcagaaaatttacacctatacgtatatattcagctgggtttttggcagaggtagtaaggcaattcaacagagaaaggatggtggttacaacgaatggtgttgaaacaattctacatccatacacaaaacaaaaacaacccaaagtctgaaaataactcaaactttattaaaaaattaactaaaattggattatagacccaaatttaaaacaggaaactgaaatttagaggagaaaatccaacacaaaaagcaggatccataaagaaaaaactgatgtattggaggttgaacttaagttttgctctgtgaaaggcactgttcagagagtataggacaacctacagattagaagaaggtatttgcaagtcacatatccaataaagagtttgtatccagaatattttaagaattcttaaaacccaacagtaagaaaacatttttaaaagggcacaagatctgaacacatacttcaaaaagaagatacatggatggcaaataagtgtatgaaaatatgctcaatattatcaggcttagggaattgaaaattaaaacctaatgagatataactgcacatctagtaaaatggctaaaatttaagaaaacgcaacggctgggcgcggtggctcacacctgtaatcccagcactttgggaggctgaggcaggcagataacctgaggttgggagttcgagaccagcctgatcaacatggagaaaccccatctctactaaaaatacaaaattagccaggggtggtggcgcatgcctgtaatcccagctactcaggaggctgaggcaggagaatcgcttgaacccaggaggcaaaggttgcagtgagccaagatcataccattgcactccagcctgggcaacaagagtgaaactctgtctcaaaaaaaaaaacaaaaacgcaaaaactagaaatgctggtgaggatgcaaagcagaaaatctctcccatatctttggaatgcaaaatggtacagccactttgaagagttggtcagttcttatgaatttaaatatacacttgctggccaggcagggtggctcatgcctataatccctgcactttgggaggccaaggcaggaagactgcttgagcccaggagttcaagaccagcctgggcaacacagcaagaccctgtcttaaaaattaaaaaaaaaaaaacaaaaaaaacttgctgtacaatccggtaatgccactctttgagtatttacgcacatgaattgaaaactatacttataagaaacccgtatctttcataattgtgaaacactgaaactagcctagatgtccttcaacagatgaatggataaacacactgtacatccatataaagaaatgctactcagcaataaactgtttattcacccagcaatacagatgaatcctaagtgaattttgctaagtaaaagaagcagtagtgtatgattccatttatatttcattctggaaaatgcaaaactcactggctgccatgggttgggagtggagagaggagttgactataaagggttaatagggaatttttgaggtgatggaactaatctgtgtgatgctgttttgttagatgcatgggtctgtgtttgttgaaactcatgaaactgtacctacaaagagtgacttttactaaatgcaatttagtaaaaaaagattccgggggagcccaagatggaatgcatattgtcacacatgaatataactttattacagataagtaacatgatattgaaggggtgaggaagcaagaacctggtctaagtaactttggaaacttttgactggatactgtaaggttagagaccaacgaaattgtagcaaatcactgtgctctagatggtaaattcatccctcacatacacaaacacaaagggttgaacatataaataaatataaaatgtaaataaacaaatggacattgtagataaaggcagccaggtttctcatggttggaggagaaagttgcagataacccagggggttgggggtggggtctagaatgagcctgtgtttcagggttatagttgaaggattcagtaagagtttatatgtgtgtgtgtgtgtgtgtgtgtgtgtgtgtgtatatatatatatataatttttgtatttttagtggagactaatttttgtatttttagtagagacggggtttcgccatgttggccaggctggtctcaaactcctgagctcaacatctgcccgcctcagcctcccgaagtgctgggattacaggcatgagccactgtgcccagccagacacatacgtatatatgtgtgtatatatacacacacacacacacacacacacacatatgtacgtatgtgtctggctgggcacagtggctcgtgcctgtaatcccagcacttcgggaggctgaggcgggcagatgttgagctcaggagtttgagaccagcctggccaacatggcgaaaccccgtctctactaaaaatacaaaaattagtcgagtgtggtaggatgcccccatagtcccagctacttgggaggctgaggtgagaggatcgcttgagcccaggaagtcgaggctgcagtggcctatgattgtaccactgcactccagcctggctgacacagcgagaccctgtcacacacacacaaaaaaggtacagttgtgtgtacatatgaattagtatacatcatatatttcctagctctgtttgctgagaggtctgtgaggcaatagcatccagtaactgaacatacctggtgctcagattttagtttcagaacaccattttctaatacaaggactcagggctgcttggaaaaaaatggtttgttgtagagctggggcagggaaacgggatgagccggggttgtcagaggttaagaaagtgcgtatcaaaagtcacgggagctggcctttcaaaagagtttccagtggccaaaactagaacaatttgagtaacaaaataacaatagtattggattatagcccagggaataaaaaacattgagtccattactgatataaataaatgatagaataaataaggggaaaaagggacaactcttccttagaaaataactaattaataaatgtagaaagaatgagagagagtaaatcagcattagaacaccacagtacaatggtaattgttgcaggcaaagtcagtggataaatgctaacataagtgggcaaaaagtttaagtaaaaagctattttgctttgtctcagaatgtctcttccccaatattcatttcttacaaagggaaaaattagagaattagaaataagagaatcctggaaaacactgccttaaccggaggatcaaggttaacatcaccagtaatgggacataaagacaacatgtgccttccaatatgacatgctaagaaagccatgtctctttgtggtattcttgcaaaaatccatgcccttctatctgattatgaatgaaaatcagacccaaattgagagacattctataagataactgatcagcactctttcaaaacaagttgtcaaggtcatgcaaaacaagttgtcaaggtcatgaaaaggaaagactgaggaactgtcacagagcagaggagacgaaggagatgtgagaactaaaggcttgtgggatccaggatctgatcctgggtcaggaaaaaggacatcagttgaaagactggtgaaatccaagtaaagtccaaagctttaattggtgctgtattatttttattagtttcgacaactgcattgtatttccttgtgatgttaacaatgtggaaagctgagtgagatgtgagggagctctctttgtaaatgctgtctaaaattatttcagaataaatagtttaaaatatatacatacatacataacaaagaaatacaccccaaaagggagccaagaaaaaatggcatttaggatggtcccatagctcacctttcaggtactggatatgcaatacttgctactgtctttcagaaataaactctacaaaatgtcatgtagggtacagaaatgtttacaagaattgttagtaaactgccaatttagagacaaactccatttaagcattttagcaattgcttaataaagttatgtctgattgttaggagagcatgaaggatctccatggaaaactcaaaatgtgtcgtatgaactatttacacgcttattcctgtatattaaagtgaaaaccatatgttttacacatacacagctataatgttagacagtatattttggtgtgtaccttgtgtttggagatatgtaaagatatctataacaaaacagttgaatagcatcttgcccacattggagatagcagttgtagatcaagtgattgtttttcagagtaagtaatcggtcccacctactttacacacaccatttacagagaaaccttcttccagattagggcttcatgtatcagtggcacttacaatgacacttttcacagactgacagagaagcttaacttactcaagtaaaacaagtaaaaactgattagactgtttctagcatgttaatattttctaaatgttatggagaaaaggagcaaaaatgtttctttttttttttttttttggacggagtctcactctgtcacccaggctggagtgcagtggcgtgatctcagctcactgtaacctctgccgcccgggttcaagcaattctcctgcctcagtctcctgagtagctgggattataggcacctgccaccgcacctggctaatttttgtagttttagtagagacaaggtttcaccatcttggccaggctggtcttgaactcctgacgtgagccaccgtgcccagccttatttcttttctttacatgacttatgaattcatttctccttcagtctcattttcttcaaatatgtggtttttctccattgaagtcattttattcacatgaaaatatatttgcaaatgataaacatatataaaactggtatttaaaactcatgtatttattaacaaatgtttgtgttcctgttgttttataactgctagctcctgcgggaaataaaacatacagcagtttctttctgccaagaagcagaattcagtaggagatagataacatgtatcaccaggtggggtaatagtagggtgattaagatacagagttacaagtacagagttgatattctcacagttccaaatacagatcgatagcatgatgaggaaccccttttaaatactgttgcagtagcatgactatgtataagaggccagcatgagagcagaccaagttggggtaggagggtgtctttgaatactggccctagagaatttaaaataatttttctagtcttttgaaaactcaacaagtagagacaagtaatttatatttctatctgttgtgtatataatcgtctctttagagttccagacagctgctagtgtccaaatatgttttttctaaagaaatattttgtttgtgagtaccaacagtcttagtaactctcttatccctcttatgtgctgagtacagtcggaggaagaggaattggagttggtgagtgtgggtttctgcttgaaggaagttgaaaaagatgtagaaagtactaattctcttacgtgttgttatctaaccaatgttccctttgttacacaaatttttttaaacactattcaaacactttgaataaagcaatctactggtactacagactctagtttttctatttataattgtatgtgttgacccattttatttgttggagggaacattggaatagagcctttaaaaacagtagctgtccatgagcataggatacttgttaattttttttttaaggaaagatacaaaataccttatatagctctccaaattattgaaatatttttagaaaatgacttcaccctcgaagttcctcagattgtaacacacgatgttgtgttgtttctctttcaaaaagattacatcatttttggtgaggtcacctttttcagcgttggaattatttcatcctgcatgatacagcctgaaccacaagggggttccctgtttactaaaaggaatgtctgtaattgaatgtgtatataagtttacttttctatcagaaggcgctcttttcttaaaagcaactattgccctttttccaaaacaaacgttttctgttggcttttcctctagaaaataaacttgactaaaagcagcttgcagttgatctatttcttctttaggaactaaaaccaaaacctcacaggagtcatcatataatttcaaagtcagctgctaattaaaggactttaaggggaataaaaacttgaaaatgtttcttagcatggacaaaggttaagagtgcatgaaagcatgggggaggaaggcatccgttggttttaatattccatgtttatgcatgctggtgtgttttgcacagtttgttttcttttcaaagaaggttatctgttccccttaaaatacgagattgttctttatttagctttgtgatcactcacagttttgggtgtagttttgtattggccaactgaaatattctagtcagctgtaaatgttttgaattatattatgaatatcttttggagaaacactttacttaatgataccataatgatcagtaaatgagagtttataattcaagctaaaataattcaccttaggttagacctcactgttcaaggagttgtgaatgcgtccatgaattatctagcactatactgccctcttgtggttctgaaaatcactcactcttgtagaactcagtgccgttgagatgaggagcttagatgagtggaactagtgtttgaagtcttcactgcttttgaagacatgccaggagattgcatgaagatgatgccatggagtaggtagggtccaggccaaactatgtcatactgtattctttcacctagtgattggacttatgaagttccagactaaatattaaagaagaaattaagtccaaagtagatctctatctcgaaaagtcattaaatttataaacttgatgctgagactaaaatatattccgaactggcatacattgattttccacattcctcagagtacatctgtaattacagaacctcagagataaatatattaggtccttgaagactttaaaatacatacctaaaaacttataaacagccatttatattatttaaaacttaatcaattaaaaatgcagaactttatgtgccagaaccaaaatataatcagaagcacagtccgttacaacttagaaagttgttcagcttgccttgagctctaaagtataattgtggatgactctgatccgaagtgcagaaggacaggtgccctggggcctgcactaaagactgtactgttaagaccagcgacagattcctttagaagccgagcaatactagaacaacttgacttcatgaaagctgcagtagactaggctatggattagaaggaataaaaatatgtatcttttttcccaccagttatatagaaatttgggacagagggtttcttaggacaataaggatattatcttatatttgtgtagtacttcagttatgaaagcacttctgacatagtaacctcatttgattctcacagtagctgtgcaaggcagccaggacaaagattgctatatcttctttatttgacaatgaagaagttcagagaggtcaaattattttcccaatgcctaggaaatggtgaatctgggacagaaactcaggcaatacatccacatccacatgatctttctcacatcttctaacctaggttagaaagtagaaattaaaaagaaataaactgagatcaggatcctcatcgaatgtttgtaagtgtctacatctagccaaaggcctttttgtctgatgtacccttttgaaaattgtgatagagaaaatggaatcacattctaactcttcataatctcaaaggcactgaattatactttactgatttggctcagacccccgaatgtcagttatcaggctgtaacataatttataaaaaacaaatagagttgtgctgtggctttcttatgtgctagtgacacagagtctgttgtgttcctctgatctttgattttcaaaaaccgttaccttaagccagtttggcgagaaactgcttctgtcgtactcctacacgttaaggacaatgactgtcttagactaactggattatttaatagttgaattttttttatccattcccagcatggataggatgctacacagatgcatccagttggcaaaaagcatttaatattgctcttccactgccctgtcggcagtacttgattcaaaattctctactcaaagcctctgctacagaaggccaggggactatgaagggatacatgtccgaatctgttgttaaaaaataggtcaactgcatgattggagagaaagaaataagaatacaagctgcacccaataagccatgacttcaaaccgtgttaacacgtaaataataccgcaaagaaaagtagttttgattcctatactcatagacgtacaatccctatatatacagatgacctttgccatcatcaggtatttaaaacctacacatacttcatttaggggagtctgacagtatttgtagtggcatcaagtcctcattttgtgcaacaaatagaagtgctaatgcctgtaacagaagttcctattttaacgtggggtgtctgacactaatcaactattttaaaagaattaatgtaaaaataggacccttcaaattaaatatttagttattctcactagtatttttgaagttttcacatcatcagtgcttcagaaaatgacattcatatgaaactgtgaaaaatgtcacttaaattgaaagtgatttttaagtcaacataaataccacatcagaacacattttctcttttttgatctcacagaatacccagaggatcagtagttctcaagccactcaacctcttgctaccccagtcgtgtctgtgacaaccccaagcttgcctccgcaaggacttgtgtactcagcaatgccgactgcctacaacactggtgagcctgctctggtgccttccgtaggttttaccgctctctgttttgtgatcaacgtgtgcttctgtgattttttttaagtatatttattgaaataaactatttccagttttttagatttaaattaggatgtatttttcaatgtgctagccttgaaaaaattacaaacaaaatggatagtgtggatagtgcgatgagtaagttattccggcttctccagtgtgaactttcacttaacccctgacacaaagccacgtggatgatagcaaaatggtgacatgcatcaagccaagaggggagcagcctgttgcttgagtattgctgatgtagtttctcttcatacagtatcacgcttttccaggcttttaaaataagatgtttgtctttatgctgtgttaacctgctttgggaaagacatgaatccctttggacctgagacttcaggaggtggccgacgtttggctgtgtcgaacaggctgttttcctccctgtaaccactagcttggtccatgtcatgtgcacctgaggggcaaaacaagggctgttctgatttctcctcggagccagtcactctgcctttgaggggagcttttccttcatttatgtttatttaggcatttcatcttaaaatgccctaatttggggttgtattaggaaagtttaagaatattacagtgatcgtaggagtgcttttagccaagcagactgtatggagaatcgagggcagctggtttcatttaaatttaccaatctaagaaggagtggaaaacacatgtggtttcgctttctcatcagctgagccaaacacctgatgcttcagaggaagacggcagtagttcaattctcccttgcccattactcagagactgcaatgcagagaagttattatgattctcctgagtgtcataagtagactgtggtaaagatggtctgattttagccttcagggtaaatgctttggcacagaactttgaaactgctgtccgcagctacgtgaggggacagagcgttgataacatttgattgccacttgaattctaagaagttcttttaaaacagaatcaacaataaaaggttttattgaaaaaaaaaaagtctcttaggaaatatccattacttttccaaccgttagtatgaaaaataatgcccaaatttgtcaactgcatactatcttagggattgtgaatcatagcctgttattagtgccttgcacagaacaaggttccagagtaaagccagggatgaagcattcatagaaattctgtttcgacgcattgatcacctgctctgtgagagactgtactagggacatagctttctccaagtttattccaagtgaggaggcaggacatacctaagtgggtaaccgtggaggggaagtcctgaattgttgtgattgtgaatttatactctgagaattgagaagggagggcaaagctatactgttcaaaggtgtattggctgagaagagggagcttgaactgggtgtcagattatggtttactgaccgtttcattacaggtttttcagtatacttagaaattccactatacttatttttagaaatgccattgaattgggaatttattttttaaaagtataaaagaaattaccaaagcatataaaaatggaggcaggctctcaaaatcatcagtcgcttagcgtcagtctcatgccaccttttgaccgactttatctttcttctctttctcgtaacacttactctgtttgaagtttaccatgttgtttttaacttatttccacatctattcagcaaatatttatcaggcagctgctgtgtggcaggcactgtgccaggcactggaaatgcaggagtgcagtcagcagtgaagcctggggggaaggcacaagacacacagctctagggataagctgctgcagttgtgtcaagggctgtgtctcagctcggacaggaaggaacatgcgtgactcagccaggcagaggaggcagagtgctcttgggagagggtgtgcctgtacaaaggctaggagtttgcgggcgggacggggctgaaggaatggggacagagcgtgggtggttagaattgagactagagaggtaagtaatgatttgtagactatgtcaaggattttggaaactgtccggagagcattggggagccataaaaaacttttgaagtagaggagtgccatgaccatatttgttattttaaaaagatgtctttgctgtatatagggttaaaaggcaatgccaggaagccacatcagaggctactgtagtggtccaagcaatgggtgctgatagcatagactagagaggtggcagtagagatggtgagacctgggcaggcttgagagagagcagatagaattgctcagacctggaaattgatgttgggagtgagagggaagggaagtagcaaggataacacccatgggcttctgcacgagctgctgggtgcatgttggtgccatgtactaagagtacttaaggaggaacaggtttgcaggaaaggatgggccatgtcagatgtgtggcgtttggagtggcgtccaaatggacatggcactaggtcgtttaaaagatctagaggtcgaaggagactgtgggccggagggagcactggggaaggcgtcagtgtgacgggtccttgccccagcccatgggagtgtatagaatgacaagggcagagtcaggacagccctgagcaccagctgtgtcgcttcaactccgttccttttttaaaatgttaattcactaggaagaccaatttctttaaacacctctcttgagacatgagaaagaagataaaagtagaagagttttgccacctctctttggaaccaagtgagaaagacaagtgttaatgatgagctgaaataactccccgtgtgagtgataactaacgtcctaaatcttggtcccagtgattacgactgaagcattcatatgatatgagctgggtatactctaggacaccgagttttttcatgaagttgaaactcttgcatgctgtcagggagtttgcgacagtctaggtactttaaacaaatgcgcttactaattgtgtaatgatgtcactgagcttggcaccccatgtagggattctgtctttcctgtcccctattccctgtcccccaaccccttgcttcattaagacttgctgattcaaactcactctggttgaggttgagtgtttctctttgttccaaagggtagtggcaggcatatttaaagtaacaattgtacagaacactctttaatgatggcctcttatttgaatcatcccagacaaagaaatattgctagatcctgtaaatcttccaagaaaagattttgcggattttagacccacatgtatgttgttttgttgtgaagtatctggcttctctcaatgtaggaactttttattttatttttttttgagaggaagtctgttgcccaggctggatggagtgcagtggtgctacctcggctcactgcagcctctgcctcccgggttcaagcagttctcctgcctcagcctcccaagtagctgggactacaggcatgcgccaccacgcctggataatttttgtatttttagcagatacggggtttcaccatgttgtccaggctggtctcaaactcctgacctcaagtgatccgcccatcttggcctcccaaagtgctgggattactggcatgagccagcatggctggcctcaatgtaggaacttttgcagtagctacgtaaaaaatagattccgtatggaccttccatcatatgcagagccctcttgtcttcctttgtagattattcactgaccagcgctgacctgtcagcccttcaaggcttcaactcgccaggaatgctgtcgctgggacaggtgtcggcctggcagcagcaccacctaggacaagcagccctcagctctcttgtgtgagtaactagaagttttccctgcatctttactcctggcctacacactctcttttcctatcagtgacagccttttgctctgttgagtttcgtgtgaggaatcctgtaatgattccttttcaggtagatacaagtgtcgggagaaaatattttcttacatggctctagacagtagcttggatactgacaaactaggcattccttgaagggatttggggagcaaggcttctcccatagggacatcctgaggtagagagactcaaccaggatctgaaggggtctgaaggcacagataccacccgcatgcaccatccttctgccctctgaccagtgatgaagctgcctactgcacccctgctcccaagcacctgcctctggctgcactgcttgaaaggcagcctgtaggcattcaggcctccctgccacccttgccattgactgctttggtgagtatctgtagacaagaataggaagacaagctggagcttttgctttctccctgggccacagggaaggaaaactggggacagggtgtcttatatatcagtcaggctccataggatttgtgtgactgatcccagcccaatgcacacaccaaacctcattcacaaagagaatgttccgtatgggcagggtgtaaggatataagcaaagaggatttacagtggcgcccagatgaggccagacatccctgacagccgggagaaagaacagggcttttgtggaaccaggatgacagcagacccatggagcagttggaggagagtgtcccaagagaggggacaacatagcagacccagctggcctccatgaagactggctgccttgcctgtgctctgggcagtaggaataccccaggcccctagcctctgcccaggaagtccccagagagcctgagctcagcagtccctttccctcatccattctgaagtaactgcacagtgaggattgttgtcagtggtcttcttaggaattatgtcatggaaaaagcagcagagtatctcagggaaatttgcctacacaggatttggccctcaggcctgtcctgagcatcctaaatgaatgcactaaaaatagtcctggaaaagcaagtggaaagggctcagagcccaggcccggggaacagcctgtttgcgtcctcctctactgctctcagccagcccctcatttcctcatctggaaaatggggatggtgcgacttgcaccttagaggtgttgcgaggatgagcgatgttgtgccctgtcacagggccagagcagatggggagcagatgctgaggaagaagaggcggtgagcagatgaggctgctgttcctctgtctttctggtccctgcacagcattaagacactgacattgttttgtatactttagctgcaaaagtaccaacgttgtgggtaacagaaccaagtaacgtaagggctcaacggtactgttttctttcctcctaggaagatgggatttccttttgtgccaagcactgaaggaaacgacccaaaccagtcttggggaactctgataagatttcagactctgggcccttttccatcaggcagtgtctctactgtatcatcccagttttgcagaggtacttgcaagccatctgacctctctcttttttttccttcagtgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttgtaaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttcccccccccccaccccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagaggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttttatc

SEQ ID NO: 37728 - DNA, 53108 bp, Homo sapiens
gcggggcctctaccggcccgatggagcgcgcgggcgctactagccgcgggggccaagcgcctggcttcttactgcggcttcatactgagggccgagccgaggcggcgcgggtgcaggagcaggacttacggcagtgggggctgacaggtgagcgggctccgggcggacttcggccaggcgggccaacctattgggactgcctcttgcgggccgggggcgcagcgggtgggccgcccggtgggcagtttacccgcccgcgccagggccttccttcgctcctgccgtgggcggagagaaactgcgcccgggcttggtggccacggcccccgcctgcgcggcgcgcggggccggcggacgccagatgaatgaggtcgcgggcccggtagccaggcctggcccctggcctgtggaggggaaacgtggtgagatcagcgccacctgcaggcctccgctgaagagttggacggcctggtgcaccaaggatgtaggtttccagttgctgttccggtgggtttgggtcccggcctggggagtttattggttgcttctgtaaaacgatcaactcatctcccagcttcagcttctccgtttactgtgcgcgcgcagttattggagaattcgccacggattaattctccggatcgagttacgtgcggtagtgagcggacaaactcaagcaaagcactgtttatgaagctatttttgtgtcttgagtcattcataaatactgactgaaccacgtactatatgccaacttagcttgtccgctcaccaccgcacgtaactcgatttattgacactagcccttacggagagtctgcaaagcgcgaaccttgcatgccccccagccctgccgctgcatggctgaccatacttcctgcagctccgagaccccgctctcctcctgggtctgcgctgactcgccgctgaaccgccccagcctcgttttccttacttataagttgggaacgtagtgtgtgctttgactgtattgacagaatcatgcatcagtaataatacagtcgtttattcattacttattgaatgctactgggagcgtattcttaggcattggctacaaagatgagcaaaacaaatagggacccttcctacctagagttttagactagtgagagtgcatttaaaagtataaactaatttatttaagtgctcagtaccacgaaagagtaaggtttgtcattctaggaatgaaacaaaaggtgcaattctgtgttcagcttagaagactgaaagatgaagttgaatggagaggacgctgacatgaaagagaaagacctctctccttgattccctgagtctgtaagaatgtgtggctgtaaggagtatgtatccagttttaagtatgagcttgtagactggtctttttatgtttgactttatcttaacgaaagtttatgtttgtgggtttgcctatttccttgcaagtgttgggaatggttctttaagaacttgtgtgagagagggctcagaaaagtgtgccagttgatacttagctgtggataatatgccaggagaaacgtacatatgggcaagtgttttagtgaaaatgaggagacaagaggttgcaagtttgagtggatggaatggagtgagtaaattcagaattaagtaggcaaatgtggcaacttggataaattggtagtggagaaggaaaatagaaaagcagagtcaaaggaatggctactgaatattataacttgtaatttctatttctgtttaccagaataaactagtgttatgagaaactattcttcatgagttggttaaaaaaattcttactactttttttttcgtttggttacagaagtagtacgtattttcagtaaaacattcagggaaatagcctatgcataaagaaaataaatattaatctccataatctccttactgttaacatgttctctatcctgtataatttcttttactttctggtggagggggaaggtgaaaaatggagtttcatgtacatttttttgggaaatcataactttttttccttatcattcagtcttcttcaacatcattcttaatggttacagtttttcagtatatggatgtaccatagtttagacagtccctcttcttggtatttaggttctttttttttgctattgtaagtaacataaatatccttgtaaccaaatatttattataggtatggacgtttaattcctgaaaggtaccatttctagaataaagagtatgcaaaatttttgcttatttctctatactctcagcaacactggtattttctaatttgagaagttaatatgctatcgtattgtttaatttaatgtttatttggttaccaatattgatggacatttggatattcatctttggatcatgaagttaccttaggacctttttgtttctggaatatgcagacctattacttcttgctgttttgcttgctttttcactacttgtcatctccctgacagaagggcaaaagaatctacatctggaggttaaaaagctaaagactacctttcccagaccccactgtagtttggttgtaaacgtgacttggctttagccaggcacgtgactgggagatttggaaggggaaagtgaggggaaggacacagaggggtttggattttccgcttcccacttagctactacctcatgggtctctgggagggtacagagcattcattttgttatcatggattgtggctgcgttgataggtccctggggctgacagtaccgtggcctcctggttggttcctggcttccaggtcgtggaggtagatacttccttggtgtgtccatactgtggtgcttgatttagcagttgtacccagaagatcagcctagatgttactcctccaggcctttcgacaattttgtggtgatctaattccctgtattacattcctttctgcctaacctaccaagggtaatttctggtttttgctgttgactcctaagtgttaagtattgttatctttgtggatataattacatattatttttgaaaattcaactttttttttttttttgagataaggtctcactctgttgcccaggctggagtgcagtggcccattgcagcctcgacctgggcttcagtgatcctcccacctcagccttctgagtagctgggactacaggcatgagtcaccagttttaagaaataatacggaaggatcccatgtaacctttacccagtttcccctcgtggtcatatcttgcaatgtggcacattatcacattgtgtacacttgcaatgatggtacactatcacaacaggatattgacattggtacagtcaagatccagaacattttccatctccacaaggatccctcaacttgcactttgatagctacactcacctcccttctacctcaccaattccttaacccctggcaaccactaatctgttctccatttctataattttgtcactttgaaaatgataggtgagtaaaatcatacaatatgtagcctttggggactggctttttttcactcagagtaattctctggagattcatccaggtcgttgcacgtatcagtagtttctttttattgctgagtagtactccacagcacagtataccacagtttgtttcaccactcacccactgaaggatatctgagttgttcatagtttgtggctattgccaaaaaagaaaagaaagatattgtaaacatttgtatacagattttgtatgaaaataaatcttcatttctctgtaataaatgcctaggagtgctgtgagtgggtcatatggtagttgcatgtttagtttttaaagaagctgccaaactgtttccagagtagctgtactattttacattcccaccagcaatgtatgactgagtttggattctttgcatccttgccagcatttgatattgctacttttttatattgactattctaatgtatgtgaaatgctatctcattgtggcttagatatgaatttccctattggctaatgaaatatgtaacctctttgataaaatgtctttttctgtcttttgcccattttaaaataggatcctttgttgttgttgttttttcactgttgagttttgacatactctagtctttatataatctagatactaatattttctcagatatatgtcttacaaaagttttaaattttggctaaaatttatcagtttatcaattttttctcttatggatagttttcttgttgtttggtgtcaaatataagaactcattggctattcccagatcctaaagagttttttcctaaaagttttacagcttcttatttaagtccatgatctactttgagttaatttttgttgcacaaattttgatatgttgtattttcatttttatttagttcagtgtatttatttccctggagacttcctcttttgatggactgtttagaaagaagtgtgttgtctagtttccaagtgttgagagatttgcctctaatgtttctgtccatgaattctaattttattacattgtggtcagagaacatactctgtacaatttcagttcttttaaatgtgttggggttttctggccctgctttagtttggatatggattatctgtccccaccaaatatcatgttgaaatttgatccccagtgttggaggtggggcctaatgaaaggtgtttaggtcatgggggcaaatccttcctgaatagattaatgctctccctgagcagggagcagagagagtgactgacttcttacttactagcttccagaaagctggttgttaaaaagagcctggcatcccccacgcctttcttcctctctcaccatgtgatctctgtacatgccacccccacttccccttctgccattagtggaaacagtctgaagccctcacctgaagcagatgttggtgccatgcttcttgtacaatctgtagaaccatgagccaaataaacctctttttatttttaaattatccaacctcgagtattccatagcaacactaaatggactaagacaggccctgaatatgttgtatggtccatggcacttgaaaacaatgtgtattctcctgtctttgggtatcagcagagctgcattcctttctggaggctctaggggagaatatatttcccagcatccagaggctgcccagatcacttgactcctggcccctttcctccaacttcaaagccagaaacattgcatctctttgatccttctctagccagcttcctctctaaccacagctgttaaagtttctccgaatgatgcatgtgattagattgtatgtccattgcgttatccaggcccacctggataattcagggtactcttccatctcaagccccttaaccttgattatgtgttcagaatgccttttgccatataaggtcacatactcactgatgccaggatcagggcttggacatctttgtgagggccactattttgtctaccacttcttccttttacttttcacttatttaattatttttgggttgaatttcttgtagacaatttataattgggttatgtttaaaatccactctggaagtcttattttttttttttctttgagacggagtttcgctcttgttgcccaggctggagtgcaatggcacgatctcagctcaccgcaacctcctgcctcccaggttcaagtgattctcccacctcagcttcctgagtagctgggattacaggcatgagccaccatacccggctaattttgtatttttaatagagacggggtttctccatgttggtcaggctggtcttgaactccctacctcaggagatcctcccgcctcagcctcccaaagtgctgggattacaggtgtgagccactgtgcccagccaagtctttgtcttttaattggtatacttacaccatttatatttcaagtaattattactatgtttgagcttaactctgccatcttatttttattgtttttagtttatctctgtttctttttcttgccttcctgtgaattatttgaacattttttagaattttatttttgtttatttacagtgttttttagtttatctctttgtgtagctttttagtggtcgttacgggtattgtatgtaaatgtacgtatgtgtgtataaaatcacagactactgatattgtcattttacttatttgagtaaagtatggaaacattacttccctttatataaacattacttccctgtatatctatcttccctttgtatttatagctttactttttgtttataattgtcttaaatatttcctttagaaccacatcagacactgttataatctttgcttcagcggtcaaacataattttaaaaactcaagaaaaggaaaacctattgtatttacacgtttttgaatgctgcattctcaccttgatgttccaaggttccatcttttatcatttcctttttttccaagggcttcctttagccattctttgagggtaggtttgttgatgataaattctctttgttttccttcatctgagaatttcctcttcattcctgaataccatttttcttgattacaggagtctggattgacagttcttttctttcgatatttgaaacatgttgtggcatttctttctggcctttaagatttctgacaagaaatctgcttgcatttgaatagtttttcctctttaagtaaggtgttgtttgttttttttctggctgcatttaagatattttctttgtcttttgttttcagcattttaataattacatatcttggtgtgtatttttttttttttttttttttttgagatagagtctctctctgttgccaggctggagcgcagtggcgctatctcagctcgctgcaacctccgcctcctgggttcaagcaattttcgtgcctcagcctcccgagtagctgggactacaggcacccgccaccacgcccagctaatttttgtatttttagtagagatggggtttcaccatgttggccaggatggtctcaatctcttgacctcgtgatccgcctgcctcggcctcccaaagtgctgggattacaggcgtgagccaccgcgcccggcaatgttttgttatgtttgcggtttactcagtttcttgaaactgtagctctttagccagatttgggaagttttcagctattatttatttaagtactttttcagccctatcctccttcacctgtttttattggacaacattgaacaaatgttagatcttttgtggtagtcctgaaggtcccggagggtcatttgttttcagtctgctttctcttctgattgtaatctctctataacttctattctgtagagttcactgattctttcctcacttccttccattctgctgttgatcccatcaacagcatcagtagccttttattttggttatattatttttcagtttttaaaatttccctttggtctttatatcttttatttctttgctgaaatttctgtttcttacctgaggtttcctgtttttttcagttgttcaagtgcattcataactacttgttgaagcattttatcattactgctttaaggtctttgtcagataattctaccgtctgtgtcatctgggtgttggcacctattgattatcttttttcgttcagtttgaaatcttcccagttcttgatataatgaatgatttttataagaattggagccaggcattttttttaaatcatgtttaaacctcctgtttgactgtctttgtctgatgctgctctggcaggggaagagggtctgctgccttgttagtgccaggtggggatagaagtccaggctcccccttcagcctctgtccacatctggggattgggaaggggctcctccatcctgctgggtgagggtgggagttgtggctccctcctgagtctctactgatcctgcaggggaaagctaaggggtagggcctcgttattggttggtggggataaaaatcccagctccctacttggccttctcttataccatcctggctggggtgctggggcactcgttgtagctgtaggtagaagtctatgctttccacttagcctttgctggtgggaccacaggtttattcctgtggtgtttactagaatagagcagttattatataaaagtttcctgtcttgctaggctgccattttctagctggagcaggcttgtgaggggtgggggtggtatggtttggctgtgtccccaaccacatctcaccctgaattgtaataatctccacgtgtcaagggtggtgccaggtggagataattgaatcatggggtcagttcccccatattattctcatggtagtgaataaatctcacaagatctgatggttttataaatgggagttccctgcacaagctctcttgcctgctgccatgtaagatgtgactttgcccctcatttgccttccaccatgattgtgaggcctctccatccatgtggaattgtgagtcaattaaacctctttcctttataaattacccaatctcaggtattattagcagcatgagaagagactaatattgggaggtgttcttatttgttttggttttggtctacatcagttggtgtttccagttggctgatttcttgaactgtcagactgggatatataaagcaaaaataaattccagggaacttactaccctgccttccgcaggcccaaggtccctagccagtctgcttcttcactacacctttcagagttttatgcttgttttctgtagcatgtctagggtttttatttgtacttagcaagaggaataagggaaagtaagtatactcccatcagaaacagaaatctctgaattttctgattataaaatggggataatacctactccatagaatcattataagcattaaatgagatactgtaatttatttatttatttttattattatttttttgagacagtctcgctctgttgccaaggctgtagtgcagtggcgcgatctcggcttactacaacctccgcctcccgggttcaagcaattccccctgcctcagcctcccaagtagctaggattacaggtgcccgccactacacccagctaatttttgtattatttattagagacaggttttcaccatgttggccaggctggtcttgatcttctgacctcaggtgatctgcctgcctcagcctcccaaagtgctgggattacaggcgtgagatactgtaatttatgtaaagtgtttactactactctggtatttgtaagtgcctaagaaaaataacttattttttaaattttgtacaattatgtattttgaagatttttttaaaggtataagttaaaccagatagttatgtttttgctaatagttcttatataaagtatgtttaaggtctttcaccttcccaagatatggctattctttgaaattggatttttttcaccaagggaaagagaaaagagagtaagttccgtattaatttcacacgttttctgccatccctgtacacagttaaataccctttgtgaaacatcatttccattcttaaaaacagcgcttctgtgttgaagcattattcagtgtagtcctaagttttttcctttagcattgatggcatatttaaatgggtgcaattaaacaagcagacacatgtacaatccatgtgttgttgctctttgttaagttgcatcagtaatgcctcatttcccagaatggacactggtgtgagtctcaggcagtatagaggccagatcccaagttgactttctcatttatcaagtgaatcaggtaacaatgacaggctactttggggctttgaatataaaggtgaataagtctactcaaaaagtagtttggaagtcagcagatgtttagatatccataactcctcagcaaaagatacgtccagtgaggtttagggttatgtgaatttaggctgtgttcctcattcaaactcttagaacattgcctctgcatgtactgaaatgtctgctcttcggatttgctgtattttttgtttctagggattcacctacgctcttaccagctggagggagtaaactggctcgcccagcgcttccattgtcagaatggctgtatcctgggagatgagatgggcctggggaagacctgccaggtgtgttactatgcgacgagtactgctcaccgccactgcgatacttccttataactcattctggagctgagagctctggagctaaaacaaagctcagtttcacaaatgtccctgggatccaggctaactggctcttgcaccgggaaagggccttccctgtacagtcttctctgcctcagtcattgcagttcccctactgactttattcagggccagcaaatgctacttgtcctttctttggatgttcacatagctctgctttaagctctctaaaaagatatcacctccaaatttgttttgctaaaattttgtttagactttttgcatctatgttcatgaaagacattggtctgtaattttcttgtagtgtcattatctaattttagtattggggtaaagctggccttgtagaatgagttgagaagtatgcccttctcttccattttctggaagagtttatgtagaattgctgttaatttcttccttaaattcttgctagaattcactagtaactccacacttgttttgtagacacatctggtttatagtaataaaagataaactttctctaaattgcatcctcagggaaagctagactgaatggttttaattcaataagccacttattaaagaatggttcctggcacagcttgggctgagaagccatagataatttaaaaagaaaattatttctgttataaaaactacctaccaccctgtaatcaagcactctaaccataaccatgagttgcaatgcgtgttttgcatgattgaacttttgtttttgagacagggtcttgctctgtcacccaggctggaatgcagtggcatgatcttggctcactgcaacctctgcctcccaggctcaaggaatcctcagtctcctgagtagctgggactacaggcgcatgccaccatgcacagcttatttttaaatttttttgtagagatgaggtctcactatgttgcccaggctggccttgaacttatgggctcaagtgatcctcctgccttggcctcccaaagtgctgggattacaggcgtgagccactgcacccagcccatggttgaaattatagtgcgtatatagtttgtattttgttaatctaacagtgtcactgtaattttttacttcgttatattcttcacagtcattatcaacattgcataatattccatcaagagaatttataatttacttaaatgttctacagacgagaaatggtgattcctcccctttttgtgctgtttaatcttgataggaacatctttgtgcttgtagctttctcaggattttgaattatatccttaggacagatttttctcagaaatagctcagcatttgaagatggagtctcttgacacatttttgttttaaaataggttattttctctgtatattacagcaacattcaagtcataagtgtgtactagaatcttctgaagtatgcccatttgcctttaccaatatttccattttatacccttccttaagcttaggatcgtgtattgtctgttttccccgttagaatgtgtcctccaggagggctgggcgttttgtcggttctgttcactgttgtataactggagcataggacagtgcctagcaaatagaagacaccctgtaaatacatatggaagaaaggaagacagtaggggaaggtgggaggaagtgagggaggaaggaaagcatcctccctcactcgggaaagcctggcaggcagcagagggccaccatgcgattggccgtttttacagtcatatcttggcacttcttgcttaatgttttcagagtatcgcagatcttggccatcagttggattttcattgatttctattgtctttcctgactttttctttacagtagaggttcaattacctaaacattgagcctcattgcttgttaactactgaagtaattgagttccataaatttccgtgcaagtatattgaggcttacatgatttcgctctacgaatggattactcccctgatatgcggaagttcgtacaatatttctttgtaaaacaagtcttaaacaagagtgtgtgttccctacagggttgtgggaacttcatggttgtttctcatggggaaatgtgatcaaaactgcctttctttttctgtgttccagactattgctctcttcatttatttggcaggaagattaaatgatgaagggccatttctgattctttgtcccttgtctgttttgagcaactggaaagaagaaatgcagaggtacagagtagatgtagctgaaattttattgtttatcttgattaagattttttttctggatgatgtataaaatatgataaaacaacctattgtcgtaattagtaagtttattccagaaaactttgagctgatagagtgtaggtagacactgaggatataataggggaagagtaatattattactatttggcaatttaaaggtcagcaatcgtttgtagtaagtattgatgaacttagtagaagccattgttttttgtttgtttgttttgagacagagttttgctcttgttgcccaggctgaagtgcaatggcacgatcttggctcaccacaacttctgcctcccaggttcaagtgattctcctgcctcagcctcccaagtagctgagattacaggcgtgcgtcaccacacctggctaattttgtatttttagtagagaccgggtttctccatgttggtcaggctggtctcaaactcccgacctcatgtgatctgcccgccttagcttcccaaagtgctgggattacaggtgtgagccaccgcgcccggcctatttttcatagtgacgtaggaagtaactcatgtggaagagatcgttttatttttagagtcagcacaagacctttttagatctgatccctctacctgttcacataggaactcgctctgaggttcaaccatttttttagataagattcagagccccaagactctggttgtaggacctcatgagttctgtacattgcaatcctcccatgaaatgtaattttccagatatgcacatcctgtcacatggatctagtatttatgtttatctacttcttttcttggattcagatttgctccaggtctttcctgtgtaacatatgcaggcgacaaggaggaaagagcctgccttcagcaagacctgaaacaggagtcacgttttcatgtgctactgactacctatgaggtattcattcgtttctctatagcgagaactcctaacctgtgaccttagaagttgtagagtctgctgaaattatatttaagttttgttgagagcacacacttttctgggcagggagtctaccttcatcagattctcaaaagagggctgtaaccaaaagaagtgaaggatcattgtgcttcagattagttcgatcttttcctttcttggtggatcaagggggaaggcttctcaaggaagtggcacttgagctgcctcttggttgatgaacagaagtcaggcaggcaggcaggggaaagggttttgtggactgaggaatcacgtctgttactggaggataggaatggaagacagctccggccttattttaaatccttgtttttcagtctaagacagtgtgtgccactgaccttccacttaatcaggcttttctctttgtttttaagatggcgctacttagaaattattctcagaacttttttttacttagtgaacaaatgagacttagataaatcctatagtttaagagagttcacagaaaactagcttatcaatatcagagtttatcaatgccagcctttatacgtgtcttcctaatttttcagatttgcttgaaagatgcatcatttctaaaatcgtgagtaggttgtactatttaagaacttgggttgaatgtattatgaatgtcatgtctttccttcacgttttagtactttgcctctcctggcatgtctggtatgtcttccatgagttctgtttatgggtaggcggcatggtgggagtcctgtgtttacagtcctctactcattagctgtgtgtccttgggttagttatttaatctccatgaacttcagcttcttcatctgtaaaatgaggataattgtttcttacctcaaatagctgttacgaaaattaaatgagattaaatatactttgtatggttaatagatattaggctctttacatgcaacttgcatagacccctttcagtactaccatttggagagtttgctgtaatacagaaggagaaccatttgagctgtttgctggacataacctaaaatagcaatcagtgccgtggaattaactttttagaaagggagttttaagtgtacctctaattagttaacctcatattggcccatgaaatcagaaactcagcaataccacctaataatgggaatgataggatcatgtcaagataacagttacaatgcagattaaataagggctagagtttaggtaagaaagatatgttgacagggtttcattctctataacctctgtagttattacatggttaggtggatattctgtattttaatattcaaaaatctttgttttcaaagtattttatcaatattttaaatgttatttcttatccaggttcctgtgagctggatttctattttcatgttattttgaaatactagaggctaggtcatagatttcatgacttctatctagtatttcatttaagtgagcatattatcttatttttcttaagatatacattccctctctttttattattaatattcaacttaatatttgttgaaagtcagtcactggaaagacattgttctgagagttattggcaatatcaggaaagtaagtcatagagcttccctaagaagacaaactccagtggagggatgagaagtgtacagatatccataatacatagcaatatatgggaagtctcaaaagataataaaattgggacataaatgttgctgggtactttacataaattatcccatttaatcttcatgaaaaccccacgaggcagctattattcattttacgggtgaggaaaataagagatttggtaacccatccaaggttacattgctgatgataaatagcagagcagacatttaaacccagcatttggtgctgtggagcctctttttaagagaacttctcaaaatagctagttgtactggagttttacattattcagcagaaatagaatctttctatttcagatcatcggttttcagtgcattttcaggtagatttaaaaacctaagtaacagagggacatttataatgctgtcctgtagtatgaatcccaacaacatagatacattctttcaatatatttggaaggttatattgcttattgctgtattgtacattctgagaatagcagggaagtgtaatatcatctctgccctaaagagatttattatggagagttaaggctgtgcatgttacaaatatgaaaaatttgaaatgttttggacaatagacttgtaaaactctttggatcaagaggattagaagttacctcatccaactttccattcagtgctggatttcccccatcttttcctcttcaggggacatcatttagagtatcctttgataagtgatttgacctacttcctttcatgagccaaaatccaccactctgtagcctgtttcactgaacaagcattttttggacacctaaatgtctagttcttcacaagggaataggacctaatctgttttgaaagctaattcagacagagccaggcaccatcctagagaaacttccataccttatctcatgaccactgtgcaacttcaactggacctttgtttcttgtcatccttaaatgcatcctctgctcatgccacccaaccttctccttcgacttcctgcactctctttggaccctcagtcctccctctactcgcttctctcagtaggtgaatggtaatgtcatagggacctctgttcctctgcctgtcctctggagtttctctgtagcctcaggaagagggcctcctccttgtaaggtgaacctctgctcaagatctttctctaattttggaggaattttcctttccatacctactatttttccagtgttctgttttacctgtatatacatttagttttttaaatatgaaaataatgtaatgggattccagaatgtttataatcaaaataaaaagttaaacatcttataattttcactttattatcttttgcatggctttcacatttgtaaaagaggatacatgatatttatatcttttttattattctataggccttttaaattgcaacataatcatatttattatttaaaatgccatgtaatattttactacctattattggacatttaggttattttccattttttgctgttttaaataatacaacttgaaacattcccacatatatctttttctgtattttgaatttttcttaaatagcttctcagtagtatctgtcaaagtatttgcttttatgactgaaacttcttgagaaattgctgatgtgacacagtatgctacaaaatgtgctctggcaacagccactaatgacttccatgtcaacaaattcagtggatatatcttcctggacatctctgtgagatttgactctgctcaccacttacccattttaaagtcacacttcttaagttcctacaacaccactgtctatcttgatttttttcttctgtttgaacatcagctctgtctttatgaccttcaccaagtcacctaacctttctgagctttagtgtctttattagtaaaatgagcacaattgtctgcttgctatactcttttagactaaataacacataaagccctgaggttagtgtctggcacaaagtaggagatcataaatgtttccttttcctttctgtctctggcttcttcctttctgcataggtctttcccattttgttaaaaaaaaaaatcccttggttttactaccttatccagatattgtattatgcacatgtagcctctcaggaaggtaatttggtggcatttgtaatagaaggggcttactgttaagtctttttaataacagtcacagttttgtagtaagacttttgattgtgaaatatgtgtttaaattacacaaaactgaaagcttgggttttctctcacagattcccttggagtgttcttgttgtggatgaagctcacaggttgaaaaaccaaagctccctgctgcataagaccttgtcagaggtaaacttacagtgtagccttagtttttatataaccccttctttttaaatatacattatattttagagtaattttagattcacaacaaaattgaacagaaactacagatgtttcccatgcatatgtccccacacatgtacagctgtcccctgtccccacacttgtacagcttcacccattatcaacataccccaccagagtggcacagttgttgcaactgatgaacctacattgatacatcgctatcacccaaagtccatagtttacattcgggttcactcttggtggtgtgcattctgtaggtttggacaaatgtacaataccatgatatctactgttatagtatcatacagagtagtttcactgccctaaaaatcctctgtgctccacatattcatcttttcttcgtaactccctttaaaaaatactagtttaggcctatatagagtcaattaaattgaaaccttttttcgagttcgatttctgcagggctaaatgaacattttatagaagacagaagaagtactaaatatggcctaacttcttctttcttttatattggagataggtttactaatatctggtgaataagaaccctaccccaatagaatgcattttatttcagatgtttcaactctcttttgattatcttcaaagggacaatttctcttaaaaaatcttattataattcttctttgtgcaatagtagatatatcagacatgttgtacccttccccccaatttacctgttgaaaaaatttgatagttcacctgggttcatgaagagaccaattacatgctattgaatattacctccagtttgtcttgtctttgtcctacttttgagcataatacacttgctttcattcctttctctggatctcttgcatcattctggcaaagtagatgagaaataccattgtaccctagatgggcccttttttccgaggagtcagtgcgatgtgaaataccctttttattgacctggtaaagatttgttcattgatgagaccacatatgttaatttctgtgatgataattgaagtttggtccttgtcctataataaaccaattaataaatttagaggtcacttggaggaaagtcttagatatgaattctatttttactggtctgaaagttgtagtttttagagtcttaatgtagatacgatcactgtgtattattagcccagtctcaaaggtcgctgtcccctggtggggccccctctatccctggtgtcctttgctttctttgtagggacttttaacagtatctccttctgagagcttgtcttggtctgtttttcacagactgggtaattcatatgagcagaaatttatttatcaccgttctagaggctgggaagtccaagatcaaggtgccagcatttggcaagagccttcttaactgcatcctcacatgacagaaggtggacgggcaagagggagcagaagagcaagctatccaaatgctgcatgacacttttttttttttttaatatataaaggccttaatcttattcacgagggaaaagttcttatgaactaaccacctgttaaaggcgctacctcttaataatattacattgacaacacctgaattttgaaggaaacacattcaatccatagcagttgtcatatcctggcatctaaccttatgaaagatggcttcataaactactgtgccagtttactaatttaaaacgggaggagagaagcaggcatagtaaaagaacctggatttggagtgggaaagctaagttctgttgctggccccagagccttttcttgttattcataaggaaactaaggctcagggattaagtgaagaaatggttctgggtcatctaagcattcctttttagatgaagcttgggttgcagataactagttggaaagaaaatacatgtatttattgggctgagatggggagggggatactgccgttttttatttccccctaatattgttttcagtttataaaagttggacgcaaccagccgggcgcagtggctcacgcctgtaatcccagcactttgggaggctgagatgggtggatgacgaggtcaggagatcaagaccatcctggctaatacggtgaaaccccgtctctactaaaaaattcaaaaaattagctgggcgtggtggtgggcgcctgtagtcccagctacttgggaggctgaggcaggagaatggcgtaaacctgagagatggagctggcagtgagccgagattgcgccactgcactccagcctgggcgacagagcgagactctgtctcaaaaaaaaaaaaaaaaaatagttggaagcaacctaaatgtaaaatatagggaattggttgtacaatttatgcgacattcatgcagtgcatttgcaaaaggtaaggctaccaagaacaattatgtagaagaatatttaataacatggaaaatgtttgcaaagtattttatacacacacaaaaaagcttacaaaatactatttacaaacagagatggtctctgaatctttacccagttataaattttgatcccaaaatggacctaactgaatcaaaatgttaatttgtgtcatagggtaagttacctgtagcgactagcagccttggtttcctttgtgacctcacagccttcattcacctcagctctttacttggtgaacacatattgtaagaatgtgaactgatgattggaaacattacttttgacaagttcccatacttgaaatactacaaaaacatcacctaacaagcagaacaaccatgaatgggtagacattgattagacatttaaaaagaaacaaataaaaaagggagatggcaaaaaaaaaaattgtttacatctgttttcattgattgtgttattcatttatcattttttgtattataaaagcagtgtcttcctatggccccccctccaaatcaaaatatagaaagacaagaagaaaaggaaaacatcccagtaatcctactcctacattaacactttaatggtttaatggtgtatgtgctgccataatctttgctgtgtgtatacattcaaaaagtaatgtatatatgcatatatattatttaaaaagtcaaaatgtatattaaatatcaaaatattgtgtatatacgtgtatacatacacgtatgtaaatgtgtatatacatatgtatgtatgtgcatagatacacttacatacatacatatgtatatatacgtttacatactatgttttgacatttaaaacaggctgtaattacaggctcacacctgtaatcctagcactttgggaggccgaggcaggaagatcacttgaacccaggagttcaaaagcagcctgggcaacatagtgagaccttgtcgctataagaaaatttaagaaattagctgaatgtggtggtgagtgtgtgtagctccagctactggggaggctgaagtgggaagatcacttgaaccgggaggaggaggttacagtgagccgagatcatgcctctgtactccagcgtgggtgacagagcaagaccctgtctcaaaaaaaaaaaaaaaaaagatatacatacacaagatgtcaagatatggcttcctcattttgatgtattgtttaattctactaagttcttgtgaatgtcagtttagagaatatcttttgcttgacctaatatcttttcttctttttcctgaccttctacttcatgtctctcttactcttggtgttcttctctgttgttcaaaatttaaggacattttttttccatttgagattctctgtgatctccagagacaccagaaccttcctaaccttctacttcatgtctctcttactcttggtgttcttctctgttgttcgaaatttaaggactttttttttccatttgagattctctgtgatcaccagaaacatccagaaatcttgacatcttgcatcttggtgttcttctttgttgttgaaaatttaaggaaattttttttccatttaagattctctgtggtgctgtgtccagaaacatccagaaatcttgacatcttgcatctgatgcaccattaaattttataaaaggaaagtctcctattataaatcttgcttattgcttgcagtggtggggcctgatgctgtagcgttggattctcaaactgcatgagcatgtgcattgtgtctcagatacctcagtagactccccgacacaggcagtaacacatagtttgaatccccatctaaattcagtaataacagccatattaaattctcatgcaatacttcagagttcacaaagtgttactacatccttatataagtgttttcttcacaggattattgtccccttcttatagttgaaactgaagaggtattatttcatctgcatcaaacagctagtttgcagcttcaacctgagccatctgatttcatgtcccctcagtcatttcattaaatcatgcctctctctgtgtgggtaaaggttgtgatgggtaactcagccttgcattccagtgttatggaatttttattttatttatttatgtatttgagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcaggcaagttcctttcctgcaaatcatccccaagaagccttggcacagaaaccatcctcatgcataatggttataggtagaaaagaaggagaattgatgaccagaggacaccttccagggagacagaccgctgatattagggagatgttaagtcacacatgttgttcccagttgtctgctgttcatgcctctcttaattgtttgctatttgattctgcagtagggcttctttagttcatttttggaagaaatagaaagtgcctgctgatttgcagacttttttttccaacttgtaatttctataaaggctttgttaactttataagtcacttcctgagggagaaaagaatgtgggtgctgtagtcccaaactactgttcagcatactacagcactggtatttcttttaatgctgcaccaaaaccagaattctgggatgggaacccttcctcattcatacagccaagagttgtagtcttctgttcttgtacctttgcccctctgtgttgtaggattatccatctatccctgtgatattatcctgggatgatttttcaaaacaggtaggaggtatgccaactaatgagtttgtatgtgttgggtaagtatgagtttgagggggcttctcatagcaaaaatctccagaccatagactgaagatcacctggcgaacctgctctgattactcccatgttttgggttacctgacaaaatataagacttctagtcaaatgcatgacatacttgtattacatgggacacacttgtgttaaaaagttattcattatttatttgaaattcaagtttaactgggcatctgtatttccatttgcatatctggcaatcctacaggtagtataattctaatttagaataatttttgaaattcaagacatctggggaaagaagggattttaagtcaaagagccaaatttgaatgctggccacattcacatccagctgtgtgactttggataagttgcctaatttctgagcctcacttaacttagctataaaaatggggacagtattcctcacttgaaatttctaagctgttatgctgatcaatgagattaaacgcaaaaatattctggaaacaaaacagctttgtgcaaatgagataagaagttatttgagtgttcctcgttcttgggctaagaacaagtcatgattccagaaaaaagatgatcccaatgaaggaagaaatactataaaaaaatgatcatactggcctagaatgcaaaataagcgtgaaataagaaacaaaaataaatttctttaagttctctagggttcattgccttggttctacttttgtcccacacttcttgtatttttttttcttatgtagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctaggtaatcagagggcacttgtccatttagaaactaaatgaggatgtgatttcaggtagtaaaatattttataatcacactcatttgtatgatcccaagaatatgggatggaattttgtattctgaataattctggtcggctacagtgggactgtggcagagcatcttaaagataacagccttggttgttgcagttgtgaaatttccttttctcccctcactcagtttttcttagtgcctgtaattaagcaaacacttccaggtgtcccagtcatgtctttcatcctcccaccctgtcagatacggtagtccaccctcattcacagttttgctttccagggtttcagttctgcactgaactgcagtctgaaaatattaaatgaagattccaaaaataattcataaattttaaatcaaactctgttgttagtagcatgatgaaatctcactctgttccacccaggacatgaatcctccttttgttctgcgtatccacgccgtcagcgttagtagcctgctctgtcatcagtccaatagtcatggtatcacagtgcttttgttcaactgatctttattttacttaaaaatggccccaaagcacaagagtagtgatgcctgcattttggatattctaaagaagccataaagtgcttcctttaagcaaaaaaggttaaagttctcaataaaaaaatgaaaaacaattatatgctgagattggtaagaacaaatcttctgtctgtgacattgtgaatagaatattgttataattgttgtattttattatgagacgttaatattttactgtgccaaattaaactttatcataggtatgtatgtatgggaaaaaacacagaatacatatagggtttggtactatccatggtttccaatatccactgggggttttggaacatattccccatgggtaagggggaactgctgtatttaagagagtgcaaaacttttttgttgaatcaaattcactgggaggaattggaagtgacaagggaaagatagtgaaataatttctcaaattgcacttttttgtcccttgactccacaacaacagttaaagaaaatttagaatttgcaaaagagtaacagagtacttctgagttctatttacagttgagggtctttcttaaaacaaaatggttgagaaaattttatgtgaacatgctgttaattctcaatacaattcagtgaaatttgggaggttagtataggttcaaaggatataattgaaatgattaaggttacttgtaaaaactcagggttttggtttctgttttgttcagtaggccatctctttctgtctctctctttttttttaaatttcagatgcatttgaaaatgagacggcaaagaaagttaaactacagaacattttgtcccagcttcgaaagtgtgtggatcacccatatttgtttgatggtgagacagtgccttttccccccacattattctttggtaatgtttctgtggccaaatcataccaaaattcttcaaaataattgcatatacttactttgtttactttgtttattctcaatttctctgtattggtattaactcatatattcatgttcagatatcttcagttgtcccggtaatatcccttctggctatatttttctttttttgttaaatccacgatccagtcctagatcctgcagaccctgcattgcatttgccatgtctctttattcttctataatctagaaacattcttcagcgttttttttctttcattacatgaagagtcaagaccagtggttttgtggaatgcatgataatctgggttcttaaaaatcatttcttcttgattagatttcccattgtcttgaattgactcagtcagcctttcctcaccgctactccaggttcactaatgatctccctgttgcccaaccaatggttatttgttagttcacatttcagttaccctctcagaagcctttggcacagctaatcacttctttcttgaagcactttcgtccctcagcttctgggatatactttctcttctccatctgctccttctcagtctcctttgttgcttccccttcatcatacagacctcagtaaattttcccctgggcaccgctttagctgcatcctaggaattttgatgtgtggtgtttttgtttttcttcatactggggcttttttgattccctgattggtaacccttggagcaagcactcctgtggccatggagactctagataggatcagtacagagggcttgctgcagtcattttaagggaatctctgccaaatagtgctaagaactgtttaaagattgcacaaaatctcaagtaggtgcatatgagaactttttttaagaggagggggtgttgggaacacataggttttgaaagaagtcctccaggttattctgactgccattttgacttattttatagagtgagtctcgatttcagttttgggtctccttgacctttagcatcttcttctgtctcagtttcctgaagagtggttttattccttacacagatgtttattaggcttgttggatgtgctaggctgtgtaattggtgttaagcaggactgagatcatcatgcaaacaactacttatatgatgagcttttggcttctcttcctgtagcctagctactggcttctgcccttactgagggcacattactgggagtgggttctttcttttctaggtgtggagccggagccttttgaagttggagaccacctgactgaggctagtgggaagcttcacctgctggataagctactagcattcctgtattctgggtaggtggtaggttcacatttgctgctctgagctaatggctgttaaaacctgactattgaggaactcactgagttgttcaggccaattccagttttctttttttttcttaacactgattcaggttctgccttctctgtgactacactcccaccccattctatcccactccaccccttccacaatcattctttcgtttcctgaatttgtacagcacttataatcctaatccagcacttggcaatgtgctgccgtaatctgctgtctgattaactggtgtttatgtttaccattatcattccaactatatattgtttggctctacaaggacagagacaacactgagcatttcttttatagttgcctgctagtaacttggcattgaattgacacataatgaaggctcagtaaacattcatttttgttaacctgtggggtttgatttaaactcaaggggaacttgaaggactctttctcagggacatgagttgcgcattagaagacgaggttcagagccaggcactgtggctcgcgcctgtaatcccaatactttgggaggctgaggtgggcggatcatgaggtcaagagatcgagaccatcttggccaacatggtgaaaccctgtctctactaaaaatgcaaaaattagccgggtgtggtggcaggcgcctgtagtcccagctacttgggaggctgaggcaggagaatcactggaaccctagaggcagaggttgcagtgagccaagatcatgccactgcactccagcctggtgacagagcgaggctccatctcaaaaaaaaaaaaaaaaaaaagaccaggttcagttagtgttcaacagccatgtgttcagcttatacctaatcctcctagtcaccagagttctctctttctagaggagtctaggaaaagcccagattcccatgggtttcaaaattatccctttggaatgactgtcttaggtatggcctgaactaatctaaaacttcagatttggcaaaattgctcaactttaggaatgtgcaagttaaataatttcatgtcttactgtatttcattggttctcgtatatctgccataagtatgttagagttggagaaggacctataaatgccttctggccagttttttatttcacagacccagaaaggttatatgacttgcccaaggtcacacagccaacaaatggcagaaatgagattagaattgaggttttcaggttcattgctttctctacccatttggggcttgaatcttgaaagagttccccataatttttcctcttacacttgttgcaagctcagattaaataagtttttataatgagaatattgttttgacagtgctgtgcttctttgtttatgcaaatttaaaataacagccagtaacaagggactctaggcttgactttgttcttgacttactccatcattttgccgcctttcttccctcctctcgctatacaaaaattttctcgtgttatggaaaatgagacatcacttaccccttgcttctctaaagtaatgcttctcagacttttcaacccatatagctgtagatgagaggatagtgactttacacccccaaacagggcatagttgtagatgactgaccacaggctttcttcagagtctccagtttttcttttcttttttttttgtgtgtgtatttgaattttgcattttactcttcacatatctgtatttattttgctactaaaatgaaagcttatatttctttccattgagcaaattgacattccagaaagaggcaccttgtttattctagggcttatatcccctgttgcattgacacgtcccctgggaataatctccactctagtttgaggatgactgctctgagggatacagctacctgtggaggtgtattctcatagaaagcatttggaggttctgaggcagtctataaatcatacgacacttatatttctactttggtatttatttataaacttttattgtttggtaaattttgcctgagggaaattgaccttaaataccactagacttggcagtgtttccttttctttttcttgccaggggccatcgggttttacttttctcccaaatgacccagatgttggatattctccaagactatatggattacagaggtgacaccttttggccactacattacctaaggctctgttagacttaacagtccagataggtccatgaagaataatatgggatatgagaatattacaaaggaaagcagggtgagaacattattcagaaccaaaaaatcaaaaggcgagaggagagtgatgtgtgaaggcaaggatggacagcagagaacaggcacgtgggcagaaataaacacccacgttcccatcagttacatgatttaaaattatgggccgtggagcaaatgttgtggaaatgtttttgaaaatgtgtgataaagtttcagtgactagagcttttagcgtcttgtaacattcacctcaacagttgagcacttactcatgatcagtgaaaaggtgaacattgaaattatagagataacaaataagccaggggaaaagtaagagcaactttttctgcatagacaataaagaatgtaggttattacctgggaagtctgtttaatatgtaataagatttgtgtgagatgatgagaaaaggctctaacatgagttgatcttgagcccaatgttgaacagctccagaccttacaatttaaaaaagtagttcagaccgggtgtctgagttccgcagtatacctggtccagtggacacttgcagaatgccgttggcacatgccactggccattgaggggtccccagatgcataaacagcctgatcctgtagctccccttccccacacggatgcatggaggcaggtggcgaactctaaagcctcactgaaaggcagattgctggactgttagaaggggctcactcacctgcctccaagcgcttgtcttctgtttacataagaattacatctcagcaaagttgaaactatcacacaggatagatgctcagggttgcttgagaatagtcaaaactgagtattaacttcataagtgccaaagacttcaactgcatatatttaaaaaatccagaggagtatgttatggtgagttattttgtaaaatgataattgtccctgttaatttaaatttttccctttgggatttgcttaaagtagggctgtgcctgtatatggaaagggacaaaattggcctttggttttgggcttaattttttattccccaaagactacttgaaaagggttaagatttctgtttttcttcctctctgtaaaggctacagctatgagcgtgtggatggttctgtgagaggagaagagagacacttggccattaagaactttggacagcagcccattttcgtttttctcctgagtactagggcaggtaggctgcaaaggcattgatggaaacagacaaatgagggataatagagtactattacatcccaacggttagtacacttttttccttaattctctgaaaggtgaggttactattgaatgtaaaacaaggtactggacatcaagcatggtgctgttttctatccagcctgtccaaactgtcatctcagcaaagaagtaaggctgaaacctggggttattggaaagtaattctaatctgctttgaccattgacctgggaatgtcctgaaagatttatgtgattttgtggaatgtttcatttacattcagtggaagtagctcttcttcccaaccgtgaatttgggaaataaggtaacagtttgtctactagttgtccttcctctataagtatttctggaatagtgctgaaaagcttaacaaaaatctagttgttaaaaaatgtgattatgttgaaaataccaactttttagaattatttatgacatcatccatatatgatttaaatcgtgaatattacgacatttgtaatgctttaccagttacagagtgctttcatttactgttacataatttgaaatcagctcttggagatgaaatgattctctaagtcattgtggtgtctggaaaaaaaaaaaaaaaaaggccggcacggtggcccatgcctgtaatcccagcactttgggaggctgaggtgggtggatcactggaggtgaggagtttgagaccagcctggccaacatggtgaaaccccgtctctacttaaaaaaatacaaaacttagctggatgtagtggtgcgtgcctgtaatcccaactactacggaggctgaggcaggagaaccgctggaatccaggaggcggaggttgcagtgagccaagattgcaccactgcattccagcctaagaaatttttctcaggtcctggagcaagctgaccttagttttcaactcataggatcctagtttcattatcttatttttgtagacataaatcttgatggagtacatgcaggaacatgaaagagatgtgtgtcctctattaaagacagattgacatttttctaaaaagagagttcagtcttatttagaaagctttctaaatgcctgctgctataagggtatatgaaagaagtgttagatataatttttgattataaggagattatttcacctgtgtttgttttatctccctaataaaattaataacataagattcatttggcctcactcttccaagatcatagactgcacatggagtctcagccattttctcatgtgatcagttgcctcagggttagtctcaggagaaactgaaagaatcaggcagtgcatcatcactgccgggaaaacagttttatttatgctttaatgatttcatcatcctcatattcagagagcagcattatgtttgaaatgtctaaaattaggaaaaaagagatctctgcttttcagttaatctccttggaggactcagagtagatctgggagctgaagcagtcctggacattagtcttctccaaacactgttgtgtttgctgtcacagttttgttgtagttttgcagtattttcatttatttaacaggtttccttccaaatttcaaatatttctgtgatgagtcatgttgccaccagatggcagtgatagctcatgaatatgttcctattcatggatgtgggtgtggcttatttataaaaatctcacccctcggtgaagagctgcacttagacaacatgaattcaagaagataattttatggaacacattttaaaatgaaataagcacctgaaaagtattatagtatagtggataaaagcacgggctctggaccaagactgcaagggaatgaatcctggctctttcaccttctaggcttgcaacttcagagaagtcccttaccctccctttcaacatctataaagtggggaaaatcgtagcaactactcaacttcccgacagggttgttgtgagggttaaaggagttaatatagagagagtgcttagaataatgcctggcaagtagtaagcacagcgtaagtgtcattatcattattattaggtataatttagcatctctcagtaatcggtcatgattacctccttgttccaacttcaacttgatacgaagactttaattagaatattcctgcctgatttgtctggagatccagcttatggtcagtagtccttcttaaaagttagtccttaattcaggtttatggaacaagccctttcaggcttgcttgtttcagcaaccagctctaacgaccctggcaagagggagtctgttttgtacttgttttcacattaatcaaagagaaggctgcaatgtaccttcacggttctcttaattaattcctgtaactcaaggtacctcctcagctctcttcctgcagcactgaagaaagaccagcaagagtgttctgagcaagcctcagaacactcagagtaaatgacaagagtgttcttgtcttgccgttggttttgttactttctttttgattaatgtggaaaccagtacaaaaaagactcactggagttttctctaatcagagggaggaggtttcccactctgctcaggagtataatatcatccactcttctcattaactttttatcagagatcttgctacctagttgtaacttgcaagcgacattcggcactcttctcttgacagtgcgcattgcagacctctcatatttagatctgttttctgaaagagcatgtgtccttttcctcagactactctaatcaaaatctaatcaaggtttttaagcagaagagataaagtggctccatggcactgacttaagtatccaccttggccacttgcccctgctccgctcattctgttccattcagtaataaaaattttcccatcaggcaataagaggtcaggtagcacttctcaccgctggaacaaggctttggagttaggggtgtgggtccatttgaaggatgaagccaattgttttgactgatttcagtttatcagtctgacccactctagccttgtgcttattttctagctcctcgtctttgtgctgctgattacattcctttttgcattgttttcaggtggagttggcatgaacttaacagcagcagatactgtgatttttgttgacagtgactttaatcctcagaatgacttgcaagcagctgccagggctcatcgcattggccaaaacaagtaagtgatttttttctgctttcttggcttgcccagcagcagttctgggttgtgaaaaaggtgaagaatatagtcctggtgacagtcccacactgggagccgagagaccaccaggttttagctcatctgtgctattgactcctagggtagtattgggtgggtcacattatcagtccagactgactttattagaaggagtcaaatcaaactgtgaaaggattagaaggaaactttagaagtcatttaactcatccttcttgagttagggtctgactcagttaaaaaatggggttatggggctatggagctaagctaaaaaaaaaaaaaaaaaaagatagatgttgccctttgatctgaggataatttgatcttccagatattttccttggctacagataaggaatcccagtcatggttaccccatcattctttctttgactgtctggaatggttcagagagaatttcaggcgagttctctctaacaagtgctcaggaccaaatgaaccaatctccctttcattgtaccctgaatatggtatttggttttgtttgcttttagatgtatttaccttgcatacttttgcccagctttgcacacccttatagcacactacccttgtttgacttatgtccaggtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccaggtatgatatgatatactgttcttcactttggaatataccaataccctttgtggaggagaatgtaaatgaaaagaaccagcactcaccagccactctccccagctacacatttgttccttggcctccctcacacctgccacagtgctggctatgtgcagggtctgtaggaagtaaggattagttccaagcctcatcacttcttggctgtttgggtttgagcggctttcttaacttcttagatctactctttttgcatttctaaaaataaagacaccacaggttagctcagagggctgttaagagaattagttaaaataaagaactcaataacaattaattctgtacttccaccttagtcccagagcctttgatcagtgacttacattacttcatactcagaagagggcgaatgagatcaggaattcataattgtgccttagaaaaaatgggtgaaagaactagaggtaatttatttaaagaagggagtactggatgggagacagacactggattggaagattttagagctctcttttggaagaggacttagagttactctgtagcagcccttgggttaaaattaaaactcataatatttcctggatgctttgtttttgccctaaggatgaggggctggatgcaaagagaccaactcctaggatactagaaagatgcaggtatgaagggagtaataaatgtctgtcaagggcagcatcagtgggagagtctggtgtgagaaacattgcaaaagaaggaaggacaggagttggctactgtttagagttgggtctcaacagtagggagatagaaaattcaaagatggctgtgaggttttaggcccctatgatgaggagagaagaaaggaaaataagaagtagggcagagttttaggaagataaagagaatttaggctttagtcagagtgtgcagtaaaaatacaatataaacaaactattgttagaggcagactcagacaaaaggaaagaattttatttgtaaaagtttgcaagatggactaggattggaaaggactagtccatcaaaaaacataagtgtttaagagagaaaaagtgacacaatattagaagcagagttactaagtttgtaattagtctgaaaaaacagcagttttcttacatggttactgtatctgcaaaggccagtgcatatctttacatatcagtgttgcaaaagacagggatcctgttgtttttgttagggagttagtaattacaggaaaggctcaaggttttattaattttgggactagaactagaaagagtaacactgggtttgttctttgtttatcttagggggtaggtgtggcttttttctttttctgactttccttgtgttgctgactgtgtcacatgcatgcttaattaaccataatggtgctagggcaggctgtacattttgttttcacactaagagacaattataaatgtgagatgaaagcttgagagagaggtagaggtacgctgtagatacccttaaatgcagttttccacagaaaaattatccatagaaccttaagagagagaaggtcactgctgggcatagtgaaggggtaaatgacagagcctcacaaggcccgcattctcttgttagaggaggaaggatgtcataggttgtttgcactctcccagtggagggagcgccaggggtccaatgaggggtatcttgtgatgtgggctgctggacacatcactgtgaaagatgtagacatacctccaccccatggggccacaaacgagtgggaacatggactgctggctgagagcgactctgttggacttcttgcccagctcatggttatcggaaagttactttctgactctaatgtctgatttatctcttccccatgcagatgctatgagttatttgtggttgccaaaagcaaaggtgataacccagagcccttgtctaaaaagaaagcaggggatttttgtttgtttttgttttttgggttttttttttttttttttttttttgagacagagtctcgttctgttgccaggctggagtgcagtggcgcgatctcagctcactgcaacctctgcctcccgggttcaagcaattctcctgcctcagcctcctgagtagctgggactacaggcgcgcaccaccacgcctagctaatttttgcatttttagtagagacggggtttcaccatgttggccagaatggtcttgatctcctgaccttgtgatccgtccacctcggcctcctaaagtgctgggattacaggcatgagccactgcgcctgggggatttttttttttttttaaataccaagaaaccaaaagtaaaagatgtggttctgatttggtaaatctaagcagtaggtatggagttctgaagtcctgaaagaaggaaacaggttttttatcctgcagggaggacacagtagaaacaggcaggcagatgcaggtgtagtgaacacttattggatactgtgtgctgagtgttgtctgaggtgctcttttccagttgtttcagtaaataagaataacagcaggatgagatagacactatctttatccccatcttaagtaatttgcccaaggttattcagatttaggattccaatccaagcactctctaacctccgagcacatgcccttaattactgtaatatacagcttctcataaaaacacatgtaattttcttaatgactaagacacattgcaagtgagcaataacaagggagagccaggaggtgagcataagtacaagggggtgaaagggagggtcccagtatggaccaattcttatcataaatagttggcttcctactattcttggtaccagctgccaaagccagtcatcctggttatgtgtatggagggtaaatataatatatctaggtacattcatgcttaagtgagctgtctattgtttcttcaagctgttacagaataccttaacatttccaagttactcacaaaatagacgatctggagataacccagtctaaaagggcaagatgagaacaagggcccaaggtttgaatccaccttgggtcaggatctcagaattagtgcttacggaggtgcaaagttggaagtagcaagtgaaagccaggaaaaattatctgtgctttctgcatggttcctacagccatagggaataggctgagagtactccagagagggacgagagaagagaagcaggatagtgcaatgccagaggaacatccagaaaaattcaaactgagaaaaggccttcgggtctggtggtcagaagttgttactgatctttgccaaggtggtttcgatagaccactgtgttaggaaaacaaattgccaaagaaaaggagtcagttcatgatagaggtaaagttcctagtgtagccttccctttctaaggagtctggcagtggagaggttggaaagtagctaacagggtctctgatctcaagtggctgctgggaatgcttatgaaaaagtcagtgagaggtgctgtagaaaatgcaggaagttactattattcttcaaaaaaattggaggcttatacattttttttgttttgtttttatgcagaattgtcaaagtcaatacctctgataatcatttatcacctctctgcttacccatcatccaactattaaatggccctggctgttactatctatgatggggagagcagaaaggctgcctgttcattagagaaggactgtgcctggtgtcgttaatccacttagccaatcactgatatcctaatgtttcttttcatgagaatttgctggacttttttgtttcctctattcaagttgagtgagatactcaaatttggtttggataaactgctggcctctgaggggagcaccatggatgaaatagacctggagtccatactgggagaaacaaaagatggccagtgggtctctgatgccttgcctgcagcagaaggagggagcagagatcaagaggaaggaagtaagttggaggttagagcagagcaaatggcacaaccaccccaagctagagctcacgtccccatggaaagttttggatgctgctctctggggcatcttttttctcccttaccctattgtcatttgggcacactgtttaagacttgcttgataaaagaacgttacccaaactaactggaaatttgtgtggctcttcccttgtagctgaactgtgaaccaaaatcatagtattaatgtttatgatagtatcaatcttaaggctttgaatttgtaccttttctcccttggttgcaaacatcttcttctttattagtaaagcctaccatccttggtatgatgctttgcacatagcgattcctcttctaaacagtagaattacttgtttttaaaattgcagctaacattaagcatttattttgcgttcatcaacagtgcggactttgtcatgtgctttttccatttaatttctgtaatccatgagatgtaggagatggttttgtctttctcttaattttctttcctgaatttggtcagcatttgtcattttgttcttttctattctgagcacttaaatttccgatttgaagtaatttttcacatggtagctttgtaaaggtattccctggcatcttgtagttattttgaaatgacttatttttctgtaccagctgcagcagagattcaatatggactggggtgagaggtttgggagtcttactaggcttcttaattcaccagtactttcttttaattatacacaatagtgctgtttcttcactagatggtagctcctttttattttgggtagtggtagtggcatgatttctgcttttgtagttctcttttgtttctataggaccgtgaatttccatcgctcgctttctctctgtgccacaaacttgtcaaaggatgtcttcccacttctaagttgtctctctccctgccagaagcaatgccttccctaattcctggctgcatgtattttcataccttcccttctgttcagttccttagtagccactgctctgatccactcagacctatcctcattattttcccacttggaatgggactgtcttttgtgggtaacttttatctgtctgacctttctggaaccctcctgccctctccactgcatagtctctgcctgactgtctactctagtgtgggctttggagctggttttgggggttcatttctcttaacttccataagttgaagtgtgtagtattttctgactcctaatgtagtaggcatggattggggtggttttgttgtccttgttgatctgtatagtttttgtgggataggtggaaaagttggaatttgggcagctggcattgttttacaggaaactgctttttgattttatgttttatcttcgaaattctttataaaaatatcttgtttgtattcttcaagaactctttcttgttctctgcttattgttttaattgtaactctgttctcatttcaaggacatactgtcttctctggggacatttattatggctttttaatatgtattccagggagaatattacatctttttaaaaagtatttctcttcccattgcattgacttttacttctacttctttaaaaaaaaatatatatatttatttatttattgaaattggcagataaaattgtatttatcatgtacaacatgatttcttgaagcacatgtacattgtggaatcattaaatctagctaatgaacatacatcacttcatatggttatatatttgtggtgagaacacttaacgtccactctcctagtatttctcaggaatacaatatgtcatcattagctatagtcaccatggtacctctttttctaaaaaggaaaattcgtttggggatctcttgttctcatcgatagtttccccaaccgtctggtattccctggctgtctgatcacatgtgctgatgaagtgccacaaagctgagggcagctctggcatgggccctggggacttattcctggttggtgagtcagcttttacatggagggcaccttctctgatccatatttgatgtcttttcactgggcaacccattttctccagagaccaatcttctagtattttccctgggagaggtgagaatggagttcacctggttgctgaaactgaaaaggcggggtgagtcaagggctcatggcactcctgctctttggggtgcagatcttctctcaattcccccctttgcagtactctgtacttgtaagtcctaaactcttgggggattgagagggtctctagactcctaatgagcccttggctaggcacctgtgttttgtttccatgtctcttcttaatctgtcattatccctccagcaactttgcattttccaaaaggttcttgaactttttcatccaccattgcctcatagatcttttttaaaattcctttaactgtcactttgtggtttcaagtgagagaagaaatagatgcatgtgatcatatttttaagttataattgattatattaagtagcaacacactcagttctgtactgatctagataatttcagcttattttcctaacgtttactagaacaaaataaagtcacactcttttccagaaagataattatatttctcagtcaatccaactgcctaaaataattttactttatttagacagtccaactgccagaaaaaatccccagttgtattacactttggaattttctcttcgatgaatggatataggtccgctctgtggtaaatgattctcctggtaggatagagacgcgggtctaggcttgtgatggcagagtgaagataggaagtatgattacaaagaatataagtggataggaaagactagtaactaacgtggccccaatcagaattaaataaaaaacagggttgctttatcttaaatgccagcatttttttaaaaagcatgtttggaagttgagaattgcatgcagtatgaagctacatatgttgatcatatttgacacttctcagctctatttttttctacttgttgatagagtgcctcattgaaagccccctgctgatttaattagcaaatgccaattagaattacagctggttagatttgggtacaagtgtgaagcaattgatctcttgagaatgaaaatgttttgctttcatactctctagggaaaacatacttataatggatttcacaaatattgtgaaaatatattatttggtaacatgtgctactaaatatgcttcccgattcaatcattatcttacctatctgtggttgctagtcttggctggtcctgacttttcttaatcacttgattcatgatcttggcagatcactcaacctcattgagcctttttgttctcatctgtaaaatggtcctattaatgcctactttactcttttacacagttggaaaaatcagacacgattatagttgtgaaagtgatctgatagcatgaagtgctattcaagatgacactattgtcttcattgttattattaccacagttattatttgctagcctgttaatctctccacccttctagagacccaattatatactgaaaagagcacactggccttagaatcagaaaatcctgcctcttccagtgagaattacagagtcccttaatttctgcctaagcctcagttttccctttcaaaagtaggattagttataccaggattgtggtgaggatcatgacaaagacgcttgatgagatctgtaaagaatattgtaaatccaagggattatttttgtgattcttcattttctcatagatttgccaagctgaatattaaaagtgtgtttggaataaaaaagtacggattttattagatgatcttaatgtcagtgagatttgcgctgagggatagttgggaataaatgaatgaggaatgaatggaagaatccagcagagattcacaaaccatctagggatgaaccaaagggttttaagccatgctctccccttggaaaagtaaacacatgggatccccatgtagaacccacattcttcagtgtcagtgggatgggaaatgaaataccttccttcatatggacttagcccatttagaatataggctgttctcctgtccacttttgttattgatttgaatagcattaatctatttttccttggtatctaacatttctctctttgtgttttatgttgttagaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgtaagaactgttaatttatttaaaagttgttcttccaaactctcattctaaaacaaacaaacaaaaaaatgatgctggcatcgttttgttctcttaggatgatttgtcaagaaataagtatgtgtttgctgaaatgttattataattaactataccctagtataaaaactatgtaaaaaagtcagcatgaaaaacataaaggagagaatatattgtacgatgtcatgcaggtgaaagcagccttgtccatccaagtcacccctaaaggcattcctatattataccaaaataccatatcctgctgttggtaatgatgaccctatgacaagaagagaggatggcaatcataaatgatatatgtagtgttcacagtgtttggcagttaacgtggtcattaaatgctagctatcactaagataatcatgatgttgaaatacaatcttaaaaaagttacataatacattgcagaaagagttccattaaaaatggctgaagtggcatcctgcagggtatgcttttagtcaaggaaaaaagttacttttctgaagtaacttattcctaatgaaatgaatcaaaatgactgtttcaaccatgccaatgctagggctgagtttacagcatggtatcctggtcactgtgcctgtgaagtgtgtagtatgaacagtgcctccaagtgctttgcctccagttcccaccatgcagggtgtgtggagatgcagtgttctgtggaatattaagcatgttgcttccgtacagtgtgtgttagggataatgaaattcggggaggaatcttcttgaccctggtgatggatcttgttcttcctctaggttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagtatgtctgcgttaaccaagctggcggccacagttgaaggagtcactattgtatagtgagaccacagttgaatatcactttaaaaatacagaaaattcattttaagttggttcctattggtaacagaatactttctgaaaacatttcctctaggtaagtgaaaagtctcagtgtataaggcagggaagatgcattccattaaaaccagaattgttttcttttttcttttgagatgggttcttgctctgttacccaggctggagtacagtggtatgggcacagctcattcagcctcaacttcccatgctcagtgatctacccactataacctccctagtagctgggaacacaggtgtgtgccaccatgcctggctaattttttttattatttgtagagacagagtttcacggtgttgcctaggctggtctcaagatcctaggcccaagctgtctttctgccttgacctccaaagtgctgggattacaggcgtgagctaccatgcccggccaaaaccagaagattttaagattttattgtagctatctgacaaagagtaatttacttcaacaatctcttttagtcttaaaaacaggaacattcagggagtgctcattattgaattgtagtcaggaagcagttagcctaatcagtaagacttgtttacaaataagtagaaaacttcaatcagggtgagtttctaattgcatttctacttggcagatattgtttgtgaacagcagtataaaatgtgctccaagggaaattgtgattgtctgggttaatttccttttgtctctggcctgctaaaggatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtaggtacgagaagtggtatgggctggggatgggggcctcagtccttatggtgccaagaactggggaggatggggcactgggactggggtggtggtcccagtgtagtattgtacagtcaaaaaagtgtgaattttagagtcaggagatattccagaatcatttcactcttggctttctcatttacctggtttagttacccaacctttcaacttcaacttccttatccatatgatgggacaatatctgtcttatcctctgcacaaggtttttaagagggtgaaatgaagcaacattgataagacaaacaaatcctttgagaaaaagcaaaacttcaagcttgttcccttgcttgacctttgtactttttacttcatctgcctaaaaccctttcttcccaaataaccacatcaagtgttgttcaaatgtctgtttctcagagaggtcttctgtgattacctcatataaaacaggccccatcccccctctgttattctctgtcccttctcccatattttcctttatcacacctgtcccacctgacacattacctatgtatttgtttatttgactgttgctttgcattaaaaaatacacttatggcagcaggggttttttcttgttcgctgctgtgactgtggtgcctagaacgatgccttacgtgtaatacatgctaccaaacgtttgtagtgtgaatgaatgactataaatgctaagatactaagcagctttgttagtaccagcttgaataagtcacttaacctttcctgtgtactgtttcataaccttgcctatgtgctgttgcataacctattgcttctactcactctgtaatgttccatctactctccgtccttccgcagtcatttgccaggaatcacagatgcaccacagagattttgctcattgagaaccctaatttttgagatgctttcctgttatcatggccccagctatatcttccagaaaacataaacatatttgggaagtccaacctgtgatattcctaggagataagatattttgtttcttccctttgaaaaatcattcttccacaagtcccttttgtgtgcctttgtttttctaaattgtgcactggacttcacctcctatagatgaaaattttctctttcttcaaacagatgactctggccactggggcagaggtggtttatttacagctctggaaaagcgatccgctgagccaagaaaaatatatgagctggctgggaaaatgaaaggtaagaagcaaagcagagggaaaggttaagggtggaataagagagaagaggacacctaagactgtatcgtgagggttacacagcactagataaggaattagaataaccagttgggaactgaattctgtcataaattagctacttgttctgtgacttcaaggcattcctttaccttttctgtacctgtttcctcatctgtgatttgtgaataatacttgttctgcctacttcatagaactgtagtaagcataataaatgtgtgtattctgaaaaatgttgatccctgcatacatgttaaagtattggaatgggctggacacagtggcccatgcctgtaatcccagactttgggaggctgaggcaggaggattgcttgaggccaggagtttgagaccagcttgggcaacatagtgagatcctgtctctaccaaaaatttaaaaattggctggatgtggtggtgcatgcccgtagttccagctactcaggaggctgaggtgggaggatcacttgagtctaagaggttgaggttgcagtgagctgtgattacaccactgtactacagcctgagtgagagtgagaccctgtttcataaaaaaaaaaaaaaaagaaagaaagaaaaaagagaactattggaataaacatgaaggaatatgtcatgaaaatatcaaagatctatgggaagccgggcgtggtggctcacagctgtgatcccagcaatttggaaggccgagacgaggcaaggaattcaaaaccagcctcaccaatatggcaaagccctgtctctacaaaaaaatacaaaattagccaggcatggtggcacatgcctgtaatcccagctactcaggaggctgaggcagaagaatcacttgaacctgggaggtggaggttgcaatgagctgagatcatgccattgcacttcagcctgggtgactgagcaagactgtctcaagaaaaagacctatgggagagaaattggacataccattaaaatgctgacaagaactcgggtttggtgctgagtggaatgaagatgtgttaagaggtcagcacaaccttgggtataacactccctggagacagaaataaagctgttgggtgccaggggaacttagaagcctgaacaatattgtcctttggcacagagaagggaaaaaggcacctccttttacatccagaaataacaaagtggcaagaataaaattattattgtggtgattttctggagattgaaggaccttgtctgatagagaagggccctccagattccttagatattgttttttcctaattctgcccagttctctatggtggaaagggatataagaacttagaatgactactttttctagtaaaacaagttactgaaagaagggtttaatgtgtgttgaaatagtcaatccagatctagatgctgattgggcagttggcaaagcaaaacccagggaaggtcagagctggaggtgcagattgaggagtccctgtttggagtctgtgtttaaaatcatgtgggagagaggatggagaaatgagaggcagagaacagacctggaaaacacctctacttaggacttgaggcaagaagatggaatttctgacagaaggaattgtcagacaattagggaaccttgtgcggtattttgaggtacaagggaggaaagtatgtcaagaaggcaaagaagttcatggtattagacactgaagtgaggatgaattgggaaaaggccatggattttgacccaaggttgctcaccttggagcactttgaggagagtgggaagctcagacttaaggcctgagggctcaggaaggaaatggagatgagagtgtgctgttttctctgaaggaggattgaagcaggttgcagcaaagtaggtgaaactgtggattccaattcccagggaaggcttcatggaggtcctgggcctggaaaggtgggttgaatttgaataggtggagagaaatggcaagaggatccccaactgctcattacaacacttactattccttgtctgtgggtattgaaggacccaggcagttagcctgttcctttgtgtggaggatggcgtacaggccatgcaggccagagtggagggtttaggcagaagaatagaggagagtttcgttttcatcagcggcttgggccacatcatagaagacctcacatgatttgtccagggagatgccattctgagcagaaccttatctaatggaatgggtaatagctggtcgttttgggggatttgatcaaaaggatggcatagcacaaccagtattttagaatgactgaacaaaaagttcaaactggtatcaacctaaccagtagacagggtctgtaaaataaaaggaacaaaggttttttgttgttttgtttttgtttttgagatggagtctcattgtctggagtgcagtggcccgatcttggctcactgcaatatccacctcccaggctcaggagatcctcctgcctcagcctcccaagtagctttgtaccacaggcgcacaccaccatgcccggccactcttttgaatttttggtagagacagggttttgccatgttgcccaggctggcctcaaactcctgagctcaagtggtccacctccctcagcttctccaagtgcaaggattacacacataagccactgcacccaacctgaggtttttaaggagaaatgaggaagattacatactttttttgaatcagttatccttggctacaaggattagtaagggtggcaccacgccgaggttgggcaggcagttgatgagcagatgtctttgcagaagtatatttttatgtaagcttgccagggcccttgtgcaaggtcatgggttttgtaaaatctgttgtgatagttcttgttatcagacatttatgcattagaaccttcccttcatggccttccctggctctatttgtcagagttttgttttattttttgagatagggtctcaccctgtcacccaggctggagtgcactggcgtgatcatagctcaccacagcctcgaactcctttgctcaagagatcctcccacctcagcctcccaagtagctaagactacaggttcacaacaccaaacctaactttttcttattttttgtagagactgggtcttgcgccttgttgcccaggttagtctggaactctggcttccagcaatcctcccacctcagcctcccaaagcactgggattatagtcatgagtcactgtgctcggccgtatatgtcagtttttaacacaagcatctctattttgattctaaccgctttcacatcagcttatgtaaagccatagaattaaattagcacatttttcttcactatcagttttacttgatttggatggggtaggaaaatatattatacaaacaggtagagataaagtagaatgtaataatttgaatgatttaggacaagcacaaaactaccaaaggaatttcaagctcataatgctccctccccaaagccccccagctacctctgggttttgtattcactttctgatgtctacaggggtactttgttgttaatgtttgaggagcattaaattaggagatcataaaaattcaggagtgaagcaggtgagtacccagctaagaggttgactgaggccaggaaagtgagaaagggctgtgtaggaaggtgggtcctgaaacccaactgaatttgaagagggcgagatacgaggaggattcattcattagtgaacttggtgttctttatgttgctcctttctgttttacctcagacctgagtttgggaggtgtccttttatttcctgttgatgataaagaatcaagaaacaaagggcaagatttggtaagtaaaacccatctcttctcagaactacaagtggactcacatcaacttctcttgaagtgtcccctgccccaattggcctctctgctagtgtattagtttgttagggctgccataacaaaaagacacagactaggtagcttaaacaacagaaatgtatttccttatagttctggaggctgaaagtccaagatcaaggtatcagcaggtttggtttctcccgaggattctctccttggcttgcagatggcggtcatcttgctgtgcatgcacaaccctggtgtctgtgtgtccaggtttcctttcttgtaaggatagcactcagaatggatcaggccccaccctaaacccttgttttaacttcattgcccctttaaagactctgtctctaaatacagtaaacatgaggtacggggggttggggcttcaatatatgaatttggggggacacagttcagcctataacaagcagattgggccatagtctccactgtacttcccctgtccccaggcttccatccatctgtccccggagcaccgtccagatagcagatcccatcttaagtacgaggatttctatttgtctttttatcctcagtaccctacatagtactagctcataagaaatgctccataaacatttactgcatgagtaagaaagcatgactcagaactctgacggtttcatttcttaccatgtgaaaatttctatgaaagattgtgttttctagtcagccataataaagcaggagagaggaactaacacatatgtcctctgcccacatcagaatccttttgcatcttaggcatcttgggatgcctgcagtgagtttgattaaccccacctacctggctttctccaaggcctgggttcatgttcagattttaagccagaattaagaaatttcaaaatcaggccaaaagagaggttcatccttttgaggttgctgtctatgtgactgtgttaggctgtttttgcactgtgataaaagaattccctgagactgggtaatttacaaagaaaagagatttatttgctcatggttctgcatgctgtacaggaagcctgatactgacatctgctcctgctgggggcttcaggaagctcacagtcatggtggaaggcaaaggggaagctagtttatcacacatggcaagagcaggaacaagagagagtgggggaaggtgccacactgctttaaataacgagatgtcatgtgaactaccagagcaagaactcatcaccaagggtatggcattaagccatccatgagggatccaccccatgatccaatacctcccactaggccccacctccaacactggggattacatcctaacatgagatttggagggggacacacatccaaactacacagtgactaacagcaaagtggtttctgttgagtcattccttcagtaatttctaaaatgctaaaaaaggagaaaagtaaagtgtctgtgcatgagaaactcagaatccagtgattcaggaaaactgtttacagggagtagagcaccatgtctatgatatgactgtggtgatgtcatcccggaagctcccttgacactctccagctctgcccacttaggttaggatggttgagagatacttggcattttgtcctcatgggaattgttcgaacagagatggaatgactgcttgtcctgggggttgtggagctgactcaggcatcaaagggctgggatacaggagcctctaagatcttttccatgcctacaattcagaaaaattctcttttttttttttaacccttgagagcttttggaaagtatatgttttggactcattctctggttttaaagtattttaaaaagaagaagaaaaccctgtataaagtgaccacaaagtaagaattatgacgggatgtgaagtcatacatatagtaggacattgctgttcaggcatagcatccgaaagagacagagccaagcccaagtgacccatcaagggctgtgccgcctccatgggcggtcacttggttgagtgtggctgtttcatgttgggttggtcatctaatggtggttctttccagttggccttgattgtggctcagcatcgtgatcgttccaatgtcctgtctggcattaagatggcagccctagaagagggcctgaagaagatatttttagcagcaaaaaagaagaaaggtaagctcttccacctgtgctcaagagtagatgaatttgtttctaggcatgtgatacgacttttgaagggaggtaagaaatgtcaagatcccacttaatatgcacggtaaaggcaaaccacagaagtgatcaccccaccgtcttgtagtcatatagccccttgtcctttccaaaacacttttaataccggttatctctgtaggccgtctccatcccccgggtatttttatcgtgattttacagatgaggtggcagaggactagacatgaagcaacttggtcatatgtagttggtaaatgctgtttatttaatctcctcttggagagtcacagttcccaataacagacagttcttcgacaaaaattgagtttagttttgtttcgaaacctagtgtgtctcagagcttattgaattgattggcttgttagagaatctttgcttattttaattttgcctccaccaatcataatctatttccaattgtatgtatttccagaacttgtaggtccttgtgttcaacagaataatttaatttttcttactacaattcttcccccggaatatttttgacattataattatgggctttgagggagatagtcaataataattttctcccatgtgtattttatacccatcaatcaatttttgatgagtgaagacgtgttcttctcttcataatagcaagtgttcatcttccacgtattggacatgccacgaaaggttttaactggtatggtactgagcgacttattcggaaacatctggctgcaagaggcatcccaacttacatgtatccttttgtgatcttcattgtgtgttctcccaacccaagagggaaaatgtgttcattttctggtgtcagttcttaatccaagaccaagtttcttcctgccacagtctttactttccccctcttcagtgagacaaagaaagaagcactttctaacttgtgtgtatcaaatatgtacacccaacaggatcaacacatccaagcatttctggatgccagcagataaattaaaagatacatgaaggggagaattaattgagcaattgttaatttggtaacatattgagtctgtcacatcacttctctagagatccttcaggtctgtggaacaaggcttaattctaagaacttcacactgttcattttaatgaacagttaagcaaacaaataagtgaactattttattcctgaacctttttgatgtattgttaaaaagcagtatgaaatttattttaaccatgaagtcatgatctactttagctagactagcgttttcttctaatgacctccttgcttataagttagcatattttgaactattatattgagtcccaaaattactagagaaagcagaattgaccccaagtgctataatcacacagaaactccatctttttacatatttgactgaaattcactcagtgatggtcttcaagatatttaaatcactgtaaaaacttagagaagccagcttttatgtgcttgcacaattcgagcagtatctaaagagttttagtactctgaaaacaacagcagcaataagtactaatattgaaagtgtttatgatatcgtgagagaattaaagcatactacttctagaacagttatttcaataattactagagaactagtcgttttggtaaagttggtttaaagtgatgacatgtatcttccttgaccatccttatcagatattattttcctagaagcaagtctgctgtccttcatgcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcaatttggttctcctggatgttttgctctgttttggtacctgtaatatagggaaacacaactttttttgggaaagccctttgaccccagcttgctagttgcataataataaattttctgttcct

SEQ ID NO: 37729 - DNA, 77229 bp, Homo sapiens
ggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgaggtaggagctgcggggcgagccctgggcccggggccgggggagccaggccggggagccagcccgggcggggcccgcgctccagccgctcagccgcccgtcagggccgcgccgccgccatcactcccgggccgcggtggttgcgcgctgggcgaggggcgcgcgcggggagagggggtccgggttggctgccggggaggctgagggcaatgcggggtgcgcgagggggacttgcgaacgccgcggcgccgcggggggcgtgcgctttaaaggctgcgtgcgcgtgtgctgagtgggtgtgtggggaccccgcgccgaccccataggagctcagggggctgctgtcagccgcctcacaccttcacgttgcaattccgaatatccccagccgtcttccttgctttaacttctttctttcaaaagaggttcccgggactccggggatgggatgagcctgcgggggtgcctggtgcggtggggggtattagcaaagcttcaagaaacagggccttataaggaatcaagacaacaaatacgaacgtttcgataagactctggggggcgggatcccacatcaggacccgccaggcctgggctcgtgcgtgtggccgtgggatgcagtgtgctttttctttctagtcagggataaagggttaaaagtgctcctggtgtcggggggtagatatggagagtcggaaggggagttgtatcacaaaagctggtctgaggctaaaggaatctggcaagatggtcggggtgaacaaagaggaaagaactcacacggagcaagaggcggttgcaaacacttgtagccagcagtgatggaaaagccaaagaagaaaaccaagtgtcagcttttagaaagacgggattaatgaaaagcacaagaattttaaagactaaaagagataccgattctctctttgccaaagagccagagtcagttcttttcttcttggtccctgtgatcccgccatacctcgtatcaaataaatagtgccaaaagtgggtcaaagaatgttagagctggaaaggaacccagcgatgatgccattcttttattgtacaaatgaggaaactgaggcccagataggtggagtaagtggcctgctcaggtgacacggctgtttgttgagtatccagggattgaaacttcaaggactctgagattcgtgctcttcccaaagcatcgtgcagtatacagatctttgcctagatacaattccatacattttctctgcagtgtcctcagggaatgccctttgaaagggccagcgtgacactgaatatcatacttgggcttatgtcatttttttcagtcttcaagtggtgtttatggtctgcttggatcttaggtttccaaagctgttggatagccgcctgggccataataagctttcagctgttgggtctacattatttcaaataattttgttatctttcaattaaggtaatagaactgtgcctctctccccaacattctattgttgtccatttgcttatgttatattgcgttatgttcattgcctgtgagttcctaggtgaggatgtattttattgagtgtgcctttcatgttttaaaatttcattttgtaacactgtaaatattggagtggttctgatcacttcaaatggggagaatcttattgattgattttattttaaggctttgggttgttttgtttattcatttgggtaccagtttccatctcatggaagatcacagttgttagaatggacatggctaaataagagaaggggctgctgattttaagaaaaacttcctatgtgacaatttgtggtatctgttacgtttaattcaaacaagtccacaccttgggtcaggtaagcgcgttatctaggagatgacttgtttgctactgtagcctctggaagatgaaatttcaagctccagattgagacacagggaaggaatggagaggttttttttttttttttttttttttttgtaaagcaaaccatcagaaaaaaaaagttgatttctatcaccagtagtttggttattgcataacttgaagctaaactctgcacaaaataatctttgctatatacccaactaggtaaactatcccaccttctcatcagttctcaccttttcggtgcttgtattttttgcccacgggatattaatatggattgtgttcagaaatttaaggtgtgtacttcatagtatgtatgattgtaggagaaaaatgtgctatcatcgtttggagtgttacaacataaatattttggtcaacacttcctatcctgctctgacttttcatctcatctccattttcttcctctcttgattgtttttatgtcatttacatatgtaaaagccacatcaagactaaagttgccatttattactttttgatacttaagtcgagttttttcaaatcatagtattgttagtattcaaattgtctgtaatttttgttaggcttatatattatgaatccatttgttgtggtttatttggcttgttgttatgtaggtaggtgacacaggtagtcttattgtaaaaggaagacgttatagataggtaaataacatgctcaagattagatgcaggttacaggtggaatcgaaggaagcctaactattttcgtgccctacaaaaatgtctgtatctcataaagttattcacagatttctggacattctatctgtgacacattttttccctttctgttaagagtgcagattactgcattattcctacaaaaggaagcaaaataaccctagtttgtatgatttttctgataatttgaaacttattcgtttaaaaagctatctggcaattccaggttactggactcttgagaagaatatccttttattttgatactataaaatatcaaagtatcaaaatactttaactgtgcaacttaataaaaataatgcttcaaagttagctctgcactatcgctgtcctcaaatgtgtggtatttaaaggaagaaaatgtttttaattctgagctttgtgaatagaactcttctaaaatcagaagtttttttttttctcctgcagtgttggaaacacaacagttttatgcttatttctgggaataagaaagtcaaacttaacaatctagtttccattgatcagacagtttttgtacttaaatttaagttctaagcatcagagtgataaatactttttaaaattgtattcactgttaattatagtggccttatttgaagtaaaatcttgacattgggtgttttattaatgatgatcctctgctactgaaaagcctatgtcagtttggagaagattttgcacatctaaatctatgctgtttttactaatcaaaagagaagagcaatttacaggtgttagatttttagttggttgaatgagaccctcacttttgatggtttcagagttgaagtgacgttttattacttttgttagtttgggtcacacccatcacttccttggaaggtatctttgaggtttggtttcctttttttttaaatggtaatattggggtgggggtgcttcctgtttgtattttcaaaattaggtccacatgttaaccttcttgtagtgtcacatttttattttaaacttatacagacaaacatcagatgccatgtggtttgtctctgaccctttgcgctacttcatgacagctttactgagtgaagcctgaatacccaatcgggaaggcaagatgttcttgtcttttcccaactctcttcaaagtttaacagccttggaaggagtcttagaacagcaacaaaagcacaatttacagaaaaatggaggtgctgctatctgtttcctcgcaggtacttggaaaatgtatagcactaagatagagttgaaacatgttatgtagagccttgaatgtcggtgcttcaaagaggagttgctctgggtttacatgatacagaaccccatggtttatattaagtagtaatgatagccgtttttctggactcgcttaaaagccatacacagtgtcatggaaaagagttaagaacaaggtgaaattcagggtatggtattagagctcaggaggaatcaccttcagccttaaaactcttcctttactctcctggatcacttaagtgataggtcacttttaatataaatgttgcaggatgagttaagtggagccttgagaaatatgtgtagattgtttcagtgattaaagcaagtgttcttttcctggcctttaactcgctttatgctaagaagtgtaataactaaatagactcctaattgaattgacattcagatgtgtttgcagtttagggggagtttacctcttctaaattttcatttggatcccattactaaaagcagtattgcattagcatggtgcacaattatgtacaattcaatttgcaaatgaagttaatacttggagtatcttgacttcctattcccctgctgccccaatattcaagaaaggagaagttataatttgtcacatacaagatggtttcttctttaggtttattcttaataactatgtccattttcacatggatgacaccactgagatgatgaatacctgtattgattgattgatgaagaacatttatctttttctacctacttttggaagctagcttgcaaaatctactgcaacattcactcttcatgtatccttctattacctttggtaccctgaataaccttttaaaaatttttgtacttttctaatatgaagagaagtagcttcatattctatgctagttttctgaggtgcttgtgctgactcattttttaaattatactaagatatagagcatggtttgagagcagtaatgagattctcagaaaatatgaaaactttcctttctgactagttagagaaaggttggggaagacaaggggaaatacatcaatgagccaatcaattattgttatttgttgggattaatttggtgactaatatttttaatgcccatcaggctactaaatgtgaatttggctttaccctgtaatgataacaggacaaacccaacgggtttctaacattgcttgttttcccctggtaggggatttctttgcatatgggaaatcaggccgaagttgccagtaacagccacatccatgatttgtattaaaaataactattcatcattctgggctagagctctgcttaccatggctcacctgggaagatattctgattatgtatctaatcattatgatgccacctttcgagaggtgagcagacaattaacaagtccttcaaattatgttcaaaacccagagtttgagaaaatgttccaacgccttcaagtgtgaagataataaaaacattacctaatgcttaccgttcactgacagtgtgctgggcagacattgttttcagctctggccttgtgttaactcgtgattctcagaggagtgggtattattcccagatggaagatgaagaaatggccacagagaagttaagtaatttgtccaaggtcacattactgttcttggcggggctgattccagagactgcatccctaactagtgtacagcaaaagcgagctggccactgccactttgttataagacattttgtttctttgaggcttgtatttctttgtgttcccaaatggagtctcgttggtttttgaatagaaaatatttttatatgtttaggatttttttaaatgttgatgaagatggtgataaatatttttccaattaaagtatatacttctggtggaaattatattaaagaagagaaagtcttaatttttattataagttgtctttcattcttcttcccctagcattaccgtgtacatcatagaagaagagctataagctgtctccttggcctctgtttacaaacaaagggatcatttgtgccaatgtagtgggtttgtgttgacatgcacgtctgtactgagaactcaacaatcccactcattttatttacaactttattttgcggggatttctgtcctattcttgttgcattaaagctttttagagcattagtcatgatttctgagacagatttaagaattttacttatttgggctaatttattattattatttcttgagacagagcctcgctctgtcacccaggctggaatgcagtggcgcgatcttggctcactgcaacctccgtctcctgggttcaagagattctcctgcccagcctccggagtagctaggactacaggcatgtgccaccatgcccagctaatttttgtatttttagtagagacggggttttgacatgttggccaggctggtctcgaactcctgacctcaggtgatcctcctgccttggccttccgaagtgctgggattacaggcataagccaccatgcccagcctatttgggcgaatttttaaggcaactgaactattgtatgtctagagctctgcaaaggccattagaaaatagtctcagatttttttttttttttcatttatgatgcttactttctctcagcacttttccttgggagtggattgtgaagttaagtcttggaaacagaattcacaaccctaaagcgtagtgctttaactttgggagatcaagtcacagacaagaagaacttcaattccctgtgcagagtataaacttgttcaaataaacagaggatgttagcttccaggattgtcaactgtcacctttgaccagggttgaattttctttgaatgttgacagaagttacaatgtcagtggaaaaagcttaatgtgaggtatctataactcagaatttccttatgtttgtgtcagtgagatcctacaattaaagctgcttctttttttctatgtctgatgagttttaaaagccttcactggggttttccagcctttaggtgagagtaagttaaaaagtttgtgagaaactattttttgttgtctaaaattcagagcctaggtcgggcccagtggctcacgcctgtaatcctaacaatttgggaggccgaggcaagcggatcacgtgaggtcaggagttggagaccagcctggccaacatggtgaaaccctgtctctactaaaaatacaaaaattagccaggtgtggtggtgcacgcctgtaatcccagctactcaggaggctgaggcagaagaatcacttgaacccaggaggcagaggttacagtgagccgagatcgcactactgtgctccagcctgggagacggagcgagactccatctcaaaaaaataaataaattaaataaattcagagcctatagctggtggcaagtcactgtttttgaaggagtgggattttaaaaaatctaacctgggctaaatgttaagttacattcatacatgtcattgtagcctatataaaaagaaacttgaacacttgatctcttaaagtactaaaaattggaattcatcagctttgtaatatagcattcattctacagtatatttaaataggtaaaatgttctgttagaaataatgctaattctgtttttttgtttaatgtttctaaaaatcttttggtcatcttttaggtttaggaaaagtagcaaattagagatctacagaaatctacagctctttaaaaatgaaacagttcaccctgtgaatttgtttgcaggattggtgatctgtttctgatgccaggaaggtgggactcctatctcatttctgatagaaagtgagggaaagctatgtatagtgagaactggatactagattcttattccgaaggcatggaaggtttaatatgtaaggatacaatgtaaatagtccctctttttgtatttttctttggttattgttacgtaactatagtcgtttgtcacttaatgatacatggtgacaaagttctaagaaatgcattaggcgattttgtcattgtggtaccatcatagagggtacttacacaaacgtagatggtgagccctactgcacacctaggctgtatgataaagcctattgctcctagactacaaacctgtggaacatgtatactgtattgagtactgtagacaattgtaacacaagggtaagtatttgtgtatctaaacatatctaaatatagaaaagttacagtaaaaacatggcataaaggataaaaaatggtacatctatatagggtacttaacaggaatggagcttgcaggactggaagttgctctgggcaactcagtgggtgaatggtgagtgaatgtgaaggcctaggacattactgtacattactgtagattttaaaaatactgtctggttaggctacattaaatgtattttgaaaattgtttctttcttcaataataaccttagcctactgtaatacttttactttgtaaactttttactttttttttttttttttgagatggagtcttgctcttgtggcccaggctggagtgcagtggcgtgatctcggatcactgcaacctctacctcccggttcaagcaattctccttcctcagcctcccgaatagctgggattacaggcgtgtgccaccacgcctggctaatttttgtatttttagtagagacggggtttcaccatgttggccaggctggtctcaaacttctgacctcaggtgatccacccactttgacctcccaaagtgctcggattataggtgtgagccgccgtgcccggccaactgtttacttttttacacttttaaactcttttgtagtaacacttagcttaacacataaacatgtacagctgtgcaacaatattttctttatgtttttattcttttactttttctctttttaaataatttttaatttttcaaaactttaaaaactttttaatttttcaaaactttaaaaactttttcttaaaagtgaaggcataaacacacacattagtctaggcctacacagggtcagggtcatcagtatcactgtcttgcacctccacatcttgttccactgaaaggtcttcaggggcagtaacacatatggagctgtcatctcttgtgataacaatgcctcctgaaggacctgcctgaggctgttttacagttaacttttttttttaagtagaaggagtacactctaaaataacgataaaaagtatggtaaatacataaaccagtaacataggcatttattatcattatcaagtatgtactgcacgcaattgtatgtgctagactttcacatgactggcagtgcagtgggtttgtttacaccagcattgccacaaacatgtgagtcatgcattgcattacaacattatgatggctacagcgtcactagaggataggaatttttcagctacgttttattatcttatgggaccacagtgatatatgtggtctgtcattgactgaaacgtcattatgtggtgcctgactacatatatggaaactctgagtgtagtcatgttttacaaatgagtttatcttgcagtgagtttaaatatcaagtaaaaatactaatttcattgtaatgtatgaagagattggcctttctcctcatgttgaaggtatcaaaacaaaatagaaaatatttggcttcctgagtggcatggctacaattcacatgctgagttggtgatgaggcaagatcccttgactttgcaataccagaaaaatgcacatagttaaaaaaaaatagagacaggggtcttgctatgtctccaggtgatccctcccacctccacctccacacctcccacctcaaccttccacagtattgggattacaggaatgagtcactgcaccgggccaaaaagcatataattttaagggaatgatttttttttttttttttttattttttgagacagtgtcttgctctgttgcccaggatgagtgaagtgtgccaggagtgggtccttaagtaagaaaacgtattactttagacacacatttaaaattttgtccaaaaatgtgatattctcaaaatttatggttttgaattttatttattattttaatttattattattattttttaaagagtggggtctcactatgttgcccgggctggtctcaaagtcctgagctcaagtgatcctcccacctcagcctccagagtagatgggactgcaggtgtgagcccctgagcctggctagttttgaatttttattacccaaatgtgaagaggtctagtttgcacagaacttaacattacattccagttttattggtaaatttgaacaggatataagtggctttaataactaataaaagaagatacatcttatagatacacatatgtctttttatatgtatacataaatatttaaaacttctttatgccaaaaaatgccagaaaccaaagctaagtgacaaaataagaaaaatatttctaatatatatgacaaagcattatgggtaaatattcgtaatatataagtaatctatataagtagtaagaaaaagatgattcccataatagaaaatgaacaaaagaagaactacaaatagccgataatcatatgaaacagtgttcacccatactggaaatcaagaaatgcaaataaaaatgacaagttttttcagttaacagatttatgaagactaaaaatattgaaaaataagagcagtgttgcttgggaatgtgggaaactggcactttcatactcattggttgaaatgtaaatgggtgctttttttggatggcagtttgatacatgtattgagagcttaaaagagtgcatactcaagctgggcatgggagctcaggcctgtaatcccagcactttgggaagctaaggcagtcggatcacgaggtcaggagttcaagaccatcccggccaacatggtgaaaccccgtctctactaaaaatacaaaaattagctgggcatggtggcacgtgcctgtaatcccagctactcgggaggctgaggcagggagtcagaggttgctgtgagccgagatcacactactgcactccagcctggtgacagagcgagacttcgtctcaaaaaaaaaaaagaagagtacataccctttgacttagcagtttcatttagatgaatttcattctaggacatctgaaatatgtttaaagatttgtacaaataggcatgggcaaggacttcatgtctaaaacaccaaaagcgatggcaacaaaagacaaaattgacaaatgggatctaattagactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcagtattcacaatagcaaagacttggaaccaacccagatgtccaacaacgatagactggattaagaaaatgtggcacatacacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaataatgggaacacatggacacaggaaggggaacatcacactctggggactgttgtggggtggggggaggggggagggatagcattgggagatatacctaatgccagatgacgagttagtgggtgcagcacaccagcatggcacatgtatacgtatgtaactaacctgcacaatgtgcacatgtaccctaaaacttaaagtataataataaataaattaaaaaaaaaagatttgtacaaaaggagtgttacttaaaatagcaataaattggaaaaatcttggtatttccattagaggtttaataaactaaatcatttattacacctgtgtatagctgtccaatagaatactgtccagctatttaaattatgttataaaacaatatttaatgacctacacaaaattcactatatattactaaatgaaaaatgaaattacaaacaatcatatacaattgtgcctggaaaaaagaacaggcgctgaaaaaagatttcttctgggtcgtggagttccctgtgtgtgtgtgtgtgtgtgtgtgtgtgtgtgtgtgtgtgcgcgctttctagtatctttccatttttctataataaacagattatggctgggcacagtgactcatgcctatatttccagcactttgggaggctgaggtgggaggatcacttgagtccaggagttcaagatcagcctgggcaacatagcaagaccctatctctacaaaaaattaaaaaattagctgggcctggtggcacatgcctgtggtctcaactacttgggaagatgaagtaggaggatcacttgagcctgggagttcgaggctgcaatgagctgtgattgagccactgcattcgtcctgggtgacagagtgagaccttgtctcaaaaacaacaaataaaaacaaacaaaaaaacagatgataatacagggaatccttttgtaatcaggaaaaaaaagttatctttaaaatggctgtgtgtattgatatgtcttagaacgtagaatttgttttttgttatcagtgttttctttttagaagcagaaaaaagagtttgtgatgtttttgttaattttttggtatagtatcctgttttttgacatcttttgttgaactatgttaaaatcatcataatttcatttaacatttttagagtttaaataatttgaacttcaggactgtgttatttcctgtgcttcgtggtagcctgtatatttttacacagaagcttatggagaattatattgttatataatataataaattgttagggagacagaggtgaaaggattgcttgaacctgggaagtggaggctgcagtgagctataatggtgccattgcactcccaagcccgggcaatggacagagaccctgtctctctttaaaaaaaaaaaaaaattgtttttgtttttttatatatatatatatatatatatatatatatatatatatatatatacacacacacacacacacacacacacacatatatatacatatatatatacacacatatatatacacatatatatacacacatatatatgtgtatatatacacacacatatatgtgtgtatatacatatatatgtgtgtatatatacacatatatatgtgtgtatatatacacacatatatatgtgtatatatatacatatatgtatatatatacacacatatatatacacactctgctaagttattcatttcatattgaagatgttttgaaaaaaatggttgagtttgttttaaccctgaactttgtattatttcaatatattttctgcattggcttttccccttcatggtgatacctatgaaggctgctaggctatggatttctttttcttataattccattagtcacacttaatgacttctctaaatgtttattatggtactcatttgggaatatctggtaaaggaaatctctagtgaaagatattttctcttgggtataagtcattcctaataccagagatttatgttctgccttaattaaatttacattaaatagtttctttgtaactagaattagtgtttaaaagaattttcctgcatggacaacatagcaagaccccatctctacgaaaaataaaaatattagcacggggtgctggtgtatgcctatagtccagctactcaggaggctgaggtcggaggattgcttgagcctgggaggtggaggatacagtgagctgtgatcgctccactgtactctagcctgggtgacagagaaagaccctgtctcagaataaaaataaaagaattttaacacttgacagagtttaaagaagaggaatgaaagtaaattatgagttgatactttaagagaatttaaataaaattacaaccttaaaaatagacaattttgagcccagtagacttacttatttcatgtaaaatttaattaagtaaaaatctattttaggccaggtgagatgactcacatctgtaatcctagcactttgggaggctgagggggaaggattgcttgaggccgggagttcgagactagcctggacaacgtaatgagatcccatctttatttttatattagaaaaaaatctggctgggcatggtggcccatgcctttaatcccagcactttggaaggctgaggtgggctcatcacttgagcccaggggttcaaaagtatcctgggcaacatggtgaaacctcatctctataaaaatacaaaaattagctagacgtggtggtgtgtgcctgtagtcccagctacttgggagcctgaggtgggaggatggcttgagcccaggaggcagaggttacagtgagctgagattgcaccactgcactccagcctgggtgacagagtgagaccctgtctcaaaaataaataaataaaaataaaaaataaaaaatctatcttaacttggattgtgcattgtaatttattatagtgaaattgctataacagaattttattttaagccagtttggggaataccaaaacatttttaaaaatcacgtagtactttttagtgcttttaaaacctaaatccataaagtagttaattaaaatgcatgaagtaaataagtgtttttctgtattaaagataaaactataaacatatattgttcaatatgcctacataaataaatcattctcttctttttggttattttttgcttatcacctcttacctcctctacttcctaaaaacatgataatctcgtttaattcaaaattatgttttctggccatacatggtggattatgcctgtaatcctaacactttgggaggctgaggtgggcggaccacttgagtcaggaggtcgagaccagcctggcccgcttggtgagaccctgtctctactaaaaatacaaaaattagccgggcgtggtggcacatgtctgtagtctcaggaggctgaggcaggagaatcatttgaacacaggtggcagatgttgcagtgagctgagattgcaccactgcacttcagcctcggcgacaaaatgagactctgtctcaagaaaaaaaaaaaaaaggtaagacatataaactaggaaactaagcaataattgtgtacagtatgtggaatatttatgttctagaccagcactgttcaatacaaatataatgtgagctccaattgtaattttcttagtctgtatcacaataaaaagtaaaaataaaattaattttaacaatatactttaatatataaaaattatcatttcaacatttgatcaatataaaaattattgattaatgaggtattttgggccagtttggggagccaaagcaggaggatcacttgagtccaggagttcgagaccagcctgggcaacatagtgagacccagtctctaacaacaacaacaacaaaattagctaggcatggtgatgtgcacctatagtcccagctacttgggaggccaaggtgggaggatcacttgagccgaggaggttaaggctgcagtgagtcgtgttcgtgctactgcattccagcctgggcaacagagtgagaccctgtctcaaaaaaaaacaaacgaacccaaaagcccacaaaaacactgagatattttacattcctttttttgtacgaatgcttcaaaatctggtgtgtatcttacagttataaaatctctcaatttagccaccaaattttcaccagaaatgcatgaactgtgttcagatttcataaaactttcagttgataaagtagattcacatactgaaggtgttccaaacgtactgaaaggttttccaagtattaaattgaacaccagtttccaggtttacatttaagttaattcaaatgagataaaatttgcaattcagttccccagtcgcactagctacatttcaagtgcttaggtagcacatgctgctagaggctaccataataaacagtgtggctataggccttctaacgaagggaaatgaaatatagggctgtctcctgctttataacatctggcttacaatcaacaaatacaaatagggtcgcttggtgcagcaaaccaccatggcacatgtttacctgtgtaacaaatctgcacatcctgcacatgtatcctggaacttaaaataaaacaaaacaaatagggtctcttgccctgtgggaactgaagccactgctctgtaggaaataaaagtgtctttcttttttgttttttttttgagacagaatctcgctattttgccgagtgaagtggcatgatcttggctcactgaagcctccccccgacaggttcaagcaattctcctgcctcagcctcccaagtagctgggattacaggcacctgccaccacgcccggctaatttttgtatttttagtagatacggggtttcgctgtgttggccaggctggtctcaaactcctgacctcaggtgatccacccaccttggccttccaaactgttaggattacaggcgtgagccaccgcgcccagcacaaaagtgtctcttacctaaagaaagtgatgcccttaaagcttcctaccattccctcacccccaagacacacccagacacccacagatgcaccctcttgtttgaaaactgctgcatccttgcatggctgaagcattacccatgtccttgaagctcctgctttcagaggacctctcatttcttgggagtagaaaagccctctctggccaggtgcagtggctcacgcctgtaatcccaacactttgggaggccaaggtgggaggatcgcttgagcccaagagtttcaagtcagcctgggcaacatagtgagatcccatctctgaaaacaaaattctgaataaaaataaacagcccaccctgtttcaggtatacctcaactgtcaaatcacttttaggcagggtgttttgttatttttgttttgtttcagagtgttgtttaactttatttttgaaactgaatttgtctagaaaagaatcatattcaccttttggtcttagctactcttcatttttataaaatacatcaagttgatgcttaaaattggggatctagttacagatgaaatttttcctttcaaaagagagttccccccagttttgctgtagtcttaggagatacttaagggaggggaatcatttttagttccccctaggtgaggtggtagcctccctaaactgccaagttcacaccatgactggtaacaccactgtgtgaggaatactgaacaaacggagcttcagaagggagacttgcagagattctggaatctaggtaatgccacttcctacttagtttatcttaatggttttgtttgtttgtttgttttgagacggagtctcgctctgtttcccaggctggagtgcaatggcgtgatctcagatcactgcaacctccgtctcccaggttcaagtgattctcgtgcctcagcctcccagatagctgggattacaggcaagttccaccatgcccagctaatttttgtatttttagtagagacagggtttcaccatgttcgtcaggctggtctcaaactcctgacctcaggtgatccttccgcttcagcctcccaaagtgctgggattacaggcataagctaccgtgcccagccttaatggtctttttaaaggatacctgatttcagaaggaacctttgaagaaatggctagaacttctgtgtttctttggatattgcctgacatctaagccaaattagttgaccttttaatgttaaataaaatattcaataacttttactaatgggtgggctttaggaacccctttattttactatgttgccaaaagtaggttcattataacattggaaacatcctgatgtaatttattgaatgtaaaattattcctcaatacatttgaggatgatttccataaagggaaacaaattcctttcttccaaatatactgtgacagcctattttgaaatatttaaaatatgtccctaaagatgaaaattaaagagcggacacaaagttgttatgctctaaggagtcattcttttgatttaaaattcattataattccctggttgtctagtggttaggattcagcactctcataaaattcattatattgattctataaaagtatattgtgttggattaagaaacacatggacatttttaagtgtttcaaaatatttttgttatacctaggttttcactgtggtggtatttgttgttttagtagaatttgacctatattttattctatgggaaaaagaagaaagtaaacattggctagctatctaccaccctgtactgctatttgtgtgtggtcccattgtgaatttttaactccatgctctatatttttagtgctttgtgaagattgaatctgcaaatcacctttgaaagacaaaggatttgatttgattgtggcaatcatgaaagttatcctgtaaataaaactgtatgtcctggaccaaagctggaataatgccacactgaaatgatcttaactgtggaatccttgattggacccgatttgttttgcacatacaatagctccataaagatgataggctttcagcagggatgaacagatgttctggttttatcagaaattgcttttgcatcaccaagacttcacaaaagccagtaatccccctgtttgatgttgtggaggtgcttttaaaacttcttcccagatactggtttgaacacacagactttgtcattgacctgtaagattcaattgtcaggtggtatctgttttctcccaacagaaataaagagaagaagaataaaaacaaaaactagaaagtgtagcaggggcacaattatttatttaaactttaaagtatttaatattacataccagaatctaagttacataaagcatgtctgttttgttcactgccacattcttagtacctagaacagagcccaacatgtaatagttactcaataagtatctgttaaataagtatagtagtcctgccttatcccaagggatgcctgaaacctcaggtaatactgaaccctacatatatatattgttttttcctatgcatatataattatgataaagttcaatttataaattaggcacagtaagagattaagaacaatgataataaaatagaacaagtatgtagtctttttttttttttttttttttttttttgagacagagtctcgctctgtcacccaggctggagtgcagtggcgcaatctccgttcactgcacgctctgcttcctgggttcatgccattctcctgcctcagcctccccagtagctgggactacaggcatctgccaccacacccggctaattttttgtattttgtttagtagagacggggtttcaccatgttagccaggatggtctcgatctcctaacctcgtgacctgctcgcctcagcctcccaaaatgctgggattacaggcgtgagccactgtgcctggccgaatgtagtctatcttaaaatactgtatcttactatgctgtactgtgggtaacagaaaccatagaaaacaaaatctcagataaggaaagactattgtattcccctttaatctcaatacagcaggtgtatccagagaacttcaaccctcagaaggactgaaagtgtgccttttactgtggaagaaagaaaagagagggggctgggtgcagtggctcatgcctataatcccagtactatgggaggctgagccaggagggtcacttgagcccatgagttagagaccagcctgggccacagagtgagacgctgtctcaaaaaaagttggggggatgggggagaagagagaggagacagcaaatatctctttgtttcctttggatttcagcattaaagatagaaaaaatgtgagtttattaggcaaaaactggttttttaaccccattttaaagattgtggagttacgtatatatatcataaaatttaccatttttaaccttttattttgagatggagtttctctgtgtcacccaggctggaggttagctcattgcaaccttcacctcctggattcaagcaattctcctgcctcagcctcctgagtagctgggattacaggtgcacgccaccatgcctggctaattttggtatttttagtagaggtggggtttcaccatgttaaccagggtggtctggaactcctgaccttaggtgaaccgccctcggcctcccaaagtgctgggattacaggcgcgagccgctgtgcccggccattttcactgttttaaagtacagttccgtggcattaagcacattcacattgttgtgtgaccgtcagcacctggtccatctccagaattttttcatcctaaactaaaatcctgtattcattaaacagtaatgagaataaaactctccatttgcccctccccgcaggctctgacaaccgccattcattctttctgtctctatgagtttgactactccaggcatcttatatcagtggaatcatacactatctgcccctttgtgtttattcctttttttgcaacataattcttttggttggagacttcacagtttttctttcctttgattgtttagtttttgctttgtacctagacctggccagtgatgcatgtgcaatgagtatgcaaagacaagttaattcagcagcttgttgcataccactagggagttattaaagctttcaaaatgtgattcctcatctgtatgcctgtggcttatctactccaagtcttgctgataaacctgcactgagagtaatagcaaagattagtctttctccatgtttcataaaacaaattgttctcattcttacagcctgattatgaactggaaaattacaggtacattgttgtaattgtttatacagacaatgagacatactctccacaggggacctcagctgcaggggaggttctgattgcgtgtcattaagaaacgacagttaagaaacttttttttttttagacggagtctcgctccattgccaggctggagtgcagtggcacgatctcggctccctgcaacctctgcctcctgggttcaagtggttctcctgcctcagcctcccaagtagctgggactacaggcgcatgccaccacacccagctaatttttgtattttttgtagagacagggtttcaccatgttggccaggatggtctcaatctcctgacctcgtgatccgcctgcctaggcctcccaaagtgttgggattacaggcatgagccaccgcaccgaccttctttttttttccatttttaaaaattttctattctcattacatcttcctttctccctacttttccttcccttcccttccagtttgtccttccctctctctctttcttccttttttctttctttttcattctcatttttctgagtagttgctgaagacacagcctgaccctaggggtccaaatatagatgaaacaatcatagctctctagcagttcacctggagggagagagaaaaagagagtaagagaaccaaaatgaaggggaaatattcttaatttttttttttttaaggacagaaactaacttgttgaggaaaaagagaaatatactgggagttctgactgataggaacaaagagaggacagcttcgaaggatgatttgaaaagtaatctatggaatttagctttaaagcaggatcttgggctgtagactactttattattattattttttaagagacagagtgcagtggtgcagtcatggctcactgtagcctcaaactcctgggctcaagccatcctcccacctcagccttctgagtagctaggattacaggtacataccagcacgcctggctaattttttaatttttattttgtagagatgaggtcttgctgtgttgcccaggctggtcttgaactcctggcctcaagtgatcctcctgcctcagcatcccaaagtgctgggatgttgtggactcctttagagcctcttgaaatagggctagtaaagtgattttctaccactgtatctgtgctcatttacattgggcagatcacttctgcttgacttcatagtttcaacctataacatgaggggtcaacaggtagattcggaaccatcagagtttaggccgaagcccatagaatatgaaagttatttttaaaatttatttttacaatgtctacaaatgcagttgttaaagtgccagagacagaagtattgacaatgagaaattatccaaaaccaggccaggcgcggtgactcacgcctgtaatcccagcactttgggaggcaaaggtggcaagatgacttgaggccaggagtcacaggctgcaatgagttgtgttcatgccactgctctccagtctgggccacagaacaagaccctgtctctaaaaataatcatcatcatccaaaaccaagactggctcctattggaaaggtggaaatggttgtgatggaattcagcaacaccaataccttggtatttctgactttcaggatgttaggagactctttcagtccttcctgtttaaatatgaatggatatgtattgccattattgccctgcccctacatctcccaaatttagattgctagtatttatgtaagtttactagtcacaaatagattcttgcatttcccatctcttgtcatagggccctctttgagttcaatatgcttttattggcacttactttggttttctttacagcagcagctgctaattagtgacagcttttgagcaagcagcttgtcatttttggcagagataggggacatccatagcaagtcaagactatattttcatttgctaaatttactttgctacatggaaatacatcttggataaaaaatagtctgtagtcaaaggtggctgtgtttactgaattatcttcctgagttggcattctgtcctgtagttgaagaactcacagagatgaaaaaaagaaagaaagaaagaaagaaagaaagaaaggttcaacgtctatcagactgatgccataagtcctgagtcatccttctaacattaatctacattctgggtatagaacctcatcatcttgttttggcacaatcataaatctttctggattgtagttagtggcatacatggtaactgaatgagtgaattgttgacaaatgtgcttttcgtttatactcagcttctttcttgagatataattaaaagaaaggttagtttgcttagagaagatcctttctttggaattttagctcatcttagcatcatcatatttcatgtaattcttctctttgaaattgctgcaataaagtgttagctctattttacaaacttgtcacgatgtttatgagggtggcacaacttgctattatgtttaccttgattagcaccaatgatgagtcaaaacctccgtcatggtttctataaagtgtgattcactcccattattcctgtaataaggattcagattaatgacctccacagtgttaaaaatatcctgaaggaaataactgacctaccatccatttcccccaatttaggtcctttttgtaacatggaggtctataaaaattgtattcaatacacaattactaaataccaaccatgtatatcaagtactatattggggaaatcaaaatgaatcagagagacatggtccttgctccaggatggcttacagtctattagttggccagcagataacttagttgccttggttcttatgtccagagtgtagggtaaattctaattctagaggaggaaaacatcccatcttttaaaaataagattatcaaaatgatcaaagacattggatacaaatattgtactgattctatttctacctaaaggtgttaaagattgtttgaggcacttttcctaggcttgtggaactgccaggcatccttgtcccaaatttccccttgatatatcgcacagcactgttaaattcagaagttgccttctgtatcagagtgtctatttcttgatggcatagcttggagaacccagatgatcttctagcattcaactcatacttaatgtacatcaacagtaacatagttatttgtatattttcttttctttttttctttttttttttttttgagacggagccttgctctgtcacccaggctggaatgcagtggcacgatctcggctcactgcaacctccacctcctgggttcgagccattctcctgcctcagcctccccagtagctgggattacaggcacgcatcaccacgcccagctaattttttgtatttttagtagagacggggtttcaccatgctggccagtctggtcttgagctcctgaccttgtgattcgcctaccttggcctcccaaagtgctgagattacaggtgtgagccaccgcacccaatctatttgtatattttcatttgaacatttattaattatagtaggaatttatcatgtataccttgtctccaacccaatgcacagtagcatcaggtaagttgctgtttagttataggtatcatgtgaacaggtatccagatggcagctaacttcagtatcctttgttatcctgtcttacacactggggtgttttacaagttgctttctcatttctattaatgacatttccccctgtatgtaaaatgttttctgccattagaaagcctaagtttcagatgttctgtgataaatattggtgatggataataatgtaactaatggaagccccttaaggaatttgcgaacaagtttaacaaagttaacaactcagcttcttataggaaatgttgcattgctaattctgaccacaagtggtcaggatctaggttttggccttatgggaaagttacccaagcccaggacagttctcgttattctcctcccactcacttttacaatctaaagcttttggctaatttctgattgatttaaaagaatgaaggtgaacccccaccccccaaatatggcatcctttggttgtgcttgaaggtttgtcttcttagtgctaaccctcagggaagggagtcttatttaaagcctttttttttggattgtcaaataatctttttgtattcatttgtgaattgcattttatgataattcattttgtggctcgtgttataaaggagttaaactgcaggtatcactgtcaggagaaactcatttgactagctgatgatttttttttttttttttttgagacagagtttccctctatcacccaggctggagtgcagtggcatgatctccactcactgcatcctccgcctcctaggttcaagtgattctcctgcctcagcctcccgagtagctgggactacaggtgcctgccaccacgcctggctaattttttgtatttttagtagagatggggtttcaccatgctagccaggatggtctcgatctcctgacctcatgatccgcccgccttggcctcctaaagtgctgggattacaggcatgagccaccgcgcccggcctcgtgatgattttcaataagtaaaccactgtggttcacagcctgagctccgaaggtggacaaaactccttgaatatttattactactactgttattataattctattactactgctgctagtactttatttttctcatttcccatgcttattcctttgctattatttaaggtttggtgatgaagtataggaagggcttggaaatgaagtcatttattttgtttccaacacaaaacagtttctagtgtgggtgtgtgggtggcttaatttaacataacaaactaatacgtttttccttgaactccatactatcttcatttcaaactaggtattctcagagtggggttaaaatactctccatcatcaaagcccagacattttagaacaagagcttgtctcacaaaaagcctggtgtctctgttgccaccacaacctgaaactaacgagttagaaaccacatagagccaacgacatggggtaggagctcgtaacattttctcgcaagttttgtgtagatagttaagccgggaaccgatctggttgagaaaaatgtttaaaatcatcattttcccttccttctccttcacttttatactcaaaagggtctaattttgctcctctgggaagattgaatgcgtaggctttcatgtagtttaacactctcttaatttaaagaagtctgggtttggtgcagtggctcacgcctgtcatcccagcactttggagggccgaggtgggtggagcgcttgagttcaagagttcgagaccagcctgggcaacataatgaagccccgtttctactaaaaatacaaaaaatgagccaggcatagtggcacacacctgtggtcccagctactcaggagactgagacaagaggattgctagagcctgggaggcagaggttgcagggagctgagatcacgccactgcactccagcatgggtgacagggtgagaccctgtctcaaaaaaaaaaattatattttctatcctcttcccctttttgttatgtgttttacagtcttttctccatgtctaatctaagaaacttatatattcattgtatatatatctactggttgtcagcattgaaccttgcctgtgccctagcatgttgcagaatgactgacttgactttattttgagaataagttcaaaatttattctttttttatcagttgactagggaccttatctgttgttgcatttattatctctaaaataccatcttctttttctttttattttttttgagatagagtctcactctgttgcccaggctggagtgcagtggtgcaatcttggctctctgctacctccacctcccaggttcaagcaattctcctgcctcagcctcccgagtagctgggattacagtcacgcgccaccacacccagctaattttgtatatttttggtagagacggggtttcaccatgctagccagactggtctcaaactcctgacctcaagtgatccactggccttggcctcccaaagtgctgggattacaggcctgagccacctcacccagcctaccatcttatttttagatggagacttctggacattggtataaaatctggatggttccagtcctgaccttttcttcatgtttaatctcaccttcctaacacttccaccacgttgaaaaagcgtagctccatatgatcttactgcccttcgttcagtcaagcgagacactgacattgtgtagattctgggtctcacatttgctttgtttttatctggagctttactggaaactaaatgctattgcgtactagctgcagaagcaggaggggaagttggcaagaattcgctgctttctgtttggtctgtctgaggcagctgaccttttggaaggaaatcgctgctcttcgcttcttccggtaacagtgccgcctgtgaaagaacacatacacagaagggctctgccgttatcctggctgatgccttgcagcataagctgttagttaagaggtgggagcctttcagtgcatctgttgtgtgctgtaggagcatgcactcaagttcctacaccatgctaagttgtgtgtagatctactattagaggtatagtgagagacggtctgttaccagaaaaagtaggttgctttagcaaaagtaattgcattttatttactcccactatgagtgctgtagtaaatgtggacaattattttgtgcacaattttagttcatcttaatgttaaatgtcctggtaattgctttttatacctggataaccgttgttgttttttttttttccccagcaggacaaacattttgatttgctaagacatgagctcttattaaatgtcatttcttctcagaattagaataagatttttttttttttttttttttttggacaagatcttacaatgtcacccaggctggagtgcagcgacacaatcacggctcacagcagcctcaaactcctgggcttaagcagttcttctgcctgtctcctgagtagctagaactacaggcatgcgccaccacactgggctaatttgtaaattttttgtagagatggagtctcactatgtcgcctaggcttgtttcaaactcctggcctaatcagtcttcccatctcggcctcccagagtgctgggtttacaggcatgagccactgtgcctggcccagaattatcttcttctttttctcatacattttttttttttttagagaatgagtctggctctgtcatccatctggcatgcagtggcgcaatcatagttcactgcagctactaactcctaggctcaagtgattctcccacctcatcctcccaagtaactaagactacaggtgtgcgccaccacacgctactactttttgttttgctttctttgtaaagacagagccttgatatgttgcccaagctggtcttgaactcctgagctcaggtgatcctcctgcctcagcctcccaaagtgctgagattacaggtgtgagccactacacctggccaagatttagcttcttaacaaacctgctactcgttggatccactttttctgcaggacttgttttacttaaacacaggtagtaggacaccccacaacttgggattatttttggaaagctgtagttgggtttcatatcacccagtaagcaaacaagggaactaaccagctgatgaagcgtttctctcttaaaagaggagatttcagttttgtattgttttaactaaaacatattcagttcagtttttattttgttatttgaaatgacatattcaagttatgtctaagtaaaaatgaaacattttaattcatggcaaattaagagaacacagctacctggaaaacggggcaaactgccatatccttctgtatttagttttggttcggtggataggtgtgcttttctaaggtattattggtctcttccctagatttgctgttgatggcagagatggttgggtgaaggtttgtgttgatgtacataaaagacatagagattagtacagagagaaacatctcagggcccccttagcaagattgccctgcagtgcttctgttcttggaaactggtctgatctgttccactttcctggggtaatgaagaatccagggggaatacaaaccctgcgttggttttaggtataggttcttggcacaaaataaattgatatcaacaaaacaggaagatttctccccggttctgttggcctttgagtaggagcgaagttaggaaccaacagctgaggtttcctgtgatctgctcttgtaatgatagctttctagacaccttgaattgttactcttgaactgtcaacggccttcacgtaagccagttgtgttcaggtatgtgattagaggtaagggatgtgtttgtttgtgtttagaaatggggtctcactttgtggctcaggcttgagcatagcggcgtgatcatagctcactgcagccttgacctcctgggagcgctcctgtctcagcctcctgagtagcttggactgcagaagtgagtcaccatgcccagctagaaagttttttattttaaagaaattctggtaccgttgtgagtgactttctgtgtatttcgttctatttacagttggtacaagtttgcttagtcacatcaaagatgaaagagggccactaatatatataaatatatgtcagaattacaaattaatctgctattaacagtcttaaatcactatttgaaaacacatttaaggcactatatatttgaaagtgaaagaattgcattttaaaaaaaatttttttataattctgaatttttactttataattctgaatgttctacttaaaattaaaatttttttataattctgaatttttactttataattctgaatgttctacttaaatcaaggctgcccaggtaagacagtgtcataacctggatattatcatgttaggaaatatttcttcctgtgttttatgtctctttaaacttggttcctgtgggatagtcagtagtaccaattccccattgattattaaatttatatcttaagttttacattttaaacacaatttaatcaaaaactttacaaaaattgtaccaaaaagccccttcacctaaatgtaacaactgtttacacttctctttgacctttctctatttgccctcttgcatacgtgttgcatacacttttcatttaacattcttttatttctactctaaaaaaatgtgtctacaggccaggtgtgatggctcacatctgtaatcccagcagtttgggaggccgaggtgggaggatcacaaggccaagagttggacaccaggctggccaacatggtgaaaccccatctctactaaaaatacaaaaattagggctgggcggggtggctcacgcctgtaattccagcactttgggaggccgaggtgggcagatcacccgaggtcaggagttcgaaaccagcctggccaacatggtgaaaacccgtctctattaaaaatacaaaaaattagccgggcatggtggtgggcacctgtaatcccagctactcgggaggctgaggcaggagaattgcttgaacctggggggcggaggttgcagtgagccaagatcgcgccattacactccagcctgggcaataagagcaaaactccgtctcaaaaaaataaaaataaaaaattagccaggcattggtggcagatgcctatggtcccagctgctcaggaggctgagacaagagaattgcatgaacgcgagaggtgggggttgcagtgagccaagatcatgccactgcactttaaccctgttgaaagagcaagactcagccaggcgcggtagctcacgcctgtaattccagcactttgggaggccaaggtgggcggatcacaaggtcatgaggtcgagaccatcttggccaacatggtgaaaccctgtctctactaaaactacaaaaattagctgggcatggtggcgcgtgcctgtagtcccagctattcgggaggctgaggcaggagaatcgcttgaacctgggaggcagaggttgcagtgagccgagatcgcgccactgcactccaacctgggtgacagagtgagactccatctcaaaaaaaaaaaaaaaaaaaaaattagccaggcattggtggcagatgcctatctatggtcccagctgctcaggaggctgagacaagagaattggttgaacacgagcggtgggggttgcagtgagccaagattgtgccactgcactttaacccggttgaaagagcaagactctgtctcaaaaaaataaataaataaaataaaaatttaaaaatgcgtctacatggtttttatatttcaacatagcttttatatttcatttaactggttgcaccatatcccattagattaatacattatagtctaatcatccccctattttggacattttggttatttctgtttgtcccgacggtatatatccctgggaattggcctgaatcaaggcacttgtcaaagaaaattttgctaggtagaaactaaacactgtaattctcaatggtaagagggaggccatgaactttaatagggaaaatattggtaacatgtgtggatttattaataaattgcctgttttgtttgtttttaactttcaaacaagaggaaagggattatatttcatttaagcagtatagaaacagggtattgtagtagctgaggagtttttttcctgaactaaaagatttgaattgtccaagagacagattctaagatgagttgatcttgaattacagtacaaatataaaccttcactagaaattctgaggctggctgggtgtggtggctcacacttgtcatcccagcactttgggaggccgaggtaagaggatcacttgagcccaggagttcatgaccagcctgggcaacatagcaagaccccatctctaaaaaaaaaaaaaaaaaaattagccgggcatggtggcacacacctgtggtcccagctactcagggggctaagggaggaggatcacctgaacccaggaggttgagactgcagtgagcagtgattacgccatagcacttcagcctgagtgacagagtgagaccctgtctcaaaaaaaaaaaaagaaaagaaaagaaagaaaaaaattctgaaggtaagataggactacatggcagcttcaaatcatttcttatttttccgtaatgcagatggtcattaattttgggctacagcaagtgcttttagtcatctggaaagtgatacagatgtagcttcttcccaaagggatcgcaaatccattatctccatggatttggacatggagataatgataacacatgtacactgtgggccaccatggcacaagagagcccaacttgcatgctggtggcctgcaagctgcagcacaacgcctaagaagtccagatttttattgaccaccagggacagtttcaaagtgagagtcaaacctctgctttcattgctttgtttttcttttttggaatgtttgcccttcattttgattttgaaaaaagtgtacatgacttaaaagtggaaagaatagaacaatgagtactcgcatatacttcacctaggttgagccagtgttcacagttgttagatttactttcccacactccccaccactgtcactcttccgtttctcctgccaaagtaagatgcagacgacatggccatttaccctcaaatacttgacagtgtatctactcccagcaagggcattcttctacgcaacctgaatgccattgtcactctcaagaaatttagcagtgataaagtaatatctaatatataatgatataatggcctttagagctgtgggtgtttttgtttgttttgagacagagtctcactcagttgcccagcctggagtgcaagtggcgcaatctcagctcaccacaacctctgcctcccgggttcaagagattcttgtgcctcagccttcagagtagctgcaactacaggcgtgtgccaccacgcccaactaatttttatattttttttttatttattttttttaagtataaacacatatattttttaaagtttatttttaacattttttttttttaattgatcattcttgggtgtttctcgcagagggggatttggcagggtcacaggacaatagtggagggaaggtcagcagataaacaagtgaacaaaggtctctggttttcctaggcagagggaccctgtggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtacaatttttgtatttttagtagagacagggtttcaccatgttggccaggctggtctcgaatgcttgaccttgagtgatcctctgggcttggcctcccaaagtgctgggattacaggcatgagccaccacacccagtcgtgtttttgtttttgaattacgctcttggttgtgtctcttcagtctcctttaacctagaacagttccacctgttttgggtggggggtgggatcattgattagagtctcacaatttggatttgtctgattgtttcttcatgatttagtttgtgtattcttttcagcaaatcatatctggaggcacataatgtcagtttatgccatgattggggatgtttgatcactcggttaaggcattgtccgccagatttatccacagaaatgcaccttttcccctttgaataataagtaatatgtgagtagtactttgagactaaatgctgttccccaacaactgtcacctaatggttttagtagctgtgatgatccttgtctgagtctactctctttatttttgagattgtgcatctttggccaagactttatatcctatatttagatgagagttttaaatatatagtaacctgctgattgaaacctgatttttatatttagtaagtagatcctttctctaccttctcctttattccctcccttacccttttcccctcctccattctctgttcttcctattgtaatatgcagtgatttggctgtgacataaagattaatggcggattgtcttcccagaatactatcatctctatgttgcctgggcacatttttccttgtttgcttctttgtgagccaaatgcttttattctttctgttctcttcccatctgtttaataatgtgattttttaaaaagagaattggcttcctgattgcatatagggtagtatttagaaaaaaaaaattaaagagcagatggctctggtattaacctgcttctagatgtgatagccttcttacttgatattagtccaattttaatatgaatgaagtcttaatcctttattgctgctattgaatatttttccgtccctcaaaatcgctatactaggctaggcatggtggctcaggcctgtaatcccaacactttgggaggccgaggtgggtggatcacttgaggtcaggagttcaagaccagcctggccaacatggtaaaaccctgcctctactaaaaatccaaaaattagccagacacagtggcacatgcctgtaattccagctactcaggaggctaaggcaggagaatctcttgaacccgggaggcagaggttgcagtgagccaagatcatgccactgcactccagcctgggtgacagagcaagactctgtctcaaaaaaaaaaaaaaattgctgtactaggtgaccaccaccatttaatatatttaataatgttggtatcaacagaaagcagtaaacataattagggaatttgctctttttttttttttttttgagatggagtttcactcttgttgccaatgctggagtgcaatggtgcgatctcagctcaccgcaacttctacctcccaggttcaagagattctcctgcctcagcatcccaagtagctgggattacaggcatgcaccaccacgcctggctaattttttgtatttttagtagagacagggtttctccatgttggtcaggctggtcttgaactcccaacctcaggtgatctgcccgcctctgcctcacaaagtatgggattacaagcatgagccaccacgcctggctggaacttgctctttatattctgtacagaatccttagtcattcactggagctgataggtttaacagttttgaaccctggctccttgccttgtacttttcagatcagaagcaatgtttaaacgtcatctctttgatctgtcacccagccctagcctttgccaaaatcagagcccctcagtattaggtttcttactttaatttttcattctttgctctctttaaattatgaaatataacaaacaggcagaaaagtacatagaaaatggcaaaccaccttaagtcctcaacatgcatgcagcctggtgcagtggtgcaagtaagtgcaggttctcaggtaggtccagcccagatagtaccccttagtagtatggaccgaccctggagcaagtgtttcacctctttctctttttaaaaatagctttactgagatataatcacgcactataaaattcaccctttgaagtatattctcagagttatacaattatcaccactatctaattccggaacattttcatcatcccctcaaaaagcccttaccttttagcaatcattccccatttctccctcccctcagcccttggcaaccaacaatctattttccgtctctatggatttgcctattccggatatttcataaaaatggaatttacagtatgttcccttgcatgcctttcactttacataatgatttcaaggtcatccacactgtagcatgcgtcagtacttcattcctttttaacatctgcataatattccattttattcattgtatttatccattcctatccatatttatctgtttatcctttggtggacatttgagttgtttccactttggggcgattatgaggtgattatgaataatgcagctgtgaacatttgtgtacctgttttttgttttgctttgtttttgagacagagtcttgctgtgcttgccctgtcatccaggctggagtgcagtggcacagatctcggctcactgcaacctccacctcccagattcaagcaattcccctgcctcagtctcccaaatagctgggattacaggcacccgccaccgtgcccggctcatttttttcttttttaatttttagtagagatggggtttcgccatgttggccaggctggtctcgagctcctgacctcaggtgatccacccgcctcagcgtcccaaagtgctgggattacaggcgtgagccactgcacctggcctgtgtacccactttctggggacacatgttttcacttctcttaggcatatacccaggagtggaactactggataatgtagtaactctatgtttacccttttgtagaattgccagatagttttccaaaactgtttcaccatgttacaattctacttaatcttgatgaccctcaatttcctcatccataacggggataataatagtgcctacgtctgagggatttaggataaagagtagattcataaaagcacttgttataagtaatatactaagtgcttagctagctcttaaatctggatgggggataataataacactgataaatgttatttatttcttatcctatttctgaagtttatttttatttattagatgaattgaaatatttgttgctaataattcataaagcagtataataaatgaaaacttcaaatttcattagttgttttttgtactttaattattaaaagtcagatatgtccttggaaggaataggtaaaggcatggctccctgctggcttagtcctctctgttcaacaacatattagaaggaatggaataggtagttttcttctcctttttttttttttttttttttgagacagagtcttgctctgtcgccagcttggagtgcagtggcatgatcttggctcactgcaacctctgcctcctgggttcaagcgattcttctgcctcagcctcctgagtagctgggactacaggagcatggcaccacgcccagctaatttttgtatttttagtagagatgggttttcaccattttggccaggatggtcttgatctcttgacctcatgatccacccacctcggcctcccagagtgctgggattacaggcatgagccaccgcacccggcctcttcttttttcttttttttttaagagtttagtatgcatagggcaaaatcaaagccttgctgttactgtaccaccctcacccttcacaattctccattctttcattcaaagatgagagaacagacttcatggtgcctttccaccaccacctcccaagagttcctgtctgcagaagtccttgtgccagtgaaattgattaagaaataggaatgccatcttttaaaagggcccagcacagcctgtaatcccagcactttgggaggccgaggtgggtggatcacaaggtcagaagttcaagaccagcctggccaagatggtaaaactccatctctactaaaaatacaaaattagccaggcgtggtggcgggcagctgtaatcccagctgcttaggaggctgaggcagataattgcttaaacccgggaggcggaggttgcagtgagcccaggtcacgccactgcactccagcctgggtgacagaacgagactctgccttaaaaaaaaaaaaaaaaaaaaaggccaggcacaatggcttgtgcctctaatcccagcactctgggggaggctgacttgggaggatcacttgaggtgaggagtttgagaccagcctgggcaacatagtaagaccttgtctctacaaaaaaaaaaaaaaaagtttttttctttaattagccaggtgtgatggcatgtgcccacagtcctagctacttgggtggctgaggtaggagtatccctcaagcccaggagtttgaggctgcagtgaaccatgatcacaccactgcactccagcctgagtgatggagtaagaccctgtctcggatggatggatggatggatggatggatggatggatggatggatggatggatggatagaaaagtttatactggaggatattggttaaggagaaggatagcaagagctatttgtggaggattgatttttggaaagtttattaaattgagttaaaattagagatgggagaaagaagccggttttgtaagtttaaggtaacagtaagaacagtagtgagtacttacagagcacctgctcttagctagatactgttttaggtatgtacataaaactaattcattcttacagcagccccctaaggggcataagtattattattcccattgtacaaataagaaaactgaggcacagagaggcttaacaggctgtctttggcagaaccgtatttaggtgagttcagcatcatctctaaaagtttaaccccagtttagagactttggccctgggatggggggtaggatggagaatcggaattacaaaatgctttaaattatacatatgaatccagcagaccaaatctgctggattcatattattcatattatgcataatattattcatattaaccccctactcccaccccacactagaattcattcactgagttggcagatacacagtgggccttctaatgtcagacactactctccactgcagtttagctagggcaagaccttggtcacagtgttctacaagtcttcagagagagagtaatgtttttctttgttatagtttatattttacttttagaaaggaaaagcatctgagaaaagatatttatgactgagacaaaattattccaaatcccactcacttatatcatttatttatgtggtggacattcatttttatggttttcagtaagcctgtaacattatgagctattagactttgaaacttttattaacaagtgcctgagggcccgactgatttatttggctctccaagcccatgggtatatccagatatataaggttgaggtaggtgctttatgccttcagaaagtacagggttctgcatccagggctgtcttaggttgttctgaaatgtctgtgaacacagagtgcaactcagccgagctcaaatagttctcatctttggcctaaaaataagattgtgaatccatttcccagtctttagagaatcccctgtgatgatttaccaaagaacaaactacttcccttgtctgagcatcacgcactgaaattggagctgcccgtaaataagcagaagatggcgggtactggggacagaggtacagtctttgtagatgcagagtagcgttcgatggctagatgaatgccagttagaaggatgaatgccggttagatgaatgctactcatatcaggcatgtggacatagcctgataatggggtgaagagttgtgacatgtatgaagaaaaatactacttaactgccaggcacgctggctcacgcctgtaatcccagcactttgggaggccgaggcgggcaggtcacctgaggtcagtagttcaagaccaacctggccaacatggtgaaaccccatctctactaaaaaaaattagccaggcgtggtggtgagtgcctgtagtcccaggtactcaggaggctgaggcaggagaatcgcttgaactcgggaggcagaggctgcagtgagccgagatcatgccactgcactccagcctaggcgacagagtgagactccgtctcaaaaaacaaacaaacaaaaaaccactacatagcttctaggtgttattcacgtaactgggagaacagttggttttttcctaaactgggtgtttagaatttataatgataatctcagtaagtcatctcatatttcacatatagataattttcagtttaacagtaaaataaaaatgactctgtactagttagtgtacttttattttacacttttgaatagcagtgagcagaatctactctccagctctatcaaagcacttatgtgtagtgaaactatattgtatttatcaaaataaggtgattgccacttggtatttaccagctattatccttcaaatgggatgctattttagaaaataattattatggcatgttcataactagaatcataaaaatattctacaaattctaagagctcagcattctactctttgatgaaaactaagaaataatctaaaatttaaggcaaaatagagtgacattttttaatacccctacatgcatagtatatcaccacagtatttctttcctaaaacagtaataggctcctaaatatgcttgaccagcagggaatgttaaatatttgtttgtgtatttattcgctccgcaagtattttttgaccactttccataggcaagccaccgtactagacactggggacacagtcgtgaataagatgtgctcctggccgagcgtggtggctcacgcctgtaatcccagcactttgggaggccgaggagggcagatcacgaggtcaggagaccaagaccatcctggccaacatggtgaaaccccatctctactaaaaatacaaaacttagctgggcgtggcggtgtgtgcctgtagtcccagctactcgggaggctgaggcaggagaattgcttgaacccgggaggcaaagcctgcagcgagctgagatatctgcactccagtctgggcgacagagcaagactccgtctcaaaaaaaaaaaaaattgtaattgattatttaaatggaaatctgttccattttcatgccttggtgtttcatactgatatattgttcaattataactttgaaaagagccaatagaatcggtcaaattgtgtgtatacatttatttatgcaacaaaaaaattatgatgcttatgtgccaggtaccgttctagacccaggagaaagcacggtgaacaaaacaaagtcattgtgttcatggtgatttcaccctggtgggaagtcagtaagcaaatatatgatcaatatcaggaattgataaatgataagaaaaataaagcagattaagaggatagagagtgaccagaatgccgttttatttgagtgggctgggaaggagtctctggggagataaaagttttcatagctttccttcttttgtctctgaagtcaattcacctaatgaatgcagatgcaagagaatttttgtatctgttggtatcactcacatattcattgagagctatggtgagggcctacttcttactctttactacttaggaatactaacacctagattcttctcttcattcttttatcactcttccatatacttaagtgcctaagcaccttcattcatccatcccttatataattttttttcttgagacaaaatctggctctcttgccaggctggagtgcagtgatgtaatctcggctcactgccacctctgccacccagattcaagcgattctcctgcctcagcctcccaagtagctggaattatagacgcatggcaccacacctggctaattgttttgtaattttagtagagacggggtttcgccatgttggccaggcttgtcccgaactcctgacctcaggtgatccacccacctcagcctcctgaagtgctgggattacaagcgtgagccaccatgcctggccatccattccttatccttcatccaaaaatcatgatttggtatctgttctggttttccaaaatcttgcgatatgatttatttgattaaaaaatacattgtgcagttaagtgacttccagtgtttgattataaagtggaattgcttctggagagagctcttttatctaagtgttttggtgaactcacaaccactgaaatttgatgtcttgggtcaaattgggtctacagtgatcccagccttaatgcctaaaagccctaaataatacacttctcaagtgttctatagcattgcactagtctaaaatagataactggcactcccctacacctcattgttggctaactgacttgtcccataaatagcccagtgttacgtgatcagacaactacaactaacagaagagatttttatttcctgacacacttgtacagtctctggtagtaaacaaaatccaagtccaagtcaccggcccctaactgtaacctagttcttagaagaattgtgcaaatcagtagccaaatcatgtgggatggaattcaagataaccctgccttataccaaactctacattatggaaaatagtgttagagcaagattcattttcagtccttagagttacctgaagtcccttcccagtctacccaaatgtttctgccctaatctggttaaactcaaagagcatctgccagatgagttaaaaattgtcaggtgagtctgaggggggcatcatggtagttttataaagcctttctttaaaaaatcaagagcatgttaaaaaaagaaactaccggctgggtgcagtggctcacacctgtaattccagcactttgggaggctgaggtgggcggatcacaaggtcaggatatcgagaccatcctggctaacacggtgaaaccccatctctgctaaaagtacaaaaaattatccgggcgtggtggcgggcgcctgtagtcccagccactcgggaggctgaggcaggagaatggcgtgaacccgggaggcggggctagcagtgagctgagatcgcgtcacggcactccagcctgggcaacagagcaagactccgtctcaaattaaaaaaaaaaaaaaagaaactacctgctattggagtataatggttcatatttccaactcttaggtggaatgtattgtttttgtgtctgaaagatttgtaaatgctataatttaacaacattgcttcataaattccttagcagtaactcaggaggtgaaccttcgggcatttttccagataaatctgtgctctttgtgtgcaaagcattgctgcttaggtaactagtgataatgcatagggttcaatcaacacttcagatattttcacttttcttttactgggctttttcaaaatggcatatgtttattatatttctgaagtcaaaataccaaatctaaaacaagtgattttttaaaaaaaatctctcagctgggcgcagtggctcacacctataaccccagccctttgggagctgagatggatcacttgaggtcaggagtttgagaccatcctggccaacatggtgaaaccccatctctactgaaaatacaaaaattagctgggtgcggtggcgggcacctgtaatctcagctacttgggaggctgaggcagtagaattgcttgaacccgggaggcagaggttgcagtgagccgagatcttgccactgccctccagtctgggcaacagagcaagactctgtctcaaaaaaaaaaaaaaaaaaactctctgctaattatttattactgttgaaatgctgcttaccatggctgacaattttgaacaaaagtaaagaatatgtctacgatgtcaaagttagcaattctttccctaattctccttttgtacttttgcttataagaccttagtacatttcatagtcagagcttcatagacccagctgtgtatctttccatggccaggctgagtgtctacattttgaaaacattttaaagttaaaattcagttcaagaatattgtctttagtctaccaaaagggctaaaaacatttactttggccaaacgtggtggctcacgcctgtaatcccagcactttaggaggctgaggtgggaggatcacttaaggtcaggagttcgagaccagcctggccaacacggtgaaaccccatctctactaaaaatacaaaaattaaccaagcatggtagtgtgcccctgtaatcccagctactcaggaggctgagacaggagaatcatttgaaccggggaggcggaggttgtagtgagccaagattgtgccactgcactccagcttgggtggcagagcgagactgtctcaaaaaaataaaaataaaaataaataataaaataaaaacatttaccttggtaactaagtgaatatttactctggtggatgtaaggggaaaataaagaaaaaacgcccaaagcactgattgtttgttcaacagattgtaaaccatggctgtgtggatacaagctcagcagctccaaggagaagcccttcatcagatgcaagcgttatatggccagcattttcccattgaggtgcggcattatttatcccagtggattgaaagccaagcatggtaggtgaacaaggatgtttgcatcatattttgtgaaacacaagaatattggagtttgtttagaaagatgtcatgatggcaactttcaaagttgtatttttaaacatttttaaatgtgatccataaaaaggtatttaaaattttttttctttttataggtgaaaggtatttaagcccatcttagattgaggggatggaataactcttgggatttttaaaacaggatttgttcccctttaatagtaaatactgtctaaaagcattagaatattactgctaagaaagagcagccaacaaatatgtttcgagtgcccatgggatgcctagcagtgtcctaagtagtagaatttatatgaaaaaaattaaagcccaacattgtgttgtaatcccaacactttgggaggccaaggcaggtgtactgcttgagcccaggagttcaaggaaggcctgagcaacatagcaaaaccctgtctctgtacaaaatacaaaaattagccaggtgtggtggtgtgcacctgtagtaccagctacttgggaggctgaggtgggaggatcacttgagcctgggaggcaaaggttgctgtaacccatgatcacaccactacactccagcctaagcaacagagtgagaccctgtctcaaaacaaacaaacaaacaaaattaaagccctcatctccagataattcagtgtttcactggacatggtggtgcacacctataatcccagctacccaggatgctgaggtgggaggattgcttgaccccagcagtttgaggccagcctaggcaacatagcaagatcctatgtcaaaaaataataataataatttagtgtttaatggggcagataggtgtgaatatgcatataatttaattataatttatttcttatagtttattaaatataaattattttacatttcttaataagtttacatctaacaaaaaactaaaaattaataatttaacagtggagacattggtgtttttaatttatatgtattttatatatacacataaagactaaaagaaaattgagtgggtgttgtggctcatgcctgtaatcccagcactttgggaggccaaggcaggcagatcactggaggccaggagttctgagacaagcctggccaacatggcaaaatcccatctctactgaaaatacaaaaaattagttgggcgtggtgacgggcgcctgtaatcccagctactctggaggctaaagcatgagaatcgcttgaagtcgggaggcagaggttgcagtgagccgagatcgcactactgcactccagcctgggcaacagagtgagactgcctttaaaaaaaaaaaacaaaactaaacgaaaatatacccaaatgttaacactaattacattctggtggtagatttgataagcattttaatttttctttattttccagattactgattacatacttgggggaggggagagttgttttaaatttcttttagaattagtacagtgcagtcgactaacagcacaggtttttaattggtatcattattacacaccaggcagcaggatgtacactgctctgctcaaggtctgggaggttgctggttggttacagtctgtcagtcgatctgacatattcatttgatacttcaagcctcaccgtcttagccatgggtcctctttgacagtccctgagagaaccagctttgatgctgctatttgcaaagggccatatacctgtctgtaatgttgccttagaataatcgcaatgcgtgttagtagcaaatttctgttcagaaactaaagatcaccaaagaaaggcaattttctaggcaattaaaaaaaaactcaacttcatgtaattaagtgagggaaaaaaattagctaaatatgagaatgtcagctgtacctcgtttagtgctttccactcccttttcattttctctcctgttttctgatgtggaggatttagaaaaacatgagtaggaagttgctgttaatttcagatttcacttagcagagttctcatttggtgttctcactgaatgaattaaaagacttgtgttgatattaaggaaaacttgaaattttttagctttggttttcttcagaatataaagattttaatgaagaattttcaattcttttttttttttgagatggagtctcgctctgtcaccaggctgcagtggcgtgatctcggctcactgcaatctccgcctcccgggttcaagcaattctcgtgcctcagcttcccgagtagctgggactgcaggtgcccgccaccacaccgagctaatttttgtatttttaatagagacggggtttcatcatgttggccaggctggtctctaactcctgaccttgtgatctgcccatttcggcctcccaaagtgctgggattaaaagcttgagccaccgggcccagccaaatctttagttctttatgtttaagccatctaagcaagtcttttttttttttaacagagaattaaggtttcaagtaaagaaccaatacctgacttctgtgagttttgctcagagactggatccttttaagagtgggctcctggccgggcacggtggctcacgcctgtaatcccagcactttgggaggctgaggtgggtggatcacttgagatcaggagtttgagaccagcctggccaacatggtaaaaccccgtctctattaaaaatacaaaaattagccaggcgtggtggtgcacgcctgtaattccagctacttgggaggctgaggcaggagaatcacttgaacccgggaggcagaggttgcagtgagctaagatcgtgctactgcatcccagcctgggtgacagagtgagacttcgtctcaaagaaaaagagtgggtttccagaccaagggcattgttgccagttgaaacagaggtgcagggctgccctcattccttccagcctttcatttaatacgtattctatttaatacatagggcacacatatttagaatctgacttgccttaactgccttctcaaggcgcagattggggtgtactatttgatggactatggtatcactgctttttttgttttgttttgttatgttttcgtagagagaatcttgctttgtcacccaggctggagtgcagtggcgcaatcttggctcactgcaacctccacctcctgggttcaagcagttctcctgcctcagcctcccaagtagctgggactacaggcacatgccgccacgcccggataatttcttttgtgttttagtagagatggggtttcaccgtgttgcccaggctgatctccaactcctgagctcaggtaatccgcctgcctcggcctcccaaaatgctaggatcacaggcgtgagccaccacgcccggccggtctcactgttttgatacacttgttggtgcctcttttttgaaattagttgctatcttcagggatttagggatggcagagccttttagctaccactatcttgtttggctccagacccagtcagcagttattgaatgttatttcagtccgacagctgtttggtttcttcagtgagtaagtaatttggtacttcccagtgtcaattgttgcctaagtagtagaaaggaaggaaggaacggaaggaaagaaggaaagaaggaaagaaaggagggagggagaccatccaacccccgtcaccagttcagtagcttgaaatcaatgcaaagtctgtagcgtggttttccttgtttactggaaaagttggcattgccttcaggtcctgggtctgcaactagtgacatgaatgtctgactcgtataaattcttgtaggcaccctctgcctgaatgtctcatttccagggcttcttagaaatagcaataacttgtttcacctgtctctacctaagaaacccacagataccaaactccttgaggctggaaaggacatgtagaagagtcttggccttgtgcctcctttacacccatgaggggtaactataaataggaaattatccaagtccttatttccttcagagtacacagaaccctttccttttccttgcatttctcggagcaaatagcataagcaccaagcacatcattgagagaaaggaagaagggcagcacattgttaaaaatttttttttttaaaagaaggaaatctactgtataatccaactatttagtaaattacaaatagattaacataggcattgagtccatttctgttgggctgtttcttaaaatttgcagtgaggattaaaaacatcactttagttgaagaaaaagtaggatgtgttgaggctgtatttatacaggctcacgtgcatgtatgtatacagattatgtaatttttttcccctagggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccaggtgggtgtgggctctggggtcacacttaattaccttcccttgggggtcttcttcctgtagagactttctttctctccttcagtccagcattgttgagttacacgtgcataaggttcttgttgtgtggttttggtctttttttttttttttactttttatttgagaataatttcatacttccagaaagttacaagaatcatacaaagattccccacatatgcccatattcacctgttgttgacttttatgttgtcatatactcctcgctgtctctcgacacacacgtttttcagtcactggagagtaagttgcataccttgtgtccctgcaccagtaagtacctctgtgcattttctatttatttatttatttatttatttatttatttatttttgagacggagtcttgctctgtcgcccaggctggagtgcagtggagcaatctcagctcactgcaacctctgcctcccgggttcaagcgattcttctgcctcagcctctcaagtagctgggattacaggctcctgccaccatgcctggcagtttttttttttttttggtatttttagtggagacggggttttgccatgttggccacagtggtcttgaactcctgacctcaggtgatccgcccacctcagcctcccaaagtgttgaaattataggcatgagccactatgcccggtccctctgtgcattgtctttttttttttttttttttgagatggagtttcactcttgttgcccaggctggagtgcagtggcgcggtctcggctcaccgcaacctccacctcccgggttcaagtgattctcctgcctcagcctcccaagtagctgggactacaggtgcatgccaccacacccgcctaatttttgtatttttagtagagatggggtttctccatgttggtcaggctggtttcgaactcccgacctcaggtgattcaccctcctcggcctcccaaagtgctgggattacaggcatgagccaccgcacccagcccctctgtgcattttctaagaatgaaccttgtcttgcatggttataatacactgatcaacttcactaaatttagcattgatataatacttttaggtactcatctggatttccattttgtcaactaattcaaacatgtcctttagggtatttttccccgctgcagtccagaatccagcccaagatcacatattgcatctagtcatcatgtctctttaatctcctttaatctggaaccattttgcaaccttactttgtctttcattacattggcattttaaaataattaatgtaggctgggtgcagtggctcacaccagtaatcccagcactttgggaggctgaggcgggtgaatcatctgaggtcaggagttcgagaccagcctggccaacatggtgaaaccccatctctactaaaaatacagaaattaactgggtgtggcagtggacaactgtaatcccagctacttgggaggctgaggcaggagaatctcttaaacctgggaggcagaggttgcagtgagccgagaccgtgccattgcactccagcctgggtgacaagagtgaaattccatctcaaaaaataataataataattcatgtaccccctgctttttaaagataaaatgttcctcatttggggtttgtctgatgtttcctcatgattacgttaacattgcacatctccgagcagacttctaaatatagttggctgtccatgtccatgggttctgcatcctgattccaccaaccgcagctcagaaatattcaggaaaagaaaaaaagtaaaaacaaatagaaataaagatatgacagaacagctatttacatagcatttcttttgtattagatagtataagcaatctataggtggtttaaagtgtatgggaggattgtatgcattctatgcaaaacgatgccattttatataaggaacttgagcatctgcagattttggtatccaagtgggtcctggaaccagcccccacagatgccaagggacaattgtaggtgacttgtccttctcgggtatcacatccagaggggggcagtgtccctcgtcccctcattggtggtagtagttttgattgcccatttgagagtggcatccagtttctcctcttgcgaggcttttaaaacttatttattccgtttttaagaatgttccccggatactttaggcaaattaagatgcaaaaagtaaaacagcactttgggaggctaaggcaggtggatcacctgaggtcaggagttcgagaccagcctggccaacatggtggaaccccatctctactaaaaagacaaaaattagccaggcgtggtggcgggcccctgtaatcccagctactcggggggctaaggcaggagaattacttgaacccaggaggcagaggttgcagtggcccgaggttgtgccactgcactccagcctgggcaacagagtgagactcagtctcaaaaaaagaaaaaagaagtaaaacaatcttaccttttcactgcaattggatttccatgatgtgccttcttgttcctgttggtattggaggaacagtgcctcctgtgattcaggaggtccctcaggaggctccccatcctgaggcatggttagggcccatagtgtggagtggcacaaagtgatgtctgctgttggattctttcagaacacgtatgaccgctgccccatggagctggtccgctgcatccgccatatattgtacaatgaacagaggttggtccgagaagccaacaatgtgagtgtcccatagggatggggagggcagtcgggaagtcttttcttacccacctccctctggacccacctttgtcaaggtgactcagggtgcactattggtgtctctttaaagagagcttcatcctaaggggcacaaaagaaataggagacttgactgagtgcagcccagcactttgggaggctgaggcaggcagattgcctgagcccaggagttcgagagcaccctgggcaacatgatgaaaccccgtctctaccaaaaatacaaaaaaattagctgggcatggtggcatatgcctgtagtcctggctgttcgaaaacctgaagtgggaagatcccttgagcccaggaggtagaggctgcagtgagccatgatcgcacccctgcactcatgggtgatggagtgagaccctgtctcaaaaaaaaaaaaatgaaatagaagatgtggtctctgatcttaactgatttataaccttgatgagattgcaaccacaagacaatgtgaacaagtgcaaagtaattcaacctcagctgaataattttttagtaaaggcatgctcatattcaggtgagaatacttaggaaagacttttccctagcccctgaatcaggtgtggaaggagtggtctgatcaggtcacttacagggctgggtccacagagaccttgtttatgcctcccccatcacttcaccctggggtctccaggatgcctgcaagaggtttggcctcttccatggtggaagcaaatgattccatcacgagaatatcttgagtgaggacacagatgatgtgtgttcacatggccctgctccccatggcctccctaatgcttaatgccgtccttgcattgggtcagtgagtggaagaggaatcactccacctcctcattagtaggaaaacccaggtgacactggaccaggttacgttctagtttctccaaaggtaattcaatggacctcgtttggaatactctggtggaggtcagatctgaaatggaagcttctcccatgctttgtgatctgagccatgatctgtccgctcacctgtttctcacttttcccactccaccctgtgtctcatgatgacgtttgcttttcctcccgactcaaaatttaccttttggggtcttaccctggttgtaggagctggcttttcctggggattaaggcctcagtcttcctcccattcgcactgccttgcactgccccccatatgttcccagggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaaggtgaggcgcggtggaggcacattgtgcaacttgaggattgggcctggggactggaaagcagctctggtggggttgggagaaagcacactttccattcggaggcagcgacctttctctgagtagcagggacttatttgcattgaagacagtgctgagaggatgagatttaggaaggggagatgacaggaccccccgcttaagtgcatatctcactcaggtccccacatccagggagcttctgagctgccagggaagacatttcttcttttgagaaggagctcacagtctaaataaatactagcaaacaatacttttgtatatagtaggcatattataagtggagctttattgaaatgataaataggaaattatataattacatgtttaaaaatttttctggctgggcacggtggctcacacctgtaatcccagcactttgggaggctgaggcaggcggatcacctgaggtcaggagttcgagaccagcctggccaacatggtgaaaccccgtctctactaaaaatacaaaattagctgggcatcccagtggcgcatgcatgtaatcccagctacttgggaggctgaggcaagagaatctcttgaacccgggaggcggaggttgcagggagccgagatctcaccattgcactccagcctggacaaaaagagcaaaattctgtctcaaaaaaaaaaaaaaaaaattctaagctgggagtggttttgcacacctgtaatcctggtgctttgggaggccagggcaggaggatcacttgaggccagtagtttcagactagcttaggcaacatagtaagaccctatctctaagggggaaaagaaacctttctaagcaggtacgtgtaagtactaaggacctgtatatgatttctaatgttctatgcagttattcacagaggtcttcctgaaacagagtacacttaacgccccttaggtagcccttatggacagagcttccctagcctggtataaatcctgcttagtagttggggcacagagagcttcagtctgtggtgaggctgtggagccccaccagcgcccccttttgaccctgtagcagtttggcagtttgagctttaatagtttcctctctgcttccatgcccagctcagtctcagagaagccttggctcaaccacccagcccctccaaacacacacacacacagcacacacagacaacacagcacacacacacaccacacacatcacacacacagcacacacacacacagcacacacaccccccacagcacacagagacacacagtgcacacacacagcacacacacaccacacacagcacacacacagacacacagcacacacacaccacaccacacacaccacaccacacacagcacacacacaccacaccacacacagcacacacacaccacacatagcacacacacacaccacacatacacaccacacacacatagacacacagcacacacacacacacacagcacatgctcctctaattccatgtatgtaggttccattttatgtctatagtgatactacttatttactctttatcttctccactggaatataaatctttgagaagggactatatcttttatctctgtaccctgaggccagcacaatgcctgaaacataacagttattgagtaaaggttgacaggatgattctagcctgtcttccttttttatctgaatccatcctagactggccctagaagaagggcagctccttcagagaatggaaacggaagatttgggatggctattcctacccaagtccttagactgtcaacagtatttctgatcccgtgcctggcttttctgtttcctgtgcatggtggcggattaggtttggattcaggttgggtttggatctatcacgcagtgtcttctcagtcccatttgtcaagttcactcagcagaaacacagactattgatctgcttttgccagggaaggctcagctgcctccagtggagtagggaaattgcttcccgtctccctggcctccttcccaaaagcttctgcaaatttccaggagagccctaagtgggtcccttgcataggaaggctgggcccaggtgttgggatcaccaccaccctccctgtggctgggcaggattcctgaggtagccgtgcagataccttggatctgtccgtccctggatgatcctcttcctgctcgatacctgcagtgagattggagccatatttctgagttctagctctgggctgttcctggctacatagagttgcttttgtctgtcccagcttgtgcatcccatgggtcagggctggggtcagagtgacgtggccctcaggggccagccaggagctcgaccaagacatgctggtgcgcgcatcttctgactcagctcaagcaaggactctgggctgttgagaaggtgatgggaagggattaatagtcccagtgtggtggagacgggctgtcgctgggagggtggggtgggcctgcggtggtggttgtaactgtggacatgtttactttcttagcctgggttattgatacacaggtgctcctgtgttccacgttccctgtgtcttacctatttcataataatttttaaaaggtaatgaggcctaacttactccctgtcccgccatcaatgagactcctcacagatggtgtggagggaagccgcctcccttcggcctccctttcctgagagaatcttggtggctctgcatccccagtggccctggacatgctctccctctgcggtctgtctgtctgtccgtgttccctggttggttggctgggttcacagtgagctcacctggacaaacatgctgggccccttccagcctctcaagaatctcatcctcccctgaggagggattgctgtgctcagggactagacagagccgccggggctgggtttccctgaagaggccttgctgcgggagggatggggccgagcagctgcttgtctctgtcacctcttctctctgtcctgttccccgttaaccaagaagcacgaacctcacacagagctcacccatgtcaggcagctttctggcatcttccatgtcctcatgtatttaatcttaatgcaccccactgaggcaggtgccgagaatctcccgttttacacgtggggaagccaaggcacaggaaaggaaagcgatttgcccaggttcacctgcagtcaagggcatgggcacacttacaccccagacagcctggacccatgctgggccgcgagaagagggctggcagccctgtgaggcaggcgggcaggaggcaggcaggcctcctccccagctgccccagcacccgtgtgcccccagaggggacggctcagagtcaggaggctggcgagcagggcccagaggcgcctcctggggcacccattcatcttggcccccctggctgtcaggaaccccgacttgcccttaatgcagtatctgagcccaggagggtctcgctccagaacgggtgagtgggcttctctgggcctcctgttggacactgggaggtgatggtcatggtttcctctcccctcctctagctcagtttggcccgctggcccagctgagcccccaggagcgtctgagccgggagacggccctccagcagaagcaggtgtctctggaggcctggttgcagcgtgaggcacagacactgcagcagtaccgcgtggtgagtggggtcctgggcctctcctgggcgtgggtgccatgaagtcagtctctggggacccgagggagggctgggaccagcatgagagcagaacctgggagggcaggaggccttttttcctgggggccttgcgaggcagagcagcttggggagagggaacggcctgggccctgccctgccatttcccagcgaggccctgcggtgttctctgggagcccagaaggggctgctctcctcccttccctcaggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtaatggtgtggggcggccagcgggcagggcaggaggggctggtggggatcccggctgcttctgcgtcctgtgctggctcctgcagcaggccccctccatcctgggacagctcttgtttctccagggagcctggttcctcaatcagactttggcccccatcctgtgcacctcccccaggaagggggctgctgtcctggagatgggacagggttcgggtgtgtggggtgatgcttgggctgtttgggcctagtcagggtcgcccctcctgtgtacgtctctaattctgggaggcagggagctctgctcttcccatgggtgggaagtgtggcgaaagcacagagccttcctgggggaacgggagctgtgtcttggggcctggcgtctgtgcggaggagccattgtcctcctgttggccttggggctctcgtgcaggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccaggtgactgctgcctgtttgccatgcccaggagcttggggcagctcctgcctgcgtggggggagccgcaggtgccttccagaccagcagatccacttcctgcctctcatccctcccaactccatctccagttgctgtggcccttgcccagtttctcctgtggacactgcaagagatgcccttgggctgcagcccatgccagcttctgtgttatctcactcccctctccatcctctccctggactctcacggcttccccaggaacagaggctgtgcccgagctcttcacctcctgagcccctcgggaggcagccccacccccaccacagagggactgagagccctttcccctgcaccagcccctcatcatgcatctgtccctgtgtcccctgcagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaagtaattgtgcagcttcctctcattccctgctacttgtctcatgtcctggcaacaggaaaaaaagaattctgcctcctgtgtcagatccctgtttgcccttctggcctcttctgggcatcagcaaaggaatataaggaagttcttgggcctggtgtggtggctcacacctgtaatccaagcactttaagaggccgaggtgggcagatcacctgaggtcaggagttcaagaccagcctggccaacatggtgaaaccctgtctctactaaaaatacaaaaaattagccgggcgtggtggcaggcacctgtaatcccagccactagagagcctgaggcaggagaatcccttgaacctgggaggcagagattgcagtgagctgagattgcagtgagctgagatcacgccactgcactccagcctgggcaacaagagcaaaactccgtcacaaaaaaaaaaaaaaaagttctcttaggaactgttttctgtgaagatagtttgatcttgtttcattttgtagagatacgtccgagaagattacatgtatgtgttatgtagctaacatttcctctaaatgacgtacatttttagcaaacttctctatttcctgctaccccaaattatattatttactccgcatgtcctgagaccctggcatgggtttggagctggtctctctctgatttgcagtgattacagtggcgagatcttgaacaactgctgcgtcatggagtaccaccaagccacaggcacccttagtgcccacttcaggaatatggtgagggtggaagaagaggaagaatgaatttttccctggtctttgaggggaacaacttatatcttacgtttcatcttatgtttcttctttgtagtccctgaaacgaattaagaggtcagaccgtcgtggggcagagtcggtgacagaagaaaaatttacaatcctgtttgaatcccagttcagtgttggtggaaatgagctggtttttcaagtcaaggtaaagccttccctcagctctgcgtgtgcgtgtgcgtgtgtgtgtgtggtgtactttatgttacaaaatattttttttttatcacatagcatcttcttctttttgactgttggtaaactgaaaatggactgacctcaccctgagaactgtttcacttaggttctcttaagacatgaacagaggccaagcacagtggctcatgcttgtaatcccagcactttggtaggttgaggcagtcaggtcacttgaggtcaagagttcaagaccagcctggctaacacagtgaaaccccatctctactaaaaagtacaaaaattagccaggcgtggtggcacgtgcctataatcccagctactcaggagaatcacttgaacctgggaggctgaggttgtaatgaaccgagattgtgccactgcactccagcctgggtgaaagagtgagaccctgtctcaaaaaaaaaaaaaaaagacatgaacaagcaaggcccagtgcagtggctcacatctgtaatcctaacactttgggaggccaaggcaggaggattgcttgagttcaggagttccagaccagcctggagctggttgtgagaccccgtctcaacaacaacaacaaattaaaaaataaaaaataaaacatgaacaaacaataatgaactgaactagctggagaggtagactacaaaatggatatgagaaacattacttgggatgaatttgagtaaaggttgtggtaagttttaaatttgttatttgtattttcttcccagaaatatctccaatagtcttttctctctcctgttctccatgtaactttgagaaactttatccttcagaaatatctaagcaacattgcttgtaaaatatttaaaatttctaagattgtgccagtatgaaaagtcatattattcctggggccatttagattctgtgtctgagaggaacattaactgaaacttggaaaataaaagtgttgttataataagaaaaaaaaaaaagagagaaggagaagaacttgaggctcgtgggcgctcagccttctcttgtgtctttttagaccctgtccctgccagtggtggtgatcgttcatggcagccaggacaacaatgcgacggccactgttctctgggacaatgcttttgcagagcctgtgagtgtattcctcgggcatgtgggtcccaaaatcaatgccggtgtcatgaatctcatttatgtattatccttttaaaaagcataggaaaaggccgggtgcagtgactcacacttgtaatcccagcactttgggaggccgaggcggttggatcacctgaggtcaggagttcgagaccagcctggccaacatagcaaaatcctgtttctattaaaaaataccgaaaaattagctgggtgtggtggcacatgcctgtagtcccagctacttgggaggctgaggcacgacaatcacttgaacccgagcggcagaggttgcagtgagccgagatcgcaccactgcactccagcctgggtgacagagtgagactccatctcaataataaaaaaaaagcataggaaaaaagacgctgttttctttagtgggaggcagaatagaaagaatgtggaaagtggaaagaacatgggcttgacatcgggccagggtttgaactgagactccaccatttcctcactccatgaccacatgggcagttcactttacctctctgagcctgagtttccagcaagtgtctgcagcacagggatactcttgctctacagcattgttaggaagattaaattagataacatagaaaatgcttgccacacagtcagtactcagtaaatattattttgaatccttgggtgaaactatgaatgggatttgggactcctaggttcactccagaggttagatctctccagaggcttactttagcatagaagttgcttcataccctcttcctttcaataaatgaagatgctgttaaatgtcttttccaaattttagtttctgtgattcattctaggtctcatgaagaatgagatactttgcctcaaggaagatataatttggtggatttatgcacccaaacgctatctgaatcccactagcatgctgctcgatgagcattttaaagatctcataggctgggtgcggtggctcatgcctataatcccagcactccaggaggccaaggcaggcagatcccttgagctccagactagcctaggcagcatagcaaaatcctgtctctacaaaaaataccaaaaaattagccaggcatggtacaccagcctctagtcccagctacttggggggggctgaggcgggaggatcgcctgagcccaggaggtccaggctgcagtgagccaagattgtgccactgtactccagcctgggtgacaaagcgacaccctgtctcaaagaaaaaaatttttttagtaggcaaaggtcatttgttacatatttccaatagagattagtccataaaagcatgataaaagggttatcatttgggacataagagcatgtccttctctaagtatatccaacaaaccttgattatgttttgttttgtggctgttagaatataggatttgactgttagttcaacagctcatttacaaaacagcatggacagcatgggttaccttccagttgtgtgtaaagaaggtgaaatggaaccttctggctcacgtggagaggcttaacgtttcccaacactcctctttagagaaaaagtattttactgcaaaggtgagatttttaagagatttaccatacttcacttacaaactctgaatcagaagctcctttttgaaactgtctgtctgcctcttgtcctgataagcctcctagataagattgccacatctcttgtttccttccctgcctgtccacagatctcactctctgtgtacctttggcatctcctgcaccatgtaattactcaagtatcttgtctaaataaataagcatttttaacattctcagctatgttaatgactacttacatcttatgctatttttttttttttaatttttttgagacagagtcttgctctgtcacccaggctggagtacagtggcattatctcggctcactgcagcttctgccttctggattcaagcgattctcctgcctcagcctcccgagaagctgggattacaggtgcatgccaccacgcccaattaattttttatatttttagtagagaccaggtctcaccatgttggccaggctggtctcgaattcttgacctcaagtgatccacccacctcggcctcccaaagtgctgggattataggcatgagccactgcacccagccgaccttatgctatgttaaaaaaaagactttcagctgggcacggtggctcacacctgtaatcccagcactttgggaggccgaggtgggtggatcatttgaggtcaggaattcgagaccagcttggccaacatggtgagactctcatctctactaaaaatacaaaaattagctgggcgtggtggtgcgtgcctatgatcccagctactcgggaggctgaggcaggagaattgcttgaacctgggaggcagaggttgtagtgacctgagatggtgccactgcactccagcctgggcaacacagtgagactctgtctcaaaaaaataaaaaataaaaaataaataataaagacttgtggccaggcacagtggtttatgcctgcaatcccagcactttgggaggccaaggcaagcggatctcttgagcccaggaatttgaggccagccttgtcaacatagcaaaaccctgtctctacaaaaaacacacaaattagccaggcatggtggtgcacgcctgtagtcccagctgtttgggaggctgaggtaggataattacttgagctaaggaggcagaagttgcaatgagccaagattgggccactgtactccagcctggatgacagagcgagaccttacctaaaaaaaaaaataattgtggaaatttattctccatatatatttgcctatgtgtcctgtgggtcaaataacataagaacattgcagcattgttagtaatagctaaagatgaggctgtaacactgatgcccatctatgggggtctggtgaaatttctttatgtgctgatgggaggtctcccagatagaggattaagtgaaaagaggaagatgcagaacatgtggattttgtgctgtcatttgtgaagaaaaggaaaaggtatatgtcattgctggcatgcatagaatatctttggtgggatacacaagaaactgtgttaggtgcctttaaagaaaagaactgggttgctgggagacagggatagggagtgacttcactgtgtagccgtctgtgctttttgaattttaaatcatgtgaaaatcacctattgaaaaaagtgtttgtaacaaaataaaatggagtactatggctgaacgggttgaaaagcagtttattaaaagttaatcttctaacctatttctcaataaagccatccaactcaaaatttccactcttccataccaagttgttttactttgagctagaattcttggcagaaggagtcgagggcaatgattccacgtgtgtacacacatgccgacacgtgtgcacacatacgcacactctctctgtttgtacctagaggaccagtctttcagatttctaaattcccaaggtgtttacaatctaagagccagaccttggttatgttttggtttgtggccgttagaacataggatttgactgttagttcagcagctcatttacaaaacagcatggatagcatgggttaccttctagttgtgtgtaaagaaggtgaaacggaaccttctgaatttcacagaaccgtgtaccccagcagagtctgaatttatcctcaggccctgcaagacaaatgtgtgtaaccactcccagccatcagcgtttttcttttgtggcttgagggaataaatcatgcaactgttttctcatcagattctggcctctctccctctcagggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggtgaggagcccagctgccagccgctgttagatcagtccttcccaaccagatgctctcaggagtctccctgccctgggcccttattcttcatgtctctaataaaatgtaccgaaagtaatagaagcttctgactagatggacaacttgagagttacccaggtcacgtgtagaaaattacatctttgcatattttaaataagttgacctttgtctacagttaatgcattttcttcctttgtaaaggaaatagagcaaagcagatgttaacatagctcatgagaagcaaagcttttgaggggatgcgaactctgggcctctctcccctttactctcttatgttccccatgtgtaatgccagatcaggctcctatgggaccctcaacccacaaagagggatgctgatgaaagaaactcctcctctagcatctgctaattcagacgtcactttgattttatttttattcattttttttttttgagacagagtttcgctcttgttgcccaggctggactgcaatggcacgatcttggctcaccgcaaccgccgcctcctggtttcaagcgattctcctgcctcagcctcccgagtagctgggattacaggcatgcggcaccacgccccgcaattttgtatttttagtggagacggggtttctccatgttggtcaggctggtctcgaactcccgacctcaggtgatctgcccgcctcggcctcccaaagtgctgggattacaggcgtgagtccactgtgcccaccctatttatttttgtttatttatttatttttgagatggtgtctcgctctgtcacaaggagtgcagtggtacattctgggctcactgcaacctccgtctcccagattcaagtgattctcctgtctcagcctcctgagtagccgggattacaggcacccgccaccatgtccagccaatttttgtatttttagtagagacggggtttcaccatgttggccaggatggtctcaaactcctgacctcaagtgatctgcctacctcagcctcccaaagtgctgggattacagacgtgagccaccatgcccggctatcaccttgatttgaatttaatttttgtttcttttcctacaccccccacccccaaggtgttttaaatgtttaatttggagcctaacaacgtgcatttctcagaagctcccaggtgacactgatgcttctggtcacagaccacacatcgaaactagcaagggacgggtcagcccagtcccaggtgaaagtgtctgtagcaggagcccactgggtgctggtaactgcagtttggtattttccccttcttccctcttttcctctccatggggccattaggtaaaactcaggtaggcggggatatttgtatgcctctgacaagggtagatgtttgtttcccatttaatttttccaattaaatatgtgtataatattccaagtgttactctggtgttcttatgttcactgttgtatctccaaccaggagaatttaccaggacggaattacactttctggcaatggtttgacggtgtgatggaagtgttaaaaaaacatctcaagcctcattggaatgatgggtgagaatcattatttcttaaggcgccgacagagtctgaaggtcttctctctggcatcgtaagtcacactctgcttctgtcctttgtccttggtgatccagggccattttggggtttgtaaacaagcaacaggcccatgacctactcattaacaagccagatgggaccttcctcctgagattcagtgactcagaaattggcggcatcaccattgcttggaagtttgattctcgtgagtgcccctcccttcttatgtccaaagttagctgctttcgttacaaaattattttaacaaataatttagtgggtacttactatttgttgaggtcagtactaattatgggaaacataaatgtatagccatgacatactcataataaggcagcctatgaaaaatactattatgggaaacacaattgctaatttggttatacatgaaagtatatggcagcatggttacacatgaacatttaaccatgacatggctacctatgatacaagagtccgtgcagaatctcagttgcttccctcttaaaatgtttgccttattgtactactctgcataaagcttatttcagtgaagaatttgatgatttggagttcttacagtagtaaaaatattcctttatcctaattaacatatggatattgccatcaaccatttctacccaagatgttagttcttttctttttttgaaacagggtctcactcttttgcccgggctggagtgcagcggcacaaacatggctcactgcagccttgacctcctggcctcaagcagtcctcctcccttagcctcccgattagctgggaccacagacgtgcaccaccacacccatctaatttttaaattttttgtatgttgcccaggctggtctcgaactcctgggctcaaacaatcccccactttggcttcccaaagtattgggattacgggcttgagccactgcaccagggcatcaggaaagttagttctctcctctgaccctcacaataagggtagcttgctggttcattttctgtgaattaaagtttttaataacttttggctgggtgcggtggctcatgcctgtaatcccagcactttgggagcctcaggcaggaggatctcttgaggccaggagttcaagcccagcttgggcaacatagtaagaccctgtctctaagtaaataaataaataaataagttaattaggtgggcatggtggtgctcatggtgtgcgcctgtagtcccagctactctggagggtgaggtgggatgatcacttgaccctgggagttcaaggttacagtgagtcatgatcacatcactgtactccagcctgggcaacagagtaagaccctgtctcttaaaagaaaaaaaaaaaaaggctgggtgcggtggctcacgcctgtaatcccagcactttgggaggccaaggcaggcggatcatgaggtcaggagatcgagaccatcctggccatcacagtgaaacccccgtctctactaaaaacacaaaaaaattagccgggtgtagttgtgggcacctgtagtcccagctacttgggaggctgaggcaggagaatggcgtgaacccgggaggcggagcttgcagtgagccgagatcgcgccactgcactccagcctgggcaacagagcaagactccatctcgaaaaaaaaaaaattcatcacttttaatagctcttatgctttctctggttgtgggcatgcttcctagcttttatatatctttgtatgggaaatcagggattgggggccagtaaaaactgtttcttctactgagggctagaatactgtttgaacttgaaacgtctgagatcattggatctcttgggaagtgatttttgtattacctgcttatctacccatggcttttatttttatttatttatttatttatttatttttgagatggggtctctgtcacccaggctggagtgcagtgtcatgatctcagctcactgcaacctccacctcccagcttcaagccattctcctacctcagcatagtacctgggactacggatgagtgccaccacacttggctgatttttgtatttttagtagagacagggttcatcatgttagccaggctggtcttgaactcctgacctcaggtgatccacctgcctaggcctccaaaagtgtgggattacaggcatgagccaacatgcctggcccctacccatggcttttaaaactatttcaggccgggcacggtggctcacgcctgtaatcccagcactttgggaggctgaggtgggtggatcatgaggtcaggagatcaagaccatcctggctgacatagggaaactccatctctactaaaaatacaaaattagccaggtgtggtggcgcgtgcctgtaatcccagctacttgggaggctgaggcaggagaatcgcttgaaccagggagttggaggttgcagtgagccaagatcgcaccactgcactccaacctggtaacagagtgagactccgtctcaaaataagtaagtaagtaagtaaataaataaaagtatttcatctataacccatggttatttttaaatggagatttctattggagccattataatggcaagcttgaatttatagtatgttggggttttaagatttcctaattcagaaatcatgtttagaatgtgattgttctgtttattgatctagaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactggtaacaatgttcgcattctgatttgattttgttgtgtgtgtgtgtgtgtgtgtgtgtgtgtgtgtgtgtgcatacctgcgtgtgttatctctcttgtgtgaaaacccacacaattaccattcagtgagagcagtttgagcattttccagggcagatgtaaaccttgggctggattcttcagtcatacagaaaacacatctaccactaaccccaaatatcaaattgaagaaaacaaattctttttaatacaagcttagatcaaacaaaattaggtaaaattttgtttttcatgacagagatggttttattgctttctgagtttagaagtattacatatttattataaaattttcagaagacacataaaggcataaaaaagaaaacaggctgggtacggtgggtcatgcctgtaatcccagaactttgggaggccaaggcaggcggatcatttgaggtcaggagttccagaccagcctggccaacatggtgaaaccctatctctacaaaaaatacaaaaattaggtgtggtggcaggcacttgtaatcgcaggtactcgggaggctgaggcatgagaatcacttgaacccaggaggtggagattgcagtgagctgagaccacgccaccacactccagcctgggcaatagggtgagactcagtctcaaaaaaaaaaaaaaaaggaaggtcgggcgtggtggctcacacctataatcccagcactttgggaggctgaggcaggcagatcacctgaggtcgggagttcaagaccagcctgaccaacgtggagaaaccccacctctactgaaaatacaaaattagcctggcatggtggcgcatgcctgtaatcccagctactcgggaaggctgaggcaggagaattgcttgaacccgagaggtggaagttgtggtgagctgaaatcgtgccattgcactccagcctgggcaacaagagtgaaactctgtctcaaaaacaaaagaaaagaaaacaaaaaaacagataccacacaacatctctcatctagagattaacctctatggatgatttagtgactattcttgcactctatatatagatatgtattatacattgcatcacccgttgcttgaacttcctgtgtggaggttatctagcagcagaacgaagaccataaacaaggaaacatattcaggccgggcgcggtggctcatgcctgtaatcccagacttttgggaggccgaggcaggcatatcacctgaggtcaggagtttgaaaccagcctggccaacatggtgaaaccccatctctactaaaaatacaaaaagtagtcaggtgtggtggtgggcgcctgtaattccagctacttgggagactgaggcaggagaatcgcttgaaccagggaggcaggagaattgcttgaaccagggaggcagaagttgcagtgagccgagactatgccactgcattccagtctggtgacagagcgagactccatctcaaaaacaaacaaaacacaaatatattaatttagtgatgggcgccctgaagacaaataaagcaaggtagagggatagagaagtggcagggaggagagtggaggtgttattttactagagtggtcaaggagggtttctctgaggacatgtttgttttttttgttgttgttttgtttgtttgtttgtttgagatggggtctcactttgttgcccaggctggagtacattgctcactgcagtctcaaactgctagactcaagggatcctcccacctcagcctcccacatagttgggactacaggcatgcaccaccaatcctggttaattattttatttttatagatatggggtcttgctgtgtttcccagactggtctcaaattcctgggctcaagcaatgttccttcctcagtcccccaaggttctgggattataggcatgagccactctacctagccaggatgtgatgtttgaaaagacctgaatgaagtgaggaagctagccatacaaagatctagagaaaaacattgtatgccaagagaacaagtacaaaaatcctgggttgagaatggccatgtctggaaagcctcaggagggccagggaggctggagcctcttgagcagggaagataagtggtaggaactgaggtcaggacactccagccttggagttcagggtgaaaggttggagtctagaccatatcatatgtaattttttgtgactttttttttttacttggaaatatatcctaggtagctgggcatggtggctcatgcctgtaatcccaacactttgggaggccaaggcaggtggatcacttgaggtcaggagtttgagaccagcctggccaacatggtgaaaccccatctctactaaaaaacatacaaaaattagccgggcatggtggcaggtacctgtaatcccacctactcaggaggctgaggcaagagaatcacttgaacccgggaggcggaggttgcagtgagccaagatcacaccactgcactccagcctgggcaacagagcgagactctgcctcaaaaaaaagaaatatatcctatgcagagttacagctcagtaaatgtaatcttccaacctcattttgatgactgcatacaatcccactgtatggtgagttacatgttggttatttaagatacttataatttgggcctgggcacagtggctcatgcctgtaattccagcacattagaaggcggaggaggaaggattgcttgagcctaggagtttgagaccagcctgggcaacatagtgagactccatctctacaaaaaagaaaaagttagctgcgcttggtggcgcatgcctgtagtcccagctactcagaaggcagaggctggaagattggttgagcccaggaatttgaggctgcaatgagctatgattgtgccattgcactgtagcctatgtgacagagtaagaccctgtctcagaaaaaaataaaatcctatttctggcagcatttctttgtttttaacttcttagccaatctataaaatactctgtacactgtaaagcacaaaaaacatgttatgaaaaggtcgctcctgacacttgaagccctagaagaagattagggtaataagcaattggtgaaccctgcagcgtttcaccctcttgggctacttaaatgacaagctccttgtcctataatcatagtgtgatcgtccttgcctagtataattaactttgtactgattcccatattcacgtacccagaaacaagacttcattctcccatgtcagataatcacattcttaccacctgcttacctggatttccatagtcagccttctgaaaaggtaactgtggttgaccagatcacgtgcaggtttatctgctcatctgccacatcccagtggggattctgtgggaagcaaaggacacatcgcattcttggcaccaacagcactcactgggactagtgacatcaaagtaccccaaatgcagaaacaccaggcgtgaaggagcgtgcaggtgctgggaaaagtagccttccctttcctgaaagactagacactcagagttagaggaacctcagacatcatcagatcagatcagcggctctccagtgcctaggcctttccattagatccctgacgtgtatgcacctcctgcttgaaaacctccggtgatggccaggcaccgtggctcacacctgtaatctcagcactttgggaggccaaggcgggtggatcacttgaggtcaggggttcgagaccagcctgaccaacatggagaaaccccatctctaccaaaaatataaaaagtagctgggcatggtggtgcgcacctgtaatcccagctactcgggaggctgaagcatgagaatcacttgaacccagaaggcagaggttgcagtgagctgagatcgcaccactgcactccagtgtgggcaacagagtaagactctgtcaaaaaagaaaaaaaagaaaacctccagtgacaaggaaatcagtccttcctaagataaatcatttcttttcctggcagttctacttagaacattcttccctgcatgactgaacatttgtcctcttatgacctgcccctcctggtcctgattttatcccctgggtcaggtagaacaaatcctgtctctctgctgcatcttggactttaagcttttcaaggtgtttttttttttttaattagtatgcaattagtgcttgacttagatttgtattgaagtacatagtttccatggtttgaagaatttattgaaacatccaagccaatttggaagatatcttgaatttcagttttagtgctgaccttctcctctaccaggtcttcctaacagattgaaatattaaatgcttggccaagtgcggtggcttatgcctgtaatcccagcaccttggggggccaaggtgggcagataacttgaggtcaggagttagaaaacagcctgggtgacatggtgaaaccccatctctactaaaaatacaaaaattagccaaagtgtggtggtgtacctgtaatccagctactcaggaggctgaggcatcggaatcatttgaacctgggaggcggaggctgcagtgagccgagattgcaccaccgtactccagcctggatgagagagtgagactgtttcaaaaaacaaaacaaaaaaatattaagtgcttgtgtcatatccttagataagttaggtggttgtgttctgtcctaagaaaagatgtgattcataaggaagatcacatttttgtttcacttgagaactttgatttactacattcttcccttggcagctaaagctgttgatggatacgtgaagccacagatcaagcaagtggtccctgagtaagtgtccaggtggctgtggctctccttctgcctctttcctcctcccccagaccctgcctcccatccttatcctggcccagctttccgctcccccggggaaactgtctcagccctggggaaggacctgggcttggtgatgctatgccagtacctgaggccccactcctgtagctggagccccagggccgagtggggcactttgtccttctacaccctgagaaagacaaagataccccttggtcccctccccaagtcagctgccctggcctccctggcagctgaagctctgttctcttccttctgcaggtttgtgaacgcatctgcagatgccgggggcggcagcgccacgtacatggaccaggccccctccccagctgtgtgtccccaggctcactataacatgtacccacagaagtaggtggcattcttgtgggggtccacaggggaggaactgggggcttggccccaggctggacccctggagggctggggtcaaaggaatccagagctcctctaggtctgagaccacacagccctggcccgggctctggcctttgggagggagagatttgaccagaagtgattggtggtttagagtcgggttgggcaaatgtcatctgttcccctctctcaatatggagatttttcttgctctaaggactgagtggagttgtgatgtgtctggacagccggtgtgagaggtaacaggggagggtatttcagtctgagttgctgtacagccagctgtttgaatggttgttcttttcccatgaagccccaggctgagggcataggctggctcagactgctcccctggtggcctgtggggcttggggtggtctctggcaggctttccccttcccttcatccctcttctttccctcccaagccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagcagaggggccacagacagaagctgtggtggtttttactttgtgcaaaaaggcagtgagtttcgtgaagcctggaagttggccatgtgtcttaagagtggctggactttgacatgtggctgtttgaataagagaaggacaaagggaggagaaagcacatgtgctccagtgagtcttcgtcactctgtctgccaagcaattgatatataaccgtgattgtctctgcttttcttctgaaatgtagataactgctttttgacaaagagagccttccctctcccccacccctgtgttcttgggtaggaatgggaaaaggggcaacctacaaagattgttggggcaagggaagtcacaagctttcggatgggcggtggcttttcacaaaacatttagctcatcttattctctctttgtcctctctcccctcctgcccgcccgcaccctggaattgccactcagttcctctgggtgtgcacatatgtttggagaaatagaggagagaaaagagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttacaaaaataacttctgaatttatcagtgttttgccgttaaaaatattcctctatagtaaattatttattggaagatgacttttttaaagctgccgtttgccttggcttggtttcatacactgatttatttttctatgccaggcagtagagtctctctgcctctgaggagcaggctacccgcatcccactcagcccctccctacccctcaagatttgatgaaaattccaaccatgaggatgggtgcatcggggaagggtgagaaggagagcctgcctgctcagggatccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccgtcctggctcactttgcagttggcactgggttggggaggaagagagctgatgagtgtggcttccctgagctggggtttccctgcttgtccagttgtgagctgtcctcggtgttaccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgtgtgagatgtgcaggttttttctagggggtagggggagactaaaatcgaatataacttaaaatgaaagtatactttttataatttttctttttaaaacttggtgaaattatttcagatacatattttagtgtcaaggcagattagttatttagccaccaaaaaaaagtattgtgtacaatttggggcctcaaatttgactctgcctcaaaaaaaagaaatatatcctatgcagagttacagtcacaaagttgtgtattttatgttacaataaagccttcctctgaaggg

SEQ ID NO: 37730 - DNA, 77229 bp, Homo sapiens; identical to SEQ ID NO: 37729

SEQ ID NO: 37731 - DNA, 164286 bp, Homo sapiens
tcccctttatttccactccccacccgcgtggctttgctctccctctcccccctcagctcgtctgtatttggagctccggaagctgccggcgactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcaggtaatcctgcagcggtcggggcccggcgaggcggggaggggtcggggtgcaggtgcggggggcgcctggcggcgggcgctggcaagttgagcccgatgggtggggtagggaagcggccgggacgctgcggctgtggcagcagcgcgaggggaataaaggcggcgcgggcgcgggggccggggcgcggcgacccgggcgcggggcgcgggcgcgggcggactcccatctgggtcagcggagcggcgcgccctgcccccgcctccccagctccggcgtcctggccgctcggaaggcggggtgcgggcaggagctgcccggggttggcgggcggccgcggcctccccaccccagcgccgccgcccgcccggccgctctaactttggggggtctcgtccaccgggctgtgagtcttccaggggggtgggggtgggagtcattgcgccggctctgaccagagccacctcgatcagaaagtgctggaaagaaacagacctggcttcccctctgcagaacctgacttgaggcgatgagtcacttctaaaaaatgcagaggcaactgagactgggggaacggctcggaaaaacggcacccgccgctggctctctgactgctttgggtagaggggtgttcgtggaagtagccgccgtatcatcacttttagggccaaaaatcaacctgcagatggccttttctttattctcatcagagtggtgttcgctgcaagttgtagcaatatttgaatggatgcattcttaaaaatgagtatgtatgggtgactgcatttaggaagttgaaccgggactaggtccaaacagccagagtggagatgaacacttggtaaaaacatctaggacctttggttttatagttatggaaatgcagaagcttctgggacttgagcactgtagtttactgagtactcctatttccttactgcttctgtagatttcattgaagctatgttccttagaattcttggtaaactatctaagcccacttagtgtaaaattacaacggtagagtgaactttagagaattggatttatagttactagagtctaattagactgcaagcctcttgaaagcaaggatgggttgtttggtagttcctacggcaccaaacagtatttggctcacagcatgtaatggatagacaataaaagtgtgtgaaatagttaattcagtaccttaagtgtagatggagcatgacttcttgaatatactgcatattttgcaaggaaaggcgacttctccatgaatcccgaaatttaaaaaattcttaataacattacaatcaaagtgtcatataaatacttcttaaggataaagagaaaaagaagttgactatgagaaatcaggaaggtgattatcaaggtggtctttgctagtaggaagtaagtttttgttccccatcgttaatgtgagaagtaatttaatttgttgatacagggtagggtttggtaaacctttgagttaagagctagatagtaaacatgtaggttttgcaggccatatggtctccttagcaactactcagttccacagttatagtttgaaagcagctaaagacaatacctaaaggaatggtatgtttgtgttttactttatttacagacattgaaccttgaacttttcaccagtaacaaaatattcttctgtttttttccaggcattaaaaaatgtaaaaactattcttagcttgagggaggagcagaaaacacaaaagtaagagagaagggaatggatttgtccttctagtagtagtttgctactcccactgattgattctgtgctagaatctggagaggagcctattgaaaggattaatgggccacattctcttgagtgcctgttataccttggcagttaagttaaataccctccagaaaagcattaacttattttgagcattatggagttttgttttgttttgaatatttcctaacatctttattcatgaggttttgttttgtttttaatttattatgtaacattttatatgtaaaaataatacgctaagtctaggtgagttatgaacattatgttcaactgaacacctgtgaacccatcactaggtttataaactagggcttaagaactagatagttgtgaaaagatagctcatagaatgggaggaaatatttaggaatcatgtatctgataagggtcttgtatccacaacatataaagagttcttacaactcaataataaaaagaaaaataatccaatttaaaaatgggcaaaggatctgaatagctatctccaaagaagatatacaaatggccaataaacccatgaaaagatactcaacatcattattcatcagagaaatgcaaatcaaaaccacgatgggataccactttatactcactagcatggctataatcaaaaagtcagataataacaaatactggtgaggatgtggaggaattggaacctttgtacaccaccgatgggaatataagatggtgccctcactttggaaaagtttggcagttcttcaaattaaacataaagttaccatatgacctagcaattccattgtaaatatatgtccaagagaaattaaaacatatgctcacaaaaaaacctgtacacagatgttgacagcaacaccatttataataaccaagaggtggaaacaaaccaaatgactatcagttgatgagtggataaataaaaggtggtatatccatacagcgagatattatttggccataaaaaagagtggagtactgatacatgctacaacatcgatgaatcttgaaaacattatgctaagtgaaagaagccagtcaaaatatcacgtactgtatgatctattcatttgaaaatgtccagaccaaggaaatgtatacagctagaaagtagattttttgttgcttagggctgaaggggctggaggtgggttgagtagggaagtgatagataaaggtcacagggtttctttttgaggtgaaacatgaaaatatcctctaatcgactatagtgatagtcgcacgtatctgtgaatatactaaaaaccattgagttgtacacctttaatgggtgaattgtgtggtatgtgaattacatctcaataaaattgttaaagaaaataaacagaaaactaggggaaaaagtactagattgttagtatccagttgcatctttgtgtttttcctctgtgcctgctctcatgtccctcccaaccctgaattttgtgttaatcattccctggtttattgtaaaacagttttatcacatgtgtatgtattccaaaacaatagtgtttaggtttgtttttttggtttatgaaaaaaggtatttataatctcgcattctcttttgagatggagtctctctctgtcgcccaggctggaatggagtggcacagtctcagctcactacaacctccgcctctcaggttcaagagatgctcccgcctcagcctcctgagtagctgggattacagacgcgggccaccatgcctggctaatttttgcatttttagtagagaaggggtttcaccatgttgcccaggctggtctcaaactcctgacctcaggtaatctgccgttctcggcctcccaaagtactgggattacaggcctgagccaccgcacccagcctaatcttgcattcttaaaattcaacattaggtcattaagaattacccacattgggctgggcgtggtggctcacgcctgtaatcccaacattttgggaggccgaggcgggcgcatcacgaggtcaggagatcgagaccatcctggctaacgtggtgaaaccccatctctactaaaaaatacaaaaaattagccgggcgtggtggcgggcacctatagtgccagctactcgggaggccgaggcaggagaatggcgtgaacccgggaggcggggcttgcagtgagccgagatcgcgccactgcactccagcctgggcgacagagcgagactccatatcaaaaaaaaaaaaaaaaaaaaaaagaattacccacgttgttgcatgtaggtatgtaatatttcttggcaaatattccatgatttatttcaccattcttgttgacaggcatttgggttggttcccatgttttgctattacaaagaatgctgctttgaagactttttttccatgtgtcttggcacacatgtgcaagagttcttcactgtgaatgtgccatgtattttaatgggaaaaaaaaaaaaagaaaacctgattctcctttgacttacacattgatggcatgtaaccacttactcatttccccaaaccaagataaaatgattagatctgacattctgacttctcatcctatttacattctagttgtaaaagtatttcccaacgttttaagaagtgtggaaaatctaaaatttcacaactcaatttcacagcagagccttttaacccggtcactcacggacatcttcatctccttatatcacctgggtttaggatgagagggaggacaactttattattacatcaaaggaacattactttaatcaaagtacatgaatagttactaaacctcattaaaagttgcctcgtattgtatatcctgcggagtggtctagtatttccgatgtgatttagttaggtaagtctgataacaatgagccttgggcagatctagatctgtcgttgagttaggcagtgagttttgccattcattcaggatatttctccttgaacttagaaggaggaaagcaccttaaagtcagaacaaaccattatgaggaattttaaaattacttttactattttaagatatatataaaatttacgattttaaacttttttttttttttgagacagagtcttgctctgtcgcccaggctggagtgcagtggcacgatctcctctcactgcaagctctgcctcctgggttcaggccattctcctgcctcagcctcccaagtagctgggactacaggtgcccaccaccacgcccggctaattttttgtatttttagtagagacgggatttcaccgtgttagccaggatggtctcaatctcctgacctcatgatctgcccacctcagcctcccaaagtgctggaattacatgcgtgagccaccgtgcccggtccgattttaaacatttttaagcatactattcagtggcattaagctcattctcactgttgtgcaaccattattattgtccatctccagaactttttcatcatctgaaactgaaactttgtacccactaaatataactctggattctcctcttccacaatccatggcaaccaccattctactttctgtccctgaatgtgcctattctaagtaccttatacaatatttgtccttttgctacatgagctttgtttgtttgtttttgagacagtctcgctttgtcacccaggctggagtgcagtggcaccatctcggctcgctgcaacctccgcctcccaggttcaagtgattctcgtgcctcagccttcccagtgctgggattacaggcgcttgccaccccacccagctaatttttatacttttagtagagacagggttttgtcatgttggccaggctggtcttgaactcctgacctcaggtaatgcacctgcctaggtctcccaaagtgctgggattatagggatgagccaccacgcccggcctacatgagcttttatatccaggggaattccatcttgttttgtttctgtctttagtagacacttttcccactttaggaaaataatggcttctttcactgagaaattatgtgaagggattgtttccctttcagtatacagccctatacagaaagggacataggacattgtctgaaaccagaagaagaaattatgactattatgaatggggtcttcatctgccctgtctagttaattaggcatctaataatcctggcttctcattgaacacttagccacctgcagaaggtgcactagcccctaattcttaaaatttcacatttacctgatacatggaggaagtaaataacctttgatgttcctgttagccctcagcttttcagaatgtaaaggccattctgcaatatagaagtctgatctaaaatctcttttgttttgatgggaaggggtattctgagaggctgaaggagggttccaagaggctgaacatagaagggaggtaacctaaatggcagttctgaagaggaagatggttcctggggaagttagatgctggagacaccaaagacagacctgtagtggccgggcatggtggctcacgcctctaatcccagcactttgggaggccaaggcgggtgatcacaaggtcaggagattgagaccatgctggctaacacggtgaaaccccatctctattaaaaatacaaaaaaaaaaaattagctgggcatggtggcacgtgcctgtagtcccagctacttgggaggctgaggcaggagaatcgcttgaacccgggaggcggaggttgcagtgagccaagatcatgccactgcattccagtgtgggcaacagaatgagactccatctcaaaacacacacacacatacacacacaaaacagacctgtagtacatagacagctttgttgtcctattattatgcacagtttaatgagaaaataacctctgttactttgcatcattccatttggagatccagagaaattctgggatccattggttgacttactccccctatgttgagtgactgctatatccctagcatctggggatgcaaaaatgaagatcagtgaaggaagatagaatgaatagaagatgacacttaagctgtaaacataagtcacaaaggatctattcggatgattgtcatcatttcctactttgtttctatttagttttagtcagagaagaatcactggattcttggccgggcacagtggctcatgcctctaatcccagcactttgggaggctgaggcgggcagatcacaaggtcaggagatcaagaccatcctagctaacatggtgaaaccccgtctgtactaaaaatacaaaaaaaattagccaggcgtggtggcaggtgcctgtagtcccagctactcgggaggctgaggcaggagaatggcgtgaacccaggaggcagagcttgcagtgagccgagatcgcgccattgcattccagcctgggcaacagagtgagactccgtctcaaaaaaaaaaaaaaaagaatcactggattcttatgaaaatgaattattttatcctaaggcaacaagaacagttaaattggaccacactaagaaaatgagatgatcagatttttcagaaccaggtaaaataggcttccaagtgttgcatgtatagttcagtctggttatagtgtgatatactggagttggaggcatccatttgtaatcttagcttcgaagctgctgtggtctgaatgtttatgtcctcccaaaattcttatgttgaaatcctcactgccattgtgatggtattaggagtggaaggccttgggaggtgaataggtcatggggtagagcactcatgaatggattagtgcccttatgaaagagaaccaagggagaccctttgctcctttcgccaagtaaggacacagcaagaaagtgccatctatgagccagaaagtgggccttgatctgcattgatcttggacttcccaacctccagaactgtgagaaataaatttctattgtttataagctatccagtctgtggtgttttgttacagcagcctgaaagaaactaacatagtaacctgtgtattacccaaactgtgcaagtgatagatcaatatgatataagtgtgatctttccatcgaatgtatactgtcctggtattgctactcacccctctccagtggcaggaaaaccaaatgtctggcctaatgagttaggttgattgatggacagtttcaactgattggttacttgacatgaggtaggctaaatgcagatagtctatctctcggcagtcatgctagaagctgtggctagagattttcagggtacaatgcagatccacaattatttaggcaattttttttaagtttacatttttatttctcctccatttgaatttcttctctgtttcttagtactcctctctgtgttcaaagttctcactgtagacaacccttcactccccctccttccatcttgcttcagaacagcctctctcttccttaggaattcactcccctcaatgcctctttctgaatggaaggtggacaattatcaattgaaagtcttcagtaattgaaaattttaaaaagagacttgttaatagtgtgagtctctatataatatataattggggatggaactcatttttatgcttcttattttggttcagcaatctttaaactgtgtgcatttactatatgcaaaggtttgccaaaggtacatgtgcacaggtgctttgagaatataaaggtccaaatcctcctcttccatatgtgcttttttcctaagactaatcttgatgagaatggacctgtaatggagacgcaagttctctttcccatctgcttttccataatcaccttcctcttgctttccttgtgaaaagcgtatgtctaccccattttcctaatccattttactaaatggtttatgtctaacccattttagtaaattgctttgcccaaggatgtaaaactctaggggatggggaggacaaaaaagggggaaatttctgagtataaatttcgtttcaggggtgagaaagcaaatgactgtaatgcctgagcagagacccttttgcaaatcatgtgttttctaaatctatcttaaaaaacaaaaagtgaaggccagtctaatcaaatagtaaaccgatattaaaggataaactctaaaaaagaatgaaattttgactctcatacaaataaaaaatagacattttcaaacttatttaaaaaatgagagagccagaaaggttttgcagtcagttcaaaggagatcatttataagaatgctggaatgaatttgcttaatacatgtaaaactggcttcttccacaatgggagagggaaggtgattggacttctacagcataaagtttatttgcatgtctgtatgacttgctttactatcagttttctgcaacttaacttatatctctacagggttgtaaaatagcttagtcaaacacaatgaatgactgagatgacccagatgaataagtattagggtactcatgaaatttgtcttctcaatttttccttacattgacaattaaaataagttttgatatttcactaccatgtgatgttggagttcaaaaaattaagtgacatttctataacaaaattcctcccatttccatctcctcattatgtttcccagcattacattgataaaaacaaaaaataagaattaaattgatgctcaacattgacccattttatttatttttattttattattattattttttattgagatggagtcttgctctgtcacccaggctggagtgcagtggcacgatcttggctcactgcaacctctgcctcctgggtttaagtgattctcatgcatcagcctcctggctagctgggactacaggcgcgagccaccatgcccggctaattttttgtacttttagtagagatggggttttaccatgttggccaggctggtctcaaactcctgacctcaggtgatccgcctgccttggcctcccaaagtgcggggattactggcgtgagccacagcgcccagccacctggactcattttaataagtatacacatccacatatccataaagttatggaaagtaaaagtgttcaaaagagagagatttccaataaagttgctttttatttacttttagtaattatttgtcaaaatttgtaatatttgtgttgttttctaagtcacatcctactaatagtaacaatggtatcagaatagctttttttaaaaaatgttttgaccattgaattagaatttaaatttaaataatgtttttgatgcagaaaagtatggtaggctaatgagtaaaataggctaaagcataaaatatgtaaaattaagataaacttctgtagggcaagaagcgtggaaatataagttcaaggagaaaatggaattatgcaaaatttgtgactattaaagaccagcctgttccagtattcttttaaaatgagtaagaatgaatttcactggacatataagatagttttatatggccatatttacacagtgttggaagttacattctttgcaactattcacattttggtgacagttgctatatgccaatctaaaaatgtgcaagaggcttttacaaaattcttttagggtatatacaagtaaaaaaattgaagactcctgttgtagctcaccctgctgctattttctgaccaaaaaccaagggtcagtaattgtggcaaaacctttctagctcagtattggtaaatgaaccaattcattaattgacatagttctagtgactccttgttttactggatgtccctaaggaagccattcaagaattaaaggtcttggccaggcatggtggctcacgcctgtaatccccaccactttgagaggccgaggtgggtggatcacgaggtcaggcgttcgagaccagcctggccaacatagtaaaactctatctctattaaaaatacaaaaaatggctgggtgcggtggctcatgcctgtaatcccagcactttgggaggccaaggcgggcagatcacgaggtcaggagatggagaccatcctggctaacacggtgaaaccccgtctctactgaaaatacaaaaaaatagctgggcgtggtggcgagtgcctgtagtcccagctactcgggaggctgaggcaggagaatggtgtgaacccaggaggccgagcttgcagtgagcccagatggcgccactgcactccagcctgggtgacagagcaagactccatctcaaaaaaaaaaaaaaaatttagctggacttggtggcacgcacctgtaatcccagttacttgggaggctgaggcaggagaattgcttgaacctgggaggtggaggttgcagtgagccaagatcgcgccactgcactccagcctgggtgacagtgtgagactccatctcaaaaaaaaaaaaaaaaaaattaaaagtctaagtacttatgacacgtctcaaaagaggataacagccattacattttatttatttctttgtaggcagttatatctttactttattcatcgttattgttctcctctttggaggcactcaccagaaggtattgtatgagtgtatatgtataacagacagacagcactacagtattccccacttatccatgggggatacgttctaagaccccctgttgatgcctgaaagcatggatagtaccaaatcctacatataccacgttttttcctatacatagctaccgtgataaagtttaatatataaggccgggtgtagtggggcacgcctataaccccagcactttgggaggccgaggcgggtggatcacctgaggtcaggattcgagatcagcctggccaacatggtgaaaccccaactctactaaaaatacaaaaattagccaggtgtggtatagacgcttgttaatcccagccactcgggaggctgaggcaggagaatcgtgtgaacccaggaggcaaaggttgcagtgagctgagattgcaccactgcattccagcctgggcgacagagtgagaccccatctcaaaatttaaaaaagtttaatgtataaattaggcatagtaagagattaacaataataactaataataaactagaacttcattgcaatataccataataaaggttatgtgaatgtggagtctctctctctctctctctctctctctctctcaaaatatcttattgtactgtgctcacctatatttggaccattgttgaccatgggtaactgaaactacagaaagtgaaactgggcaaagggcaactactctatttggatctgtaaatgtgtagctttcaccaagtttggaagtttttggtcatgatttcttcttttgttttgtttatttattatttttatttttatttaaagcacaaaagcataatgttttgtttttttgaaacagggtctcactctgtcactcaggctggaaggcagtgacacaatcttggctcgctacagcctcgacctcctgggctcaagtgatcctcctgtctcagcttcccaagtagctgggactataggctcaggccaccacactcagctaatttttaagttttttgtagaggcggggtctacctatgttgcccaggctggtcgtgaactcctgggctcaagcgatctccctaccccagcctctgaaagtgctgggattacaggtgtgagcgaccgcgcccagcctgagcagtggtttatatctacttcagtttgcaaagcctttgggaccgtcccacacatacacagttcagggacttgtgctggttcatacacagagccagggcatccccttctttagctctcgtctctctgggattctcgccacacacctctaccccaagatccctttttcctgttcttctggaaagactagatttcttttaaagtttaaggtgcttatgctgctgtagagttctccaagacttggggccatcctcaggacagagtagcgagaggaataaaataccaggaattctccccatactctgtggaccacaaggtcccctgttcccctacttttctgtcagtaagcccagatttctttttttttttttttgaggcagtctcactctgtcgcccaggctggagtgcaagggtgcaatctcggctcactgcaacctccgcctcctggattcaagcaattctcctgcctcagcctcctgcatagctgggattacaggcccatgccaccacgcctggctaatttttgtatttttagtagagacaaggtttcaccatattggtcaggttggtctggaactcctgacttcatgatgtgcctgcctcggcctcccaaagtgctgggattacaggtgtgagcaacctcgccctgcccaggtttctttagaaaaaaagtttcaggtgcctgtgctgctgcttactgttctgccacacagttctgtgactacggccacgcttgggagagaaaaatgcaaacaaaacccaaaacctgggcttgcctcacactcttctattagccagggccccctttccagttcctctggccaaaaagaggagcttctgttggagtgtttgctacctgcacccccacccaattctgatttaaggtcgaccctgaagaaaaaaatgagaaaaaaaccagcattttactcccaaatgggttcccttttcaattttgattcttctcaattcatgtactattgttttgtcttttggaatcagatagttgccttttgtattttgaacacagtttggagagaggctgaagtgggcttcttccttcttgagtgtccctggtagccccttcctctttttgaagctttctcttgtttcctttttctcctctgtttcttccacaccattcttttctttccactttacccactttctctgtttccccttttactttgggctcccaggttcaaagagcaaaaaaaggaagaacctgtagttttttagtggtcaacagcatgagttgaaacccctgattgattgtgttgaagtaataaattgaagctgggtgtggtggctcatgtctgtaatcccagcacttcgggagaccgagtcaggaggaccgcttgagcccaggagctcaaggttgcagtgagctatgattgtgccactgcactccagcctgggcagctgagtgagaacctgtcttgaaaaaaaaaaaaaatggccaggcgcattgcctcacgcctgtaatcccagcacttttggaggccaaggcaggtggatcacttgaggtcaggagttcaagaccaacctggccaacatggtgaaaccccgtctttaccaaaaaatataaaaatttagctgagtgtggtgatgcacgcctgtaatcccagcaactcaggaggctgaggcaggagaatcccttgaacctgggaggtggaggttgcagtcagctgagatcctgccactgcactccagcctaggtgacagagcaagactcggtctcaaaaaaaaaaaaaaaaaaaaaaaatcaaagtcaagtgtgaaagtagacccaggaagctagagacacatgaagaagcaaaagggggctggaggaatgcttgggccaaactgatcacctggctattccatcacacttggatttgttggtaatttctattcataaaactggcccaacacttaagaactgatctttagggcttttcttttttcattttcttttaagagagttgctgaatcttttatttaattgcatataattacaatgaatgctggtaaattttgagattacaaggaatttcaacaaaccttattactcgttatctaagtccattagtattgctataaaggatacctgagactcatttacaaagattagaggtttgtttggctgacagttctgcaggctgtacaagaaacatctgtttctggtaaaggcctcaggctgcttccatttgtggcaagagttgaagggaagctggaatgtgcagattacacggcgagagaagaagcaggaggagaggagaggtgccaggctcattttttccttgccactctacagctcacaaatggatgccagcctctttttaacaaccagctctcctgggaacgaatagagcaagaattcactcttgtgagaatggcaccaagccattcatgagggatctgccctcatgacccaaacaccttccacctcccacctcccattaggctctacctggggatcagatttcaacataagttttgcagggggtcaaacaaaccagaccatagcactcatcattccagagagacaaggcattcttcacattgaaatgacagaatttgataaagtaaaacattcctagtcatgagaagtaactgactatatgaaatgatagcctcctttttttttttttttttttgagacggagtctcactctgtcgccacactggagtgcagtggcatgatctctactcactgcaagctctgcctcctgggttcatgccattctcctgcctcagcctcccgagtagctcgagtagcttggactgcaggcgcccgccaccatgcccagctaattttttgtatttttaatagagacggggtttcaccatgttagccaggatggtcttgatctcctgaccttgtgatccgccagcctcggcctccccaagtgctgggattacaggcgtgagcaaccacgctcagccctatgatgatagcctcttatgctttcagtccatggtgcttttgatatccccctgcttgcagtctgcggtgattttgcagtgtgcttgttctgtggcctggtttgagaagtgtggtgtgtgaggctgggcgtggtggctcacgcctgtaatcccagcactttaggaggctgaggcaggcgagtcacctgaggtcaggcattcgagaccagcctggccaacatggtgaaaccccatctctactaaaaatacaaaaattcaccaggtgtggtggcaggcacctataatcccagctactcgggaggctggggcagaagaatcacctgcgcccaggaagcggatgttgcggtgagccgagatcacgccactgcactccagcctgggtgacagagtgagactctgtctcaaaaaaaaaggaagtgtggtgtgtgagatgttaccatcattgtgtctggaagatagaggaggtagtaacacttaccatgataattcagggattgagcactcactgggtacagagcacagtgatgagtgctgtggaccattcagagggaaattataataatgacatgtaggcatcactttgtagttgcaaagttcacttcatggtctcctttcaccttcccaagaatcctgaggcatgtattattattgggtagataatacttatgacatatttccagaaggcccctgagctttaggtccctactcgtaactgccaactgtaggcacttcaaatgcagatcctctaactctgaactcctctgacctgggcacctccgctccctaactctattttgattggcaccaccttccctgaagcaaaacatctaagatatcctagcttctccctttccctccaaacctccaaccatttaatcttttctcaaatcttgcctaatctaaacttcccttagatcttcttcaacccgctgtcactttattcccaactcccctcccggccctgactaccaccccttctaactactcatcagtcccttgtttctcatgctctgttagatagctcctggcgcataatgaatgttccatcaatatttactcgtcattcatgcttccatgcgtttgcatatggaggcataggcggtgggatgcctttacttatttttcttcttctgaataccatactctcatctttgagacttaatttggttcttatcataactttggtagcctctctacttcccagggctcagttgcatgtctacctttcttgagctgcctgtcccacatgctcccaccacatccctgcacacctctgttacagtaattctcaaagtgtgggcccttgtactctgaagagtgcttcttaaaaaggcagattcctgggaatacccagaactactgcatcagtattgctgagagtggggcccaggagcctgcatttaagaaggctcacctctcccccagtgattcttacgcagatgaaaaagagtggtgagaatcaatgttttattctctcacctgccttggcctgtacaactagttccaggagtggggagtatggccacttggagcagtatctgggtaggtttcaccaccacttctgaccactgggagatgagaacagcaaagttactcagatttaatttttttttttttttgagacggagtccagagctggagtgcagtggcatgatctcggctcactgcaaggtctgccttccaggttcacgccattttcctgcctcaacctcccgagtagctgggactacaggtgaccgccaccacgcctggtcaacttttttgtatttttttgtagagatggggtttcactgtgttagccaggatggtcttgatctcctgacctcgtgatctgcccgcttcggcctcccaaagtgctgggactacaggcgtgagccaccatgcctggccagatttaatggtttttaactgtatctttacaaagaggcacaatcctttttcatttgtttgtttttaaaccttttttgagttataattttatatgccataaaattgacccaatttaaatgtcctaacctactttctgtctctatagattagcctttcctggatatttcttataaatggaatcatacaatacacagtcttcttgtctgactttcatttagtgtaatgcttttgaagttcacttgttttgttttgtagcatgtatcagtatttcactcttttttatggctgaataatactccattataatacatatgccatattttgcttaggcattcacaggttaatggacatttggattgtttccattttttggctattatgaacagtgctgctatgacatttgtgcacaagtctgtgtgtgaacatatatttttatttctcttgagtaaaatagagtggaatgactggttcatatggcaaatatgtgcttaacttctgaagaaacttccaaacagtttaaaccaactgtcccattttccatattcaccagcaatgtctgagggttccaattccttcatattctcaccagcactttttattatctgtcttttaggttataaccatactagtgtgtgtgaagtggtatctgattggagtcttgatttgcattttcctaatgattactgatgttgagccctttcacatgtgctcttggccatttgcctgtcttctctgggaagatgtctatttagatattttgctgactattaaactggcatatttgccttcttattgagtgtaaaagtttttttatatattctggatacaaggggagtaacacatttacttgatggagggagaatggttcacgaccctcctgcccagtctgtagtggcctggccagcaggttctccatggctcttcttttctcagtgccagcgtgtggcccttaggggactcctagaagcagttctttgaactctacctcctccatggtgtaaacaagcgcaaaggggcaacgtggggacacagaaatagaaagagcttcctcaactgcataggtgcttagaaagggctatagaggggcctggggaatgagctcctcttcagtgaagggtttctatctcgtgtttagctaagcgagcttccactccatgacaggggagtagtatatggtttatcctggccctggtcagcattcagagtcctttattttatggctctgccttactcagccccatcaccccaagtcagtgcacagagccaggattcgagatgtacttagccttccccatggcctcagttctcactgggctccctcctgcctcagtagcccagttccctgtggcccagtgccatggacagctggccagcccccagtggctgaactgtctactcctcaaggagattgtgccttgaggacgcagtctgtgtctcatccacctgtgtagccccaagccagtaccgaatgtagctcaaaacacctttgcagacaattttcttaagccactgaatgaggaagaaggaatgagttcgtatattggaaataggaaaactgagactcagacagattaagtagtctgtctactagaagactcaagacctccagaatcacgtgggttgtcagtgaaggggctggatctcaaattaagattctctaatccccagagttctttttccactacattaagttatgagtcctagccttttatcttcagacatttcaacttagaggacaaatgcttaaactacgaggcagatcagagatggttctgaggggtgatacctccagagtggagggggcaaatgggatggtgaggtaattgtacatgtggtttagatggaaatgtcagggagtaagtatttcttatttcaacttagaggaggaatatttatatataaggcaaattagggatggttctgaggggtgaaaccaccacagtggagggggcaaatgggatggcgaggaaattgtatatgtggtttcgatagtcgatggagatgtcagggagtaaagacctctccagagattactctgatttgtgagacactgcaagatctcttggaggagctgggatttgaggattgaaaattaacagtgctaggaagaaccttagaggcagcagaatcatggcataggagagggatagggtaggacacgtttgggacttggggagttgtccctgtggcatgtgggtatctcaggagcatggggaattgtagctagagagctggggtgagatctttctgaaggtcaagctgaagcatttttctcctgcagtgagacctgattagaggccctagaggagtcagttggctaaccaggatctcatacatgttttctccagtttcatgaaacattgagagtgttctttttcttatataactttctggtctcagctattctgattacaccatctcaaaaatcagagactcttgaaacatctttgcaataaaaagaaaatggtgctttttgtttgctgtttggcgagaagctggctccagaaatgctctataggagagtaagcaaaagatacgaaggcgggcaccttggcaacgtgaatgtatctcttagttaaacagcttcctggcttgactgagcagggtttgctttcagccccctcacactacagtagggcaggaaatgttttttaatcagccttagttttctagatatgagcattgtgcctagtagacagtgggaactgactgattgagtgaatgaaacaaacatattcaatgagccagttaaaaaatgaatgaatgaatactgtgatggtttgtttctcctatacataccattacccaattagtaatagtgaatcacagggttacttctcccagtgcttggtagtttcctgggaaataaaagaaagtcactgatacggttactgtaaagagaatttaacaattggccagacgcagtggctcacgtctgtaatcccagcactttgggagaccaaggcaggtggatcacatgaggtcaggagttcgagaccaccctggccaacatggcgaaaccctgtctctgctaaaaatacaaacattagcctggcatggtggagggcgcctgtaattccagctacttgggaggctgaggcaggagaatcacttgaacccaggaggcggagattgcagtgagccaagattgtgccattgcactccagcttgggtgacagagtgagactctgtctcaaaaaaaaaaaaaaagagtttaacaatctaggacagtctgatttgatggtagtttaccaaatattttaaattttgatggacttacagagaaattagtccattgtaactttattttttgcagagagttcacatataaaccagttgcccagcctcactatgagaaaaggtttgaaagtctccagtttcctgtcacttcaagtctatttccttttttttttctttatttcttcttaaaaaaaacactttaaaaaatgggatacatgtgcagaacatgcaggttcgttacataggtatacttgtgtcatggtagtttgctgcacctattgacccgtcctccaagttcctcccctcagtccccatcccccaataggccctggtgtgtgttgtttctctctttgtgtccatgtattctcaatgttcagcccctacctatgagtgagaacatggggtatttggttttctgttcctgtgttagtttgctgaggatgatggcttctagtttcttccatgtccctgcaaaggacatgatctcattcctttttacggctgcatagtattccatggtgtatatgtaccacattttctttatccagtctatcattgatgggcatttgggttggttccatgtctttgttattgtaaatagtgctgcaataaacatatgtatgcatgtgtctttatagcagaatgatttataatcctttgggtctatacccagtaatgggattgctgggtcaaatggtatttctggttctagatccttgaggaatcgccatactgtcttccgcagtggttgaactaatttaccttcccaccaacagcgtaaaagtgttcctgtttctccacagcctcaccagcatctattgtttcctgactttttaataatcaccattctgactagcatgagatggtatctcattgtggttttgattagcttttctctgatgatcagtgatgttgagcttttttcttatgtttcttggccacgtaaatgtcttcttttgagaaaagtctatttcctatttaatcttagattcatgatcttcagaagcccttggatctgggtctctcttgcagaattggaagagaaacactcactaccattatttctgtatttttggcctagtgaggagaactttcagctagcaatcaggaaacctgaaagacccacctcttttattaacatgaaaatgttatccaagtagcattatctcttacttgttttgtgaacttgttgtgaggaatttacaaaaccctttagacaatgtggagttttaacacaatttgaaatcctgaagaaaaaggagccatggaagagacccaaaggcttacattagagggagcaagtgtgctctttcaagtcatgggagggagccactgtggttccaagtaggaaaaactaatctagcatcttcttttaaatgaaaatttctcctatgaaaatctggctttcagcctgatctggaatggtgccagtgagtgggcaggcaaagaaaagacagtgagtggtagctaattaattagtcaatcaaaaagtatttatagttctctaggtatagggcaccatgctggactcagtgggagatgcaaagaagagtaagacccaacctcagcccctgaaaagcttgcagccggtctccttgggaggcgaggtgtacaggtgctgacaggaaagaaagcacaaggcaggtttttaattgggccgtatgtctcacagatgcaaaataggtaatccaggcacataggttgttattctaggcttatcaccattgacattgcgccatggagtgtcaacattcagagcatctgtgaaagctgcttttataactggttagagtgagctagttaagggcttaacagacccttcaccaatgagcacaagatgggttgggtgaagaaaatatgagggatgaaggagtgctgctagtttccaaaaatgaccccaaagagattgggccttcatcctttgctgtttagaagcaaaagagtcattgtaaaaatgttcagagggaaaatatgtgtaaatatgttcagagggaaaaataacgaattacataccacaattttcattttatggtaaccgcacatacacgtagacttgagaaaactcttttaaacatgttggaggaataagtacatgggcagaggaaaatgaaatgttggggacaaaaataaggctatactgacctgaagttttctgttagtcatttccattgaccagatcttctagatgactgcttgacatttcaaatataactattcccactgacagcaaaatgagatgggatgacttaatagctgcagcgaacgttcattatgaccatgttccagactttctctacctttatacttaatggcaaccctgtgtatagtatacctcctggctcagatgcaaatagtcataactgtgttaacactggatatcgatcacagaaaaactgtgatataacactattgggaggacaagacaaaaggcaatacgcatgcaggtggtagtgaggactgggcaagcaaaaagtaaacccgtgtatttttggtggcaactcagtagataatgccccaaactgaagaaaaccaaataatacacagagatagagtcatgttatttagacataagggggaagggagggtgtgattatcaaagaaacagttaaaattattgaaaatggttagcacttatgacacagaatggaagagggtagaactattgattctttaaattatgtgcatgtctagctttgataaaaataaaaattagcctggatgccatggctcatgcctataatccctttattttgggaaactgaaatgggagaattgcttgagcccaagagttcaagaccagcttggacaacatacagagacactgtccctgcaaaaaatgaatttaaaaaattaaccagatgtagtggcatgcactgtaatcctagttactagggaggatctttggtgggaggctcccttgagaccaggaggtggaggctgcagtgagctgtgattgtgccactgcactccagcctgagaaacagtgagactctgtctcaaaacaaaaaacaaacaaccttgaaaagtgaggggaaaattcagataagaaaaaaaaaaatgacccaaaaggaggatgggtgcacttctcattataatgaaactcaaaagagaatacaaaaaaattaattcaaaacaaggaattaacattaatctcaagtacagttttttaaaactgatttttttttttttttttctgagacagggtctcattttttcactcaggctggagtgcagtggggtgaacacggctcactgcagcctcgacctcccaggctcaagagatcctcctgcctcagtcctccaaatagctgggattgtaggcgtgtgccaccacacccagctaatttttccattttatgtagagatgggtttcgctgtgttgcccaggctggtctagaactcttgggatccagcgatccacccgcctctgcctcccaaagtgctaggattacaggcatgagccactggccccggctcctaaaacaaattgtgaaaaggagaaagttgtgcgatgttatgttccttcctcttttttccccacacacactcacactctggtcaggtgtttgtgtatatcctttgacctttccttgccatcggcttctacttaaataggatgactagagaagatctggggggacaagtttgagctgtgtcatctaacccagtctcttcattctccagctgtgaatctggcttctctttgttcttcactgggttcttagaatatcttctttcctgccatcttgctgtatccccctattctgctggcctcctgaagcaaattccttggtctatccccctggctctgactcattccttaccctgaccttgctgtctgtatttgctttgactaccctatgagtttcctcaacctaattcttaattcctggctgccacctccttgtcaaaacttggctaaatccactttggaatgctaaggcggatgggactgcctgggaagaatttggagaatctgcagctctgctctttcctcattcttgagagccaggctagtggctgagggtatatcgggagacagacagggagagagacagagagagtttggagagaaggcggcatgatcatccgatcatcttgggccccatcagtctccttgggaatgctaacatgtctcctggtatagtctttcttttatttattcttcagtttatcttagaaactgttctgaaagttttaaacccagagacatctctccaacttccttgcatgagctgtattttgaccgccttaggggctgtggcaggatttcagtcttgcttgtggtgattttacatggagtgacatctgagtcgcttttcgactgcattccacaccaatctgtccagccctgcagtttgtgggctgactcctgttgtctttcaacatacggagcactatgagatagtgcgagtttgggtcttgtcagggagtctgattaagccacagtcagagacggcagtcctaagtgtgaaatgtaacaggccttctcaagacagcttcatctgtgagctgctggaggtggctggtgccattctgttgggaatagaggcttgctaacaaagcaaacattttttttttctatcgcaggctaggtctatggtggtaacatttggcaagttgagtaacagggaacatagataactgtgaacagatgggcaactattaaaagatttgaggggctttcatcatttctcaaatggccttcacccacctacaggatacccagctcccttgcaagaggattacgtaaaggattcaattacatttctctttcctttttttttccttcaattgcgatggaagcacaagctctgacgtgaagaggaaaagaatagatgagaaatttctaattttgaatccccttaggattagatgctgatttcagctgtgcagagaacactgccccatattttgcaagagtaactgctgccagtttcaggagagatgactttccaaaatagacagtaaactccgccctccatagctgatgaccatctgacattcagacagaattacagagctatacaagttttgataagtataaccttgcttttgaaaaatggcagtggcacgtcatcactgtgtttaagctcaaaactgacggactacaaaacacataagagaaataaatgtattgcctggtccccagcagaaacataaaatatttatccatctgagagcaattaaatttatttacccctgctttaggacagcagtgtctctgattcagaagcatgctgttcctcttttgctcagagtgatgcttggaaggttcttaagagggagaagaattccaggcactgattaagaggaggcttgttgtcgtctcttaaggagcagcagcctgattttgccaaaagcaaccataagttgatatggccggggttaaggtggctataagctagatctcaggaacctgaacaaattagattgggtttcattcctcagaggttgccttaaagacatataaattctagggccaataatcttaatataagtttataattttagtcggtacttaccctatgcacactcatttaattttctgtttggaagcaggaagcatggataccctgccccctcgccatttttttttttcctagacggagtcttgctctgtcacccaggctggagtgcagtggcgtgatctcagctcactgcaacctccacctcctgggttcaagcaattctcctgcctcagtctcccaagtagttaggattacaggtgcccgccaccatgcctggctaacttttttatttttattattttattttatttatttatttttgagacagagtctcactctgtcgccaggctggagtgcagtggcacaatctcggctcactgcaacctctgcctcctgggctcaagtgattctactgcttcagcctcccaagtagctgggattacaggcgtgtgccatcaagcccagctaatttttgtatttttagtagagacggggtttcaccatgtaggccaggctggtctcgaactcctgacttcgtgatccgcctgcctcagcctcccaaagtgctgggattacaggcgtgagccaccgcacccagtcaccctgccccatttttatccccagtcctctaatcagctttaatccctatttatcccagccaagagtactgggtaactgaagatccctgtctctacaaaccaccccacctaagactaaattttgcttaaacataaccagaagccttacaaaaggaaaataaccatttgtcatattttaaattaaaaccctacattcagaataattataatttaaaataattcagcaacagaaacaccaaaacaaaccaatcagtaataagtggaaaacaattagctcttagaggtgatggcctctttgcctgctaaatgatgctcagagtcataaactcagttctcctgggcagggttgtttggttttatgtaattgagtaaacaaggattatcggtaggtttagtctcccctggagaattatactttaacagaaggaattattggaaatagtgaaaatacgctcccaccattagcagaagaagagctggcaatattaatttttccatatatgttttgtgggcttttaaaaagttaagtgctgtacatagattgtgtcatataacaaggaagcatccacacaggcacttggaagcagtataaagggagtgaatatttgtgtattacctattgggcttgtaataatcactaatggaatagaaaataagctcaatataatgccaatttttttttgttccaagttttaggttcttttgaatttcacgtatttttctgatatttagaaatactctgtaggtaaataaaagacgcatgcacacacatttatagcagcacaattcgcaatagcaaagatacggaaccaacgttaagtctccatcaaccaatgaatggataaagaaaatgtggtatatatgcactatgaaatactaatcagtcaaagaaaggaacaaaataatgtcatttacactaacttggatggagctggaggccatgttattctaagtgaagtagctcaggaatggaaaaccaaatatcatatgttcctcacttataagtgggagctaagctatgaggacgcaaaggcataagaatgatataacggactttggggacttggggaaaggtgggagggggatgagggacaaaagactacacattgggtacagtgtacactgctcagatgatgggtgtatccaaacctcagaaatcaccactaaagaacttatccatgtaaccaaaaaccacttgtacccacccccaaaactactgagattaaaaagcaacaataatacatacaatttcatggttaaaaaataaaaataaagccatccccagtgattgtgtcttcctcctcgctgttgttgagactgatggtgttggtttactcatcctccctgatgctcacgcagcctccatttgtgcctgtgcttttctagaatggccaacatgcagggactggtggaaagactggaacgagctgtcagccgcctggagtcgctgtctgcagagtcccacaggccccctgggaactgcggggaagtcaatggtgtcattgcaggtagggtcacaaactgttgtcattcctggtcttcttgtgggttacttcattttgtttccataatttcactctcaaggaacatttctattatccttcagcttccctactccttccatcgtatgtgaccataacattaaccagaggcaagcaatccctgaaaaagagaaaggaagaaaacctttcaacccacaatccacaacaattatcagtatctgtgccttttagagacagggtctcgctctatcacccaggctggagtgcagtggtgcaatcatagctcacagtgacctcaaactcctgggctcaaggcatctccctgcctcggcctcccgaagtgctgggattacaggtgtgagccactgtgcccagcctcagtgcctcttaagagcatattcatctttctttcatttagtgttcatactgctgtcccgcactcaatgactaaatatgttatctacataattatcaaaaaagaaactaatgttcttgattagaatgtaaattggaaggaattatcattctgtagattttcattttaaaaagaacaaatcactaaatttaggaactaaagttttgaaggaagctggtcttatgcaaaggcaaatatgactttgatgtaacataactacgtcacggtgttttacctttgcctattcctaaccaactatgctttttttttttttttttttttgagttggagtctcactctgttgcccaggctggagtgcagtgatatgatctgggctcactacaacctctgcttcccagattcaagcgattctcttgcctcagcctcccgggtagctgggactacaggcgcccgccaccacgcccagctaattttttgtatttttaatagagacggggtttcaccatgttagccaagatggtctcaatctcctgacctcgtgatccgcctgcctcgtcctcccaaagtgctgggattataggcgtgaaccaccatacctggccaaccaaatatgcttttaaaactatatcctaataccatactgtaaaacattttttaattatatcatcaaaaataaaaagttggctacttcccaaaaagggtaccacatatggcaagctctccaagttatctacaataatttttccaattccttcttgactaagggacaaataaaaattacaaataatttacttaataatttttttaacaaataaaaataaaggacaaccaattaaatttgaatttcagataaagaacacttttttggggggtataaggatgtcccaaatactgcatgggctatactgcgtgttatgcacctacagcaaacatttattcattgcttctctgaaattcaaattgaaccaggcaatctgcatttaatatggcaactctgttcttgtcacatgggcacttcctccttatctgacccatactgaatcctgtcaggtttttttgggctgagaaaagccgtggggaagaagggacttcagaaaaagctttcaccaggaaagacctacattggtgcttctagaatttcaggcgaatttggacccgtgcctgtattacataccatgggacaaaaattactgtgtgagcacaaatgtgctggctggtttatttcccccctgaacataatgaaaattaaaatgctttgaatgaattgaaagggggtgttgttttaaggaaggctgccaggagcctgtaagtttttttccgcaccaactgagacacatctatgatttcattttaagcctctttttgttaactgtatacaattggtatatgattcaataaaccttatttgtaagaaaatattttcaccctctcttcagtaactttgtttcattatactgttggcatcagatgattaaagacatttctgtaaactactgaccacaaatgtgaagcctgtgaatacacaaaacaaagttaaaatctaactaccgggagactatatagtattattgagtaaagaaaaaaaaaatctcaataatttgaacctcacttactcaaagaggtactagattgaacttggtacattgtaaaaaaaagattttttctaggaaaattaataggctaagtagaattagagggtatgtaattaaattatttaaattatttaagtgtttaaacaaatattttctcatataacaaatcgttccaaaccagtttattaaagcaaagctcttctaaaacaacttagcccgtaatttactatcctacttgaaatgaagtaggataattagtaaattgtctgaatgatatccatccttaaaacattttactaatcctaaacaacaccatttccatttcttcttaattagtaagttttgacaattttataaattctatttttaacaaatccgccgaacaaccttttaccttacatgtaaacatcattacgacaatgttataacaaaagttattttttttttaattttaaaagaaacttgaaaatgtttaaaatcgggatggacgcagtggctcacgcctgtaatccagcactttgggaggccgcggcgagccgatcacgaggtcaggagatcaagaccatcctggctaacacggtgaaactccgtctctactaaaaatgaaaaaaattagctgggcgtggtggcgggcgcctgtagtcccagctactcgggaggctgaggcaggaaaatggcgtgaacccgggaggcggagcttgcagtgagccgagatcgcgccactgcactccagcctgggcgacacagagcaagactccgtctcaaaaaaaagagaaacttttagaaggaacataatcccttacaaatgcataataggcatagatcaaaggaccactctattatgatactggtattatgatgtgctttagaaggtgagtgtttttttcctctggtgataatcacttaagttgcgctcaacagttgaagtatttttgcgtttttataatgcgacaaacactgtgctaggtgcaagaaaattgaagatgaattatacacagtcctaatgctccagaatctttggtctcaatgcattactattcatggccccaaattctttgattaagggatgctcaaaggatgcagtttggagagaaagacaggtctgcccgcaggaggtgtgaacagagttgaacgatgaaaggaaattggaaaatattcccttttatcattgtaccttctgctatgtagaggactctgtcacttttctgaaactttctcccactttaaatactcagcagagatccccgctcgggcctcttccatagcaacaaacaggtttatctgtctccaaacggatccataaggagcctttgggcttgtgtcctttttatgttccagaagttgttatatactgtgctgtgaactttaagataactcagcttcaacgtctagcttcaacatcctgctcggaagttagaacatacctgcagagagtgtaaataacttgtttccatcaccctttgggcctgtggaaatgggtaattgggaaaaagagaaaaagaaagacactctcctaatagttttgtgagcatagagaaaaggaatcctagattttggttagagttttcatagtttctcagtattgtatttctcaatattagggacatgaaatcagggacttagattttttttctgttaattaaaaggcagggaaggaaatgcagagcacacctgttgggcagttgccacttgagctttgccagtaatttggcagctctgaacccaacaggtatgggctcagcagtcaatttcattcccactatggttgtccccccaccccctggggagtgaagaaggaagaaaatgagtgaaatcagctttcttttcctccttgcccagagttcattattaccttctgattgtcctgggtaatcttggtaactgtttgtaaggtcattatagcacctgagcaggtggctatggaagaagggccactggctttggatgactcggctgggttcaggttttggatctgccttttgtttggtctgtaactctggccctgtcaggtgctgtgtttgcagccatttcctcatctgtgatggtgctacctacctccctgggtccggagggaatgaaatgaaattatgtagcgtctttactcaggaggatgaaaaataggaaaacagtgttttcctgagctgttgagaaatgtttaataaacattgatggagatccgggcatggtggctcacgcctgtaatcccagtaccttgggaggccaaggtgggccgatcacttgagcccaggagttggaaactagcctgaccaatatggtgagaccctgtctctacaaaaactacaaaaattaacagagcacggtggcacgcatctatggcctcagctacttgggagcctgaggctggagaatcacttgaacctgggaggaggaggttgcagtgagccaagatcacgccactgcactccagcctgggtgacagtgagaccctgtctcaaaaaacaaacaaacaaacaaacaaaaaaaccaaacacattgattgagtgaaggaatgacttagcaaatgaattggtgagaatgaaattgatgatattaaacttccatattgcctatggcaagacagtcccaggttttcttttttttttttttttcttgagatggagtcttgctctgtcactcaggctggagtgcagtggcgcgatctcgactcactgagatcacctccacctcccagtttcaagagattctcctgcctcagcctcctgagtagctgggattaaagatgcctaccaccacacctggctaatttttgtatttttagtagagacgggtttcaccatgttgtccaggctggtcttaaactcctgacctcaggtgatctgcctgcctcggactcccaaagtgctaggattacaggtgtgagccaccgtgcccggctagtcccaggttttcattcaacggccagggaataacaaactgctcctttccccaaggtgtggcaccctccgtggaagcctttgacaagctgatggacagtatggtggccgagtttttaaagaacagtaggatccttgctggggacgtggagacccatgtaagtactttcctcccctgttctcagtagagagtttaaacttaccagcccagcctctgacaacgctaacagcctgaggagatctttatttatttatttagtttttactctggctaggcagatggtggctaaaacattcatttacccatttattcatttaattgttcctgcaaggcctatggatagagtattgtccagcactgctctggaagctaggagcatggggatgaacaagataggctacatcctgttctcacagaacttccactttagtctgggaaacagatgatatatacaaatatataaatgaattcaggtagttttaagtacgaaaagaataagaaagcagagtcatgatttagagtgctggaaacagggctattgcttgagataggaaggtgtatctgaggtgacactgagcagagatctgatggagagaggtagtgagctgtggagtgatgtggggaagacagttccagacagagggaacagcaagagcgaaggctcagagcaagcttggtgtgttcccagcagaacagaaggcctgggaaaagataagggagaggggtaacaagggctcagagtacaacatgctcttctagtcacagtgagggactcggctctccttcccactgtgatgggaagccacccggggtcaccgggcagaggactcagggcgatttgatttatgcttttaaaaaggtcccctggctgagctgactcagtcaccagccacccttcttctttctgtaaaatgcggcctgaggatatcacctcatatccattgggatggctactatccaaagaacaggaattaacaagtactggttaggatggggagaaactggagcctctacgcactgttgatgggaatgtaaaatgatgcaggcactgtggaaaacagtgtgttggctcctcaaaaaaaaaaaaaaatggaactactgtagatccaacaatttcacttctatgtatatcccccaaatttaaaagcagcatctccaagagacacccatgttcatagcagcattattcacaatagccacgaggtggaagcaacccaagtgtgcattgacagatacactaaatgtggtctgtacatacaatggaatattattcagccttgaaaaggaaggaaatgctgttacatgctgtagtatggatgaaccttgaggacattatgctaagtgaaataagccagacacaaaaagacaaatactgtatgattccatttattggcagtgcctagggcggtcaaatttgtggagacaaagtagaatggtgtttgccagaggctggagggaggagagaataggaaattgttcaatgagtacagagtttcagttttccaagattaagaagttctggagattgtacaactatgtgaatatacttaacactattaagctgtacactgaaaatggttaagatggtaaattttatgttaagtatatcttactataattttgaacaaagtacagcctgaggaaaagcaaaaacacagaatttgataatctctgggttggaagagaactttaaaggtacctaagctagcctgccagttttagacacttttcatattttaaaaaatattagcatcatctccggggttagtcattgtttgcattcatttagtgaaaatcgaatgtgatagccaaaccaattaaaaacatgaaaagaaatgtatcactgggttcttctttttctttggcctttgtttctcactaaggattgaattccaaatctgtctacctatagatttctcagcaatgacagaatcctggcaaaaccattttcagtatagattcacagaaaatctgattcttgaataaagttgtggtttggggcttttcgcatattctcactcataggtgggaattgaacaatgagatcacatggacacaggaaggggaatatcacactctggggactgtggtgggatggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaagttaaaaaaagtataaagggattctctttttgctcccctcccaattagacatcatatgcaacacccaacaccagtctcccaggggatccagtgactccggttatgccagaggctccaagactgtaattaaataggtgcttatctcatcacattgcaatgtatttgtttgccacatctaagaaaaacaaagatacttctccatttctgttgaagtaccccttggtgaaagagacaagccttgatatatacgagttctggaaaaacctgggcactaagatgcatccacgtcaaatgtatcccacagcactattgttactactctagtctgtttttttcctcagtgtttttgtttacaagaaaccttgtatgcagcaagagagtggctgagcctcttgtattctgaggcgtgataactcctgaacgctaacatacacaaaggaatattatctgcaatacactgaaaaagatgcttgagtgattgatgaacattttctgtcttgaacactatgacagtaatcattgtatcattatggttactattcattaatgccaacattaggcttctgaggtacacagtacattataactcattaggagtatctcaaaaattctagatagaagctttttacaagagaataatgagacctataaataagtatatttaactttgcattttttaaaaaagtaagatttgtatgctgtcttcaaattgcacagtaaacagtccctttaagttctttttagaacagagtgagttataaagtgtagcttggttaatattaagtttttcatctcttcattcatcaggctgtaaacaggatgactcagatgaaggaatattctcagcaatgaatatgtaatgcttaagaaaatttatgttctccctagtttttaaaaaatagaggaaaggaaggaaaagaatagaagacagaaggaagaaaggcaagcaagaaagagagaaagaaagaaacacttgtcatctgaaagtttagactccagctctacaacacaaagaaaagtacaggcagctatagtccatctgcccatgacgttaatactttgaacatgccgtttattttttctctcgcttacagaaccatgtgtcattggcattaagcttgcagctgttgcctctcacatcagccagaagtgggggttgaactttattccaagaacacacctgttgcctaggaaaaaagccctcacatacctgattgtacaggatggaaatttgagagtgacacaaatgtgcatcatattaaatcctgtgcctgtgcttaaaagtcatttcacagataccagtaaggaataagggcagccaagctatgatttaacgtctgtctcgatgtgttggctgctggttgggcttaatttactgaacactcaatagcctattgacagaacagaccacaaaaaaggggatctaatagctacaattaggaatctctgctgaacctaagagcataacaggtttagaaaagattagaacttgtaaagccttcttgtgtgcagcctaaaccaaagggcttatttaaactactcttcaacccaagaaacttgacacagcttgcaccccttttaaaaaagaatagataattttatgcataattgcatacatgcatgattttataatagatattgggtaaatagagttctcaatgtcaaagaagcagatcctctagaaactgggcctatataatacctagcccttggttggacatcatttatccataaatagatttatgtgactttgggtttttttttttttttcgagacagagtcttgctctgttgcccaggcttgagtgcagtggcgtgatctgagctcactgcaacctccacctcccgggttcaagcgattctcctgtctcagcctcccaagtacctgggattacagccgcacgccactacgtctggctaatttttgtatttttcgtagagacggggttttaccatgttggccaggctggtcttgaactcctgacctcgtgatccacccgcctcagcctcccaaagtgctgggattataggcgtgagccactgcacccggccattaggggttattttttaacaaagttatcctattgttaggattcatggcggaactgatctcaggtctatttctaattgatgtgacaaataggaagcaactgcaaatcatagcttttcctaacccaagtcttttttagagatttctagaacttacattttaaatgtttgtaggaatctggaatctttatttcctgttcttgattgaaatggacttaaaaaactgctgttaccacatgctctcactaataagtgggagctaaacattgagaacacgtggtcacaaagaaggggacaatagacagtgggccaactggagggtggagggcagaagaagggtgaggatcagaaagtacctgtcaggtgctatgcttattacctgggcaatgaaataatctgtacaccaaacctccgcgacacaaaatttacctacataacaaacctgtatgtgtacccctgaacctaaactagaagtttaaaaaaagatatcgttaaaaaaaataatttttattaattatttaaaatgaaagaaccacaatttgaacaaaagggcaataaaattcaactaaacgtaacacacataaggcatactatgattaaatcacatgctgtataatgttctgtccttgagttctttgacttctataaaggatgaacatgatcagaaaattattacagcctcacttttgatgggtcatagtcactatgctagatattcctagtctttaccatttatttaaatcatctacaaaatagcttgctcactttgtgccatgctgttcagttaatgagttcaaagagtggcaaaatgagaagtctctgttcctctgactcacactggcagattgtattaatatttggatttagagtggccctgcttttgacagcatgaccttgagctagtcccttcatctgctccttaacgaggcaggatgacataatttctcagggcctctgtctctcaatagcccatgcacctgactcatcagttctctcagcctgaaagcatgagggagctattcggtttccaaatgaagagcttgcaatagggtggcctcatcaccattataaagagcatcttcagccatgccagggaagatgccctgagaaacaagcagaaggaaccatgtcagaaaaaggatacacagagcactaaagacaaaacatctttccactctcctgtggtatagatgaacatcagcctccttcatctgaaaggacccggaggcctctaccagtctgtgctttctggtcctacgagttgtcacatcttcctttacatgaatcttatctctgaaacatataatagccttatctctggaataaataatacagaatatctgcatgtttattttacggatggtatcttgtattctttcaattcttttgattcttgaaaatatttatggatcacctgtactcattttaaaagtgaccatttacatgtttggtgctttagaatctgtgtctatccaggatccccatcccaaaaaatcttatcagaagcaccactgtgaggctgactcagcaaaccagcccattccatgtcgttctcctcacctccccactctgccttcagccaacttgctcttcccatgaacttccagttttctgttcactgttttaatttgaacattaatttttattaccactagatgtggaatatcttggcaattgcaagcccgaagaatctgtatgtctttcagtttcaccaaatggcagagatccaaaaaatgacttgcatcaagaattctgcctctaggtttcatccaggctttaaatggggcatcttctttcttactggcttagccattaatgatagccagaatttttagagaaggaagcatttaaaagtcatctattccagttatccacccctccacccccttgcttgcttgcttttcttctttttcttgcttctttcttcccttcctttcttctccctcttttctttcttttcctttctttccatttattttcatccttctttccttccctacttccttctctccttttgttttttccctctttttgtcttcctcccttccttccgtctccctttcctttgcttttattttcttttacttccttccttcccttctttttcctccctccctccctccctctctcccccctccctccctctctcccttccatccgtccatctatctgtctttctatcttctacagagaaggaaactgcaaattagagaggctaggtgatgtgcgtggtgtgttaaagatctcagcaatgcagtggcagagccaggaatctagtctccagagtctctgtctgtcaccttggcaggcacctactttaacctgcagtaggatggcctcatcaccattgtaaaaagcatcttcagccatgccagggaaaacaccatgagaagcaaacagaaggaaccatgtcagaaaaaggatttacagaacaccgaagataaaacatcttctcttcttgctctctccttgtggtatagacaaacatctgactccttcgtctaaaaggactgtaggcctccacgtttctgtgctttcaggtcctacaagttgtcatggcagctgtgtctcccaccacccttgtggtaattggctgactggtgagaagcaagaccgcactgacctgcctccttcctcactccctctttctagaagaggaggataggtctccatgaccaggcttaggcccagggcagaggagagggtggaaggctactgtgcctcttagtgaccaggagaatgctgcctccaggacagaactctgtccctctaggtcttcatttctgcgcctttgcactggcgtgggctcggcctgatcattactatgctgttggcaccaaatttgcagaattcagaaaagtcacagatagatcagcctctgttaccgtgtcttcccaagaacgtggagaagttttattctcagcgtagaacacatagtttgctaccaaacatgctttgattcacagcccatctcctgctaaatctcaggccttcattggacatccctgtgactccttttttacttaaagtttgtttctagagcatacaatcctcatctatctcactaaacatcctaatttcacaaacacacttagagctttggggaccggccagtaagaaactggacttggaatcaaaaccagacttcgaagggccaccaggcctgaccaaccacaggattgcccatttactctaccaatgaaaaaaatcaccaagataccttgctgaaacaacgagtcagattccatgagtctctaaggttaagatgataagatgatacctgccctttttctttttcctggacagcaaatatgctttctgccaaactcttgcttcaatgtttttctttctgcttttttagtaatttaatttcttttctttttttttctctttttttctttctttttttttttgagacagagtctcactctgttgcctaggctggagtgcagtggtgcaatctcagatcactgcaacctccgcctcccaggttcaagcaattggcctgccttagcctcctgagtagctgggactatagacccgcaccaccaagcccggctaatttttgtgtttttagtagagacggggtttcactctgttggccaggctggtctcgaattcctgacctcaagtgatccacctgcctcggcctcccaaagtgctgggattacaggcgtgagccactgcacctggcctgatttaattttttgagtaaatgtttgcatgggttaaaaaattgaagccaggaaaagcaccacgtgtactttgtgtagtaacgtgtactaatgtacgtgttcatcccatttccctccatacccctgaaggtgatgactttttaagtttcttatgtatccttccagtgtttgtttttgaaaatacatttattcttattttccttttattactaaacggtcacttcattatgtacactgcttcacaccttgttttcttcacttaacaatatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggctatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatatccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgtcacattagtgggtgcagcgcaccagcatggcacatgtatacatatgtaactaacctgcacaatgtgcacatgtaccctaaaacttagagtataataaaaaaaaaaaaaaaaaaaaaaagaagtttacggataaaaaaaaaaaaaaacaaaaaaaaaacaatatattctagagatcttttctgtcagtccatctagagcttcttcactgttttttacggcttcaaaatactcctctgtgtagtttatcacagtttatttgaccagatccctgttgctggacattgggttgtttctaatcttttgttacagtgcataagcatgtattttctatatatacaagtatatctgaggataaattctccaaaatgggattccagggtgtatcagtcagggtcctggaaggatactcatggatagatcctgtgagtctctaaggttaagatgactaaactcttaatcttggcatggttaaactaaggaatctttctttctttctttctttccttccttccttccttccttccttccttccttccctccttccttccttcctttcttgatagagtctcactctgtcacccaggctggagcacagtcatgcgatttcggtcactgcaacctctgcctcctaggttcaagtgattctcctgcctcagcctcccaaataactgggattataggtgcgtgccacccttccagctaatttgttttttcttttgtgtttttagtagagacaaggttttaccatgttggccaggctggtcttgaactcctgacttcaagtggtccacccgccttggcctcccaaagtgctgggattataagcatgagccaccgcgcctggcccaaacaagggaatttgaggagagtttaataaagggactatttcgaaagctgtgagcaggcagtcaggaaacaagaaatcataaagtacccaggactgccaatcacaggaatcactgctaccccaaggtttggagaggaagagagagggaggcgggtatcagaaccttccgcagagagacacggccatgcaatggagaccagcaggaagaaccaggggaataaaggccaccttctgcttgtctcccttgctccagtctcctctcaagccttccactgactgaacccagtgagaatccaggagccaaggagcctgtggatgctgatgccatctatgtcaggggtccccatccctgttaggaaccaggctgcagagcaggaggtgagtggcaggcaggtgagcggccaaagcttcatctgtacttagagccactccccatcccttgcattactacctgagctctgccttctgtcagatcagtggcggcattagattctcagaggagcataaaccctatggtgaactgcgcattcgagggatctaggttttgtgctccttatgagaatctaatgccttatgatctgtcactgtctcccatcacccccagatgggactgtctagttacaggaaaataagctcagggctcccacagattctacattgtggtgagttgtataattatttcattatatattacaatataataatagaaataaagtgcacaataagtgtaatgcacttgagtcatccccaaaccatcctcctgctctgtctgtggaaaaattgtcttccatgaaattgacccttggtgccaaaaaggttggggaccactggtctagtggttggcctggagcacagagcagggtgcagcagggtagagagtgggtctagagcagcagaacagggataggcgggatgctgggtgaagggaagggcattgtgcttttgagatctgttgtaaattgccttccatggggatatgcctgttatactttcatcagcaatggatgagtgtgtctgtttccccaaactcacctacagagggggatgtcagtggagttttgccaatctgatgggtgacaaacagtatttctgtgtcgttttcaatttgtatttttcttatgatgagtgaggttgagcactttttcatatgtttaagggtcacaggctgggcgtggtggctcatgcctgtaatctcagcactttgggaggctgaggcgggaggatcatgaggtcaaaagatcaagaccagtctggccaacacggtgaaaccctgtctctactaaaaatacaaaaattagctgggcatggtggcacatgcctgtaatcccagctactcaggaggctgaggcaggagaatagcttgaatctgggaggtggagtttgcagtgaacagagatcacgccactgcactcggtccaacctgggcaacagagcacgactccgtctcaaagaaaaaagggtcacatatcacttttgctgtgagttgtttatgcatttctttagtccataggcgggagcaagaaagtcattggtttattattgatttgtagagaactttacatgttggggatattagcctctgtctgtggtgagagatacaaatatttttccccattgtcactatggcattatgactagattataacattgctggccaggcgtggtggctcaggcctgtaatcccagtgctttgggaggccaaggtgggcggatcacaaggtcaggagttcaagaccagcttggccaacatggtgaaaccccgtctctactaaaaatacaaaaattagctgggcgtggaggtgggtgcctgtaatcccagctactcgggaggctgaggcaggagaattgccccaacccaggaggtggaggttgcagtgggccgagatcgtgccactgcactccaacctgggcgaaagaacgagattccatctcgaaaaacaaacaaaaaaagaattgcttatgttggtttttttgtttgcttgtttgaccatccagaagtgtttttttttttttttttttttttgagacggaatctttgtctgttgcccaggctggagtgcagtggcacgatcctggctcactgcaagctctgcctctcaggttcatgccattctcctgtctcagcctcctgagtagctgggactacaggcgcccacaaccacgtccagctaatttttttgtatttttagtagagacggggtttcacagtgttagccaggatggtctcaatctcctgaccttgtgatccgcccacctcggcctcccaaagtgctgggattataggtgtgagccaccgcacccggcccagaagtttttttatgtagtagaatttattataaacatatcttttttttttatggcttctagaatgtgagttgtcatttaaaaggctttttctgccgggcgcggtggctcacgcctataatcccagcactttgggaggccaaggtgggcagatgacgatgtcaggagttcaagaccagcctgaccaacatggtgaaaccccgtctctactaaaaacacaaaaattagccgggcgtggtagtgcacacctgtaatcccagctacttgggaggctggggcaggagaatcgcttgaacccaggagccggaggttgcaatgaatcaagattgtgccattgcactccagcctgggctacagagcgagactctgtcttaaaaaaataaagagagagagaaaaaagagagagagaaaaaaaaggctttttcttctaacactttcatggctttatttttgacacataaatttgatccacatttgagtttatcttggtgaatgacgttaaggcatggatccaactgttttttttttttccagataggttcctgcagttcccatcactatcattaatcagtccatttcccccatggatcgaaatgctgcctttatcacatgctaaacacctgtatatcttcaggtctgtttttggactttctgttcattccattgtgctgttcatgtctcagttccaactgctttagtcactgaggatttagagcagcagtagtcaacctttttggcaccagggaccgatttcctggaaaacagtttttctgtggaccggggagagggattgcactttatttctattgttattatatactcatcagaagatagaatcagtgagagccctgagcttattttcctgcaactagacggtcccatttaggggtaatgggagacagtgacagatcatcaggcattatattctcgtaaggagcacacaacctagatccctcgcgtgcagtgttcacaatagggttcatgctcctatgagaatctaatgccattgctgatctcacaggtggtggagctcgggcggtaatgcaagcgatggggagtggctataaatatagacgaagctccagtcacttgcttgctggcttgctcactgctcacctcctgctgtgcaccccacttcctaacaggccatggaccagtaccagtctgtgtgtcctgggggttggggacccctgattcagagtatgtttcatgtgtaatagagttaattccccccataggtcttcctatccagagttctcctggatggtcttgcttgtctttgcttttttatttaaaatcagcttgtctgtttccagaagaaaaatgttggagtttttattggaatcggttaaaattataagttagtattaaaatgttcacatgtgtgtgatgttgagtcttcctctccaaaatcaggatatgtctctccattgattcaagtccacttttgtatccttcaggagtaggattaagtttttctgcagagttttggcatgattcttgagtttattttggaggacaggggctgttatttttagtaaatgggctaattttgtctgtgtatttttgaattggttgttcgtatatgtgaaagctgctgatttctgtgtgttaatttgtgtctggctacctttctgaagttcacttttgttgttgtttattggagcttttcagttgattattcagcactttttcagtatatagttatttgcaagtagtaattactgacctcttcctttttatacctttcatgtctttttatttactattacctttaagacagtattttaaaaatgttgacagaggcttatcttttagcaggaatgtcagcccattaagtatgatgcttgttttgggctgaaaacaaactgtgtgtggtgtgtgtgtgtgtgtgtgtgtgtgtgtgtggtcattttaatgttcaattctgtatctcccatttttttattatactttaagttctagggtacatgtgcacaacatgcaggtttgttacatatgtactcatgtgccgtgttggtttgctgcacccattaactcgtcatttatattacgtatttctcctaatgctatccctcccacatccccccaccccatgacaggccctagtgtgtgatgttccccgccctgtgtccaagtgttctctttgttcagttcccacctatgagtgagaacatgcaatgtttagttttctgtccttgcaatagtttgctcagaatgatggtttccagcttcatccgtgtcgctacaaaggacatgaactcatccttttttatggctgcatagtattccatggtgtctcccatttttaagcaagaagattgttgaatttttttcaaaggtctttttcagcatctatagatgctaaaaatataacttttcttcttagatcttttaataaattacattaatatattagtatttcttcatattgagtcattcttatattttaggaggctatttagttatatcgaagtgaccattctaaactttatctcatgtttctttcaagatgtttaaggaatttcacagtggcaaagagaaatacgaaattttctgagttatgtaaactaatttgttcaaggaaaacatgctgcctttgaaaaatccttatgtactttcaagctttattattaatatattattaaatatcaagtgcattttaaaatactttttaaatcttaagaccattgtatgtacacagtacataggcttatttcagatcctctgtccaaatgaaaacaaaattgtcgtttttactttgagacagggtctcactcctttcgcccaggctggagtgcagtagcaagatcaaggctcactgcagcctcaacttcctggggtcaggtgattctcccacctcagcctcctgaatagctgggactacaggtgcacaccaccacgctcagctaatttttcatatttttagtagagacagcgtttcaccatgttgctcaggctggtcttgaactcctaggctcaagcaatcctcccaccttggcctcccaaagtgttgggattacaggagcgagccacggtgcctggccttaaaaatatacatttcctatcatagattcatagttaaactacggccaacagatttgaaatgtgtaactgttgaaaacaaaagttcaaattaactttaaaatgcatttttttctgttatgtacgtaacctacacttttcaaatttaaaattaaaaaaaaaacagcaacaataacatgtaggaattgtaatgaactcttgttgcgttcacttctttgcataactcgttattgcctgtacaaacaaattaagcaggaagaggaagaacctccacaatgacattagcctttcctggcctgttttcagtagttgatactttaggggcaattaaattctttggtcgagtaagtcaggcaaagctgaatcctcactggagttgctgaatctgaaagagattcctctactccttagagctcatgatataatgattggaatattgcactaggggaaggaaacctgggtttcacctccaagttgaccatgaacttagtgtgcagctgtggatggggttcttaattctctgggtctttgaatctgcacatgatgatgttcgccgccaggaaacctgtggagcacctgccctgattcttcctttctgttctgtgttcgctgacataagcaaaacggaacagacaacatgtgcaggggtgaatttgtgagcatgcccagggctgctgtgcttggggtgaatcacattacccttgggtacctcttcacttgcatctgggaaaaaactgattgagtctcacatgcatgatattcctctgtggaaatgcatggcatgtatctacagctcagtccatgccagaagttcctgagagctggctgggtgtggtggttcaggcctgtaatcccagcatttttagaggccaagtggggggaattgcttgaggccaggagttcaagaccagcctaagcaatatagtgagaccccatcactattttttttttttgagacagaatatcactctttcacccaggctggagtgcagtggcagcatcttggcttactgcaacctcttcctcctgggttcaagcgatcctcgtgcctcagcctcccgagtagctggaactacagatgtgcgccaccatgccaggctaatttttctgcgtttagtagagatggagtttcaccatgttgaccaggctggtctcaaactcctgacctcaagtaatccaccgcctcgacctcccaaagtgctgggattacaggcatgagccactggccccggctggccccatcactattaaaaaaataaaactcttgagagtaaccagcaactttcttcctaacattttctcctcaaaaataccctttcattagctgagcatggtggcacgcacctgtagccctggcttctcgggagactgaagcgggaggatcattttagcccaggagttctaggctgcagtgggccactatcacggtattgcactccagcctgggtgacagaggaggctctgtcctaaaaaaagaagaaaaaaatatgcttttagaggattgtttccaatgtcctgaattaatcatgttactgaatactgcagaatatatgttctttgtcttgcctcttgccttgacgcctcttttccctacttgccgtctttctaaaactgtgcccataattggaaatttgttgttgttttctatctagacttcgagataactctgttgtttgcctggaggctgcttcagcaatacttttgtacaaaaggaatgacctctttacatactgatttcgtttagcttatcttgttatttctattcatgcacccattcccacaaaacacacagacacacacacacacacacacgtgcgcacgtgcactccctccactcatctatgaattcctcatgatattgtattggctacatgtaagaaaaaacagtctcagtcaaatgtatgggcacactggctgaagcatcactctgattctagggaatgtgtttgcagatttattatattactatgcataaagcaagtacaaaatatgttttccaaccttcagtatttttttccttttctggttgtctttacattgtggtttaacactgttagttttaaaacatgccagattttacatacacacacatatgttataacatattacacaccaagtctttttcatgtatcaaatataagatgttttagtgatgtaaaagagaactcacatgtgtttgcaatacaaatcctttcccttttagaaaacccttttaaaaaaatattttaaatagtgaggtacttggaatgctgatacttgactttcaattgctttagttaaaacaaattcatatacaggtaaagtagcatgatttataactttgggcccacctgttgagagttggggtttattacaaggttccagaattatgctcttttcttccagccctgtctctgtctagcactgtgcccataatagctagtaagtgttttctaaatacataagtgaaaacaagtatttaaatggatgaatcaaattattaaggaagaatggaatcaatggacagatgaatttactgtggcggacagcttgaatcaagccaaacctagaccagtagttaaaaaacaaatcatcagctaggcgtggtggctcacgcctgtaatcccagcattttgggaggccgaggcaggcagatcacgaggtcaagagatagagaccatcctggccaacatggtgaaacttggtttctactaaaaatacaaaaattaactgggtgtggtggcatgctaggacctgtagacccagctactcgagaggctggggcaggagaatcgcttgattccggaaggcagaggttgcagtgagccgagatcgcgccactgcactccagcctggcgacagagcaagactctgtctcaaaaaaaaaaaaaaaaaaagtcatcatggcccaggttttaagtcatgaaattagcaagtgaaatattgagaaacatagactattatcaacacctgtgaaaagaaggggaaaaatacgtagactattagattgccatgtctctgtagatttttgtttctctctctccacacacacacacacacacacacacacacacacacacacaacacgagtcctgattttatcacagctgtgacagtttatccagtacccgcctcattcccttcattctcgttgctcttttgtagttgaggaaagtgagccattgaaagactggggctctgaggcaatataagaaagtgagactaagatacataagtaacctgaaaattcaccaatatattgacttataatcactgacaatagaaacacctttagctccacctgagacaagatatttatgtgaaccttactgtaagtattttatcttattatttatctatttggagacagagccttactccgccacccaggctggagtgcagtggcacaatctcagctcactgcaacctccacctcccaggttcaagcaattctcctgcctcagcctcctaagtagctgagattacaggcatgtgccaccacacccagctagtttttgtatttttagtagagagggggtttcaccacgttggccaggctggtcttgaactcctgacctcaggtgatccacccatctcggcctccgaaagtgcttggattgtaggcgtgagccaccacgcctggcctctataaatattttaaactgaaggtcaggttaagaaatagaatttcgtttggttttccagtttggattgggttgtggcatgttgcttccccctcaattgttttcaaaatgatagcgatcgggcaagaaatgactttggagtctgaaagggtaagttgggaaattaaacttttggtggggactttactgtgtatttctaataatcaaatctccctggtttcaagagtctttgaccgtatttatatcattgtaaacatctggatggaaagtgaaaaattcagttgattatctcaatatatacaaatacaggcagtcccaaacttctcagtgagatcccctctccccaaagctcatttgtaaattatttcttagaaacttggaagacattctcccatagacatttcccatagaccatgggtggttgggctcccatggaaagatatcgaacagcaccgccgcacgtgctgtgcacagaggctgcagctcgaaaactattcactaacggtttgtaccatgagataagtacagaaattatgcgttacactttgaaaacttgtatagcagtgcaacagaggaattgtctgctaaatctagtaattgaaataacttagacttgtactatacttcgtatttcagtttttttaatttcatttttctagtactgcatttttacttattttacaaaggtatcagtctgtgatagatgagacattatgaagaaaaaccttccctataggttactgagcagtacttacataatgcaaaatactaaaacatttattttaccatgcttttagttaaatgagacaagaaaacaataacatgaaatgaaaaatagtcatctgttatgaatgctgacacctaggggaatgtgagtttaattagagaaagtcaaagacataaatagggatttctatgtgtattttcagctgactttgggtctgattcctttctactttagataccaaacaagatttttcttttttctttatatgagtatatagttatgctgctttggtgcttagcaaccattattggggttaccttggaattcacgagtgggacaaaaagacaggaaaagagattttctgaggataaccgagtaggaattgaaagaaagaagagtagggaggtggcatatgcacttaagagagatttgtcttgttaaaaataaattctggagggatattcattgaattactgacggtggtcacccttgtggggtgggattattgagtgtttttacagtttaaacatccatgtcttttgaactttttacaacaagcatgtgttgctgttatcatcagaagaggggaaaaggaatatttggtgctagaataaaaatgcttggaatcaagatactgcctgaaaggcagttcatctagcagcaaaaaacaaagtaaagagaaaatgtgggcatcagctggtgtgaccaatcctgcacagcttggctgcagggcaccctagtggtcaggggtcccagctgcctgggaatccacggggaatgaggaaccagtgtttagcaagcacctttcatggttgagcggtcatagtgagttctcaatgcaggtgagttaatattgggtggacctggttcatgaatgaccaaatctggttcttagctttttaatttaagaggcagagtctccctctgtcacccaggctggagtgtggtggcatgatcatagttcactgcagcctcaaactcctgggctcaagagatcctcccacctcagtctcccaagtaactgcgaccacaggcagctaattaaaaaaaaaaaaaaaaaagtttgtagagacagggggatctcactatgtttcccatactggtattgaactcctggtctcaagcagtcctcccaccatggcctcccaaaatactggcattagagatttgagccatcgtgactggcccttagctaaattttacagtcactagagattaactttcttttcttgccttattttcgttttccatattagtaagagaggcaattttttaaaaggggaaggaaaactagtatttgtggagggtctgctaggtatcaggccctgggcacagctatcaacaaacattacttccttaatcattaggagaactttgtttttctgagacggagtcttgctctgtcgctcaggctggagtgcagtggcgtgatcttggctcactgcaacctccaccacctgggttcaagcaattgtcctgccccagcctccggcgtagctgggattacaggcactcgccatcatgcctggctaacttttgtatttttgaagagactgggtttcaccatgttggccaggctggtcttgaacttctgacctcaggtgatccacctgccttagcctcccaaagtgctgggattacaggcttgagctaccacacctggccaagagtttttaatgtatctttcgaggtaatgaaaccatgcctcagaaaggttgggtaagttgggaatggctatgtgtgtagtaaggggtagagttgaattcgatcccaggcctatctgaagttcatgcttgtggtttctctactacatcacactgctttacagtaatttcagtccttcattattaagcagtaattactgagcttctgttgtaacaaaggcccttctatataggcacctactggcttagtcctctggaatatatcttctatgtggcgccacaaggcatgtatacatgcatgaaagcttggataagaatatgacttaaataacacaaaatgaaaggataatgccgtaatgcttagtgtcacagtggattctaatataaggagtaccttgttgtctctgatttttctgagcggccttagtagccaagtgtcctttatttgtgaaaacccaagattcatcaaccatgaaggatttgctggttctctaagtcaaaagatttggcttaaatatgttgataaagtgcttcagattccttaagtgatagaaaaacaagttagagaatttggagaggagccaatctgccaagtggtttgtggctatacagtgattgaatttgaaaatgcagtttattcaggagaatggttttgttcagaatataaacttctaacaatattcatgcctgtcagaaaagcaaatggatttgaacatgcaatggtgttttctttcttttcctattcccatactgttttaaattctttccagtctttgatcttttaaaatataaattgcaataataaattatttagaagagttcagtgttgggctttttaagttacaatgattggtcttacattatagattttgcagacttttctgcacatactgtttctgtaacctgcttatttaacttagaccatgtcttctgggtctctttccatgtcaatgagttgaagtctacattatctttttttttttttgagacaaagtcactctgttgcccaggctggactgcaggggtgcgatctcagctcactgcaacctccgtttcccaggttcaagagattctcctgcctcagccttccgaggacctgggattacagacacccaccaccacgccaggctaatttttgtatgtttagtaaagacagggtttcactatgttggccaggctggtctcgaactcctgacctcaagtgatccacccgccttgggctcccaaagtgttgggattacaggcgtgagccacagcgcccggcctacgtcatcatttttaatgactgtatagtatttcttcacgtgttacaccgtaattgattcaaacaatcaaaattatatgtagatgaagtaatgtatgtatgagaatttagggcttggactaaggtgacacaagtgaacattgcagggtgtgacctaaagagagagcacctcttaaattccataccatgggctccttgctagctctaccctggtcctatccctgcaaggatggttatctagtagtatttataatcatttaaaaaattagtgtcatttgacttgttttcagttttgaccctattgtaaaccaaattgcagttaaaagccttgtgcaattattttattattattattttttttttgagacacagtttcattcttgttgcccaggctggagtgcaatggtgccatctcagctcactgcaacctccgcctcttgggttcaagtgattctcgtgcctcagcctcccagctagctgggattacaggtgcccaccaccatgcttggctaattttttgtattttttagtagaggcggggtttcgccatgttgaccaggctggtctgaaactcctgacctcaggtgatccacccacctcggcctcccaaagtgttgggattacaagcatgagccaccatgcccggccaattattttatagttatataattattttctcaaggaaaattcctacaattagaaattcctggccaatggcaagtggtccctaatatttattgccaaattattctcccacatatatgttgtactgattcatactctcacagtgtcttaaatgctttaggctatttggtgataattatgaactaggaaaataagagttttagggaaatggtgcatgatttgaatgcacattaatattcatgacattgattgtttaaaaatactttgccgtctgctgaacaagcaggaaaataaaaacaacccacagaaatcatcctttttgcaaaagaaaaccatttatcagttctaccttttttttttttttaagactgggtcttgctctgtcacccaggctggagtgcagtggcacgatctcggctcactgcaagctccgcctcccaggttcacgccattctcctgcctcagcctcccgagtagctgggactacaggcgcccaccaccacagccggcaaatttttggtatttttagtagagacggggtttcaccattttagccaggatggtctctatctcctgacctcatgatccgcctgtctcggcccccaaagtgctggaaatacaggcgtgagccaccacgcccggctccaattctgcctttgatctatttgatgtaccaagaaatttgtttaaattgcctctttggggttggatatgacatattttggatggggttggtggggcattgaggtcaccttaactgaaaccagtaatgcagctgaaatgtatgatagaagattctaggtctggatgtagaaaagacacattggagctgtttcttattgtcagagctgtgcactgatgtaaatacttttgtgagctggaggttgccagggcaacagtcctattaatgaagaataaacctcatttattatcagtgccagaataattattttttaaataaatgtacccagtggtctaacactgacattctcaatctacctactcatctttccttcccagattgcaaaactatttagccttattcaataagcatgcctcctttctccgccaatgagagtaaaatcattgaaaaaaatcagtaaaatgtaagggcattaaaaatgctaatttttaacaattacctaatataaaattattgcccttttgatttgtgctttggctaaggtagagcctgaaatcaactgtgatttggttggtatttgagcaggccagagtctttaaattaacttgtctttacgatttaatggaatattgccaacatattcgttaagtaagtggagtgtgacattactgcttccttcctcccatcagactgtaaatttagactccgttttattgtgcacacatggacacttcagaaaggcagctgtggctgagttgtagcctttattaaatctcttgtcttgaggagcccgagaattgtgttaagggagacagtggttccaaatgactgaggaccaagcagggtacgttctggattttagaggaaaggaaatcttctatccaaaaaaaaaaaataataataataacatttcccttttcattttcttttttgtgaaaatgtttcttgtgttttgtcaagctgagcaaatgggaaaacttaccttttcaaccatgggtcatatcaacaaacctcctgtccaggttgggtgtttgctgtctgctccacacagttcacaccttatcacttgttactcacatgcactaatgattctgtgttcctgtcttgtttcccctgatttatatctaatttagcatctcagcacatagtaggtattcagaaaatactttttttttttttgagacagagtctcgctctgtcacccaggctggagtgcagtggtgtgatctctggtcactgcaacttccgcctcccgggttcaagcgattctcctgcctcagcctctcgagtagctgggattacaggaacccgccaccacgctcagctaatttttgtatttttagtagagacggggtttctccatattgaccaggctgctctcaaactcctgaccgcaggtgatccaccagcctcagcatccctaagtgctgggattacaggcgtgagccaccacgccctgcccagaaaatactttttgattataaaattgtgtaataagtttctgtttcactcaggtcttttcaatagatttttttctgataatgaaaaaaaatgtttgacataggaaaaatagacaatccatatttgaaaaagagaacaaaaaccattcagaatcccactacttgaaggtaacttccactgataccatggcatgtttatttcataaggacattatttgaaagtctaaaaaacccaatcattgtacagtctgttttctccttgatacgatagaatcacaacgtaatctgtgctgactgtgtgtgtagggcaagtggcacctgccaagccctagcagggtataggtatttcagatgagatattaaaatgccgactaatgatgggaccagtcacagaccaagaaaagctggcccttctgtctcaccatggcaatttcagattcaaccacaaatagcaggcaatctgatttctcatttcttaactcttcgcgttagactgtgttactgacaaaacagattttaccctcagaataagttttcgcacaagcagacgtatatgtttctttgtcgatggcacttctggcttacttctttgtgccacttcctaatggcacactgggaagagagtaatttcccaaacttatcaggcaaaataggaaaaaggccatgggaacccaacaagtcatagcaaagaaacattccgtacttctttattttattcttggctatgacagcacaaagggggcagtttggatgttggtttaatgccccactccatctctatgacacctccaaccatccccaaataaatatgctaaaaataacaataataagcacaaagaataaaatcgtatgtagttagtataagcatctttagaggactttgctatttttcataagcagaagcaatccaagtaaaacagcgcacttatcagagagtttcttagtgacttcccatatcacagtttcactgtcctttcccccagataactgtctctgagcccctctcacataagtatttatcacactcaccctcacctcacccgtagtctccctacatatgtcagttcatggggagatgaactggaatggaagttccataacattgcctgaataagtcctttctagttttaaaaaaaagtggaggagggggccacatattttaactcacaggactgatagcaaaagttgggaagatacagggatgttatggtttctccatcaactacttataaatcaacattggttgggtttaacttttaataatttatactccgttcaaatcctcaccatgttgttccattcattcttccatctgctcagcagatcttgagcacctgttgtgtggcaggcaatgggcagggtggaaactgagatttgaaggtgaggtgggactttgaagtagagacttggaagaatgctagagggagcagactaggacaaaaccaatgatggcatggaacactactgatgactttgtagaacttctctattgaggtctagatggtgtagactaaggaactgcctttttcctgcctttccattattgatttgttgcatgattggtatcacttggaactgtgtatcgggaaaagacaaatgcctatgaaatccatctgcgtcttgtttttgaggatggtcatatgccccatctgttgttctttgagccctcaccagtaaagtcagctcccgtaattaattttcagtcacgttgccttgaccacagtgaacggaatccttatcaaacggttaatacatgtaagttgtctgctatatgcaaaaccccatgctaggctcagcagaggatacagaagaagggaacaggaaatcttggctctttagggatggagagtgtcattgaggaagcagtgaagacactattcccacaaagttaacccacagtggtaattagtacgggattagggagagggcagtaggctcaggtcagtagacccaactctaatcctacatttgtccaccaatcttgggaaattcactaacctctccaggtcttgattgcttttttggagaggcggagacctgtctctgggtaaataaatatatttattgtcccagggctctttctctttttattcttttttttttttttttttccttgcccaggctggattgccatggcgtgatcacggctcactgcagcctcagcctcctgggctcaagcaaccctcccacctcagcctcccacctcagcctcccacctcagcctcccgagtagctggaaccacaggcaggtgccaccatgcctggctaattttttaatttttatagagacagggttttaccatgttgcccaggctggtctcaaactcctgggctgaagagatccacccacctcagcttcccaaagtactgggattacgggcatgagccactgcgtccggctcagggctccttcaagcagatccctgggatgcatgggagaccaccgtgactggagcagagggtacttggagaggagtcgtggccgtgacgctagaagatgagggtccagttgtacagggctttggaggccaggcaaaattctagactcatccaagccttttataagaaatgagagctcttgaagtgattataaaaacataagtgtccaggcgctggctgagtagggatgtgatgaggcattctgtcctcggcctgcagcctctgctcccaaacaccattagcacatttttaccctggggtcttgttttctttcctttcactcttcttttgtaatctcccattatcatggctgccctgtgctcagcagagaggcaaagtgctcatgtggcttctttataaatacttttgggtggtgatagttcccatgactggcttaactctgctcacttgtcttcttccattaggtaagtggtagtagctctgaagtcagtcttgctgatatgtttcaaaagaacattggcttgacgcaattatatccagctctcatgatctgcattgttttcattttcttttgccaaacttttccgttttctatgcttcaagtctctctctgggcaataaaagagaacttggaaagaatcaggatttaggaattcttgcttcagctttgacacttgggcagagagctttattttttctagacattcatcccgtcacttaaaaaaaatgcaaggattgaacgaaatgagccccttcggatggtatgagtgcatggttttgttacagtaggttgttagtcagacatgagcagggcaggagagcccccgctccaggaatgtcaggccaccatcaagtgatggtccagaggttgttaactgtctcgctaaaataataattggtctcagctggcaccaaggaacggcaatctcccaataaataggaaaaacctgaaactagtgataaggccctgataagatctaagcttataaggagactcaagcatgagcactaagaggcaaaatggtggagtttaactggtatatgaccttcctctaggaatgctctactggtaaggaaaaaaaaaaaatgcctcaagcgagcatgcgcacaacttaaattacacactgtgtgtggtccctcccaagggctggcaggtgtgcatatggacagcccaccccgagggaagaatcaggagaagagatacagacccaggaagaatgctaacatgtagaaccccaaatcaaagggcagatcacacacttgaaactctcaagtcacccgcttggccctcttccaagtgtactttacctcctttcattcctgctctaaacttttttttttttttgagacagagtctcgctctgtcgcccaggctggagtgcagtggtgcaatctcagctcactgcactctccgcctcccgggttcatgctgttctcctgcctcagcctcccaagcagctgggactacaggcgcccaccaccatgcccggctaattttttgtatttttagtagagatggggtttcaccatattagccagaatggtcttgatctcctgaccttgtgatctgccctcctcggcctcccaaagtgctgggattacaggcgtgagccaccgcgcccagcctaaactttttaataaactttccctcctgctctcaaacttgcctcagtgtctctctctgcctgtgcccctcggttgaattctttcttatgaggaagcaagaactgtgtggttgctgctgacttgtacagatttgctgctgctaacagttttgtagtggatggcctctgagctgttttgttaattcatctgctaatgaaaatggaatagaaacgaaagacagaatatatgaggtatcatttaggccagtggttttgaaagtgcagtgtccagacttgaagcatcagcctcacctgagaacttgtagaaatgcgaattctcgggccaacccaaatctaccgaatcagaaactccggagatgcgactcaacaatcagttttaagaaagcctccagttgattctgatggacacacagaaccactgattcaagccttctgcgaggtgcataatatgtcaactcagatatctttcttattctgaaaagatacagaaacggggttggtgcttatgttcatgtttacaaaatcaagcatcttcagtcttgttttaagcaaaatcatgaaatgggtgaaatttgtctttagcattctattacctctttttggggctcatttcttgtctcaatttcatctgtcaggttcttctttacctcttcattggcagaaactctagggacttttcctttagggtagagtagaggaccctaaacaacaaatctgaaaacacagtgtctctaattatgaaaaacagggcatcagtagaccaactggggaggtatgtgaggatggcattggcagtagggcctgcaaattgcactgagtacacagatgcccattcttccatctttagaggaagaggggccccttccctttgctgtctggttctcaagaagagggctgatgcagtttcagaaggatctggaaatgcctttagcacaagcatccagggtggatgcttttgccatcttccaagtattgcctgtggcctttccccccgttgtgcctgttcattttgccatccacatgggactttgcagcctgtagttcttccagtgaaacaatgcaaagctttgatgagtatccagaaatcaactgggcttccctagggagccagctgtctttcctgaggggattagatggaaataagtcatatttcactagtgtctgctggctcccaaggatggttttaaactgatttctgaaattcattcccctgttcttcatcctaagaccacacggcaatagatgttccaccagcctatctgagaaccccggttgctggtgtgataactgataaagttcaaacagaatgcacagacttgactttgtcaaaattatccctttcctctctgcacacacatgctcacaggcagatagatgcacatgttcacccacaaaggttgcccaggctttctgagccctgcacacatgtgatggacaaactcagcaaaacccctcgattatttgtcgttactgaaaacccctacgtttggctttttctttcacagtgttttgaactgcctgagtgagccaaattctccctttgaagttaccagactcagcaggttcggtaaaattgctcctaaataggatgctgtctggttgaagggactcatggaactttccagaaggaagaagcaagaggatcggaagttggaatgaaagtcctttgacatgtcgaccgataaggttaaaaacgaatgtagattagagtctgctaattatgcccagagttccaggaagctgaaagaagtacacagtcaaattctcagaaaggttttgtctacataagcaaaatggaagggagagttgaagcagatatctcaatattgggccattctccaccccaacctcaacttctattgttcccatgaaacaccatttggaggaagagactaattaatgaaattggccatctttgctcatcagacctgccagaaaattgctctattagcaacaggctaaatgttgttactagagaaagtaaaaaggctaatgatcatgctcatcttgggataactacaaaaatattgttaatgccacctctgagctacaattttaactgcagaagtcagaccatctgaattactgtttccacagcaactacaattcagtcggctctgcaaggcttgtcatagatgaggacgttacctctatattatcgttgctggggaaaagtgcacttattttatttatagccaagctgtgcaaagttgtattttgtagtcttttatttggaaatgtggtcattagagaccgacaaaagtccttctgaatcactgaaatatatgttttgatacaaggaaaaatactgcatagctcagagcttcccattcataatgtcataatggcctccagggcagtgagatttgaaagccctctattcttccctaatgaatattcaaaatttgagatcttgagcagtatatcccagcaatcaggctaccaggataaagagaaagaagatggtgtactccaaaatggctttgagaaaaacatacactaatttaaacagtcaagagacttatatctgttgtgttaatgatgattgaatttgtgattttaaatgtaaatagtctacaaatcttggtttgatttcaagcattttcttctcagtgggaaaaaatacccttggatgagaagtgacaaggaatgttagaaacaagaataaggtgttcgttcatttcatttatgttttggaacatttgtcagatgccaaaacgttaatacgaagtggtttgacaaaaactagtcattttccagttaacacatgtaccttacagaaaattatctgatattgacacggggatgaaattaacctaatcctcctgttattttgttgttttggtatctgtttttgaaaatgtattaagctagttcttgcctatttactagagaagtcagtcacatccaagattgcagagagatagaaactgcccataaacagatgtggagctaaaaagaaggagattaaaaatgaaattatgtatagaagaatataaactcatgaccaaataaaaccgaatcacagaatttttccctccccacaaaggagcaaaaaaaaaaaaaaagaaagaattaaagaaaaacacctcactagtagtaagcaaacaaaaaacccataacctaaagcaatacattttagtaactggtggctgagtggcttttgatttctaaccctgtccccaaaacgccttaaagacattccttaggggaaacgaaatcaggaaaggagaatatgaagcaagaaaaaaacaccatggactgcttctgtttatagatgtaaagccctcatgtctaggttttgaatcagagaaatgatctaaagtcggaagggaccactccatccgaatggcatgtgttccaagaatggggagtgaatcctggtttggggcatttagcaaattcccagaagaatgagcagcacttgaagacacaaataaagactggacatcacctcagccaaattcttcctctccctgttctagcaggccttaaagaatagagagcagaaagcatttagcccccagattctggcttgaaagggcaaagaagctgatctccaatatgatggcaaggaatcacccacattttatcagaaaaattaaaatatgtgcaagatggaaagagccaatgtggcagctacaagtaatgtgtcagaaaggaggctagcatgcaaagtagaaagacaggggcttacccttgaagaaaatagtatttaaggaacagaaacaggttcctcaataagaagataacttgtactcttagaatttaacaagattataaaaagtatttttaaaatagcctaaagacaaggtgataaaacaagaatgaaatgaaaaaggaaatttaaagtctgacaaatcaagaattaaatacattaatgcaaaaaagatatgtaaattagaaatgataacatatatgagacctgttgaaaatttgtttactaacaatagaaaaagtattcttataatcacagagaatgcagataacaaacaaggagattaaagacagagagactctaaaagatattaagacattcaaatattctacactatgaggataataattgggtccctgaatagagactctaacaaaaggaacagaagagacactgaaagatgtgataaaatttcccagaaatgaagaaaggactaaacctattccaggaaatatactatggaatgttcaaaacgcaaacatatcttagtgaagctattaaacctcaaggataaagaaataattcttgagatatcaaatcagaataagtcaatttcctacaagggagaaaaaaatcaagctagtctcagatgtcaccattgccacatctggggccacgctctctgaaaatggagagagaaagtgacccaaggatattatatcccatcaagatcttgttaaaatataaagacaacagggagacgtgcttcaacctgaaagaactaaaaaacaactgagagcttgttgaagaaaatacacaataatgaatgcctggccagttaaaaaaaaataaaattaactcagaaacggagaagttatgatgagaatcattaggtttgcataaatgcagaactaatacttaacaactgtgtacactaatactacagattgaatattattgctatcagtttggagaaaataaaaataataactaaaaaccatggaagatagggatcagagatggaaaaagtgtaagtacttatgttctcatctttcccagcaagaagtcagtcaatactatctagaattataacatgtcattttagagtgcaaatacataattatcccagtctcaacattttataatcttttttttaaccttagaatgatcttttaggacataaaaactattatggtgcagaaacttttctttgaagtttaacagttctttttcatttacatctctacgattcaatcataactaaaatgtatgctttttaagtctctctgcatatattcttaaaaggaggttacaatgatgttcatttaatgattatttctaggttgtgaggcattattttaaaactctaatctttgctgggtgtggtggctcatgcctgtaatcccagcactttgggagaccaagacaggaggatcgcttgagcacaagagtttgagaccagcctggacaacatagcaagaacttacctctactaaaaaattcaaaagttagccgagtgtggtggtgtgcgcctgtggccccaactactcaggaggctgaggcaggaggattgcttgagcccaagagttggaggcttccgtgaaccaagattgcaccactgcactgcagcctgggtgacagagtgagaccatgtctctaaaacaaacagacaaaaaaagaaaaacaaacaaaacaacaaaaaaaaaaaccctgtaatctttgaaacctttttttttttctttttttgagacgtagtctccctctgtcacccagtctgaagtctgaagcgcagtagcacaatctcggctcactgcagcctctgccacccaagttcacatgattctcctgcctcagcctcccaaatagctgggactacaggcatgcaccaccatgcatgggtaatttttgtgtttttagtagagacagggtttcaccatgttggccaatctggtcttgaactgctgacctcaggtgatccacccactttggcctcccaaagtgctgagattacaggcatgagccgccatgccttgcctaatctttgaaactttctgcatttaaaaaaaaactattccaagtcagtatgctttatcttacaagaataactgcatgaattttcttaaaaactagaaaaaaatgccaaaatggttaatcctgggtgatctggatattttttcttggtacacttctgtaatttttttaatttaaaaaattaacaaggccaggcgtggtggctcacacctgtgatcccagcactttgggaggccaaggtgggcggatcatgaggtcaggagatcgagaccatcctggcgaacactgtgaaaccccgtctctactaaaaatacaaaaaaattagccaggcgtggtggcgggcgcctgtagtcccagctactcggggggctgaggcaggagaatggcatgaacctggggggcggagcttgcagtgagctgagatcgcaccattgcactccagcctgggcaacagggcgagactccgtctcaaaaaaaaaaaaaaaaaaaaaaaaaaaaaaattaacataacaaaaaaagaaaaaagaaccaaaaaaacccacaaaaattaacaaattagttgaatgagtcaagggtgaaggtaagagaatatgtgtttgaggccattcctgcttacacgtctccttgtggggtgttgagtccaggtggggccccctctaccagggcccaaatggcactgacatctctcctgggcccatcttaatgattagaagccactggctttcagtgagcatatctaaatggtgatggcttaagggacaattctctttcctctagaaggtgtagaatagaatgtgggcacagtgtgaaagagggtaagagagagacaggctttgaaaacaagtgcactttggggctcaaacattttttaacagctttattgaaatataattcacatgtcataatattcatctttttgaagtgtatgattcagtatattcaccaagttttgaaaccatcatcactatttcccgaacattttcaccacccccaaaagaaaccccatacccattagcagttcactccccattcctccctcccagcagccccagcacccactgctctgtagtggtttctgtctctatagatttgcttctcctggacattttatataaatgggatcatacaaatgtactcttttgcgactgacttcattcactcagcgtaatgttttcaagggtcacctatgtcgtagcaggtgtcagtaccttgtctctttttcatgctgaataatattctgtggtatggatatatcacattttgtttattggttcatgagttgatggatattcgggttgttcccatgttttggttattatatgatgctgttacgaacattcatttacaagtttttgtgtgaagatatattttcatttttcttgggtatatacctacgggtggaattgccagattatatggtaacaatttttaggagtcaaacattgaaactgccatcttcctctttgttcccaggcagaaatggtgcacagtgctttccaggcccagcgggctttccttctgatggcctctcagtaccaacaaccccacgaggtaagagagtgtcctgagagggaaggtgtcccagggtatgcgcagtgtaagatggaaaacaaggaggcaacagaagcatttattatagtcgacctcctaaaaatgagacttacagcacgtgtatgttctgtctctaatctggatcatggtatagaacaattcttctctctcctaatctcattaatagtagacaagttttttttttttaagtatgccatttgcgaaaaaaaaaagaaagaaaaaaagcaatgtgtcttcttactactaatatatcattatggccaaattcttactgtaacaaatggacattaccagtttaaaaggtgagttgacttgtgtgatctttatactagtctcacaacctttttataatcaaggaaatgtttataactaatttttagctcagattttgagctgctttgttaccaaagactgttcacatctatgatcatctctaacctccatgtatggattttattagctcctatttcctaagtagcgtagatgggctaaattggtggttaagtgttttgtgtttatgggtcgtctacggagcttcattgcagtttctggttcatcaggcctggattgtgtcccaagattctgctttttaataagctcctgcgtgatgcccatgctgctgatcctcattctcaaaacaccaaaattggaaagagttttcatgactctataagaacttaggtatagtccatctcgcctttctcttccaccataaatatgaatgaacttttcttaggttaaagatatttagaggtgttagaggatctgatgctaactgcaacaatattaccaatgtagtaattttaacaacttttaatctattgtaaaattaccaagtaaggcccatggtaaattttaatacagaaggaatcaaattgtgagaacagatgttaagagcaaattaatggttggcggaggtccgtctcattccccaggccctgaaaattttcgattctctaaaccaaagcgtgatcaccacctgcccaaactactgacattgtatcatgcaaataactgcattccctctaccaagggttcataataacaacttttgacaatgctgattgtgtcacgaatgaaattattcattaaaaagtagtggcactaccagcatactttgttttatcagaaaaaaataaaaattgttattttggctaaatattctgcatccgaagtttaagaacatttatataaataaaaaataaattgagcatatgttatgacacaatagcttaaatgtaataactcactttgaattatgaaacaaactcctgaaattgaaaattttgagctaagaatcctgggaatccagaactttgaccttcaggggatgacactcagctccataaagaggcaagaccagagacctgagaccctccctggaacggacattcccagccatgcttgtgcagtagaatcacctgcaaaattttaaaaaataccagtacctgggtcccaacccaagggactgtgacttcattggtctgaggagtggcctgtgctttgagatttctatgggcttcacgggtgattctgactttcaaccagagctgtcagcccccacccaagatggatatatcacctccctccacgtgaaaggagttagctcacagcctaggtaggaggctctgtagagatgaaaatattccgtgttccaccatggatgcattttcctccttgctcttctcaatctctgctttgcagaagagcaaaatgaaactgggaaatcacaaagcgatgtgttgtagattcagccttagcctgccttttctgtgaagtgggaggagaggtggtccaattgagattctcaggtagaagaagaactgtgactttcctcactgggttaccactccatcccttccctaagcctcagaacaagaggcctctccaatggctttgcaggccttagacaaaaaagccactcactaaatattgaatgaaaatgtaagtgaatgaacaatggatgaatgcattgggtctgtggcattccagcatgagccatagtcagggacactgtgtggcctagcatgtggctgtgcagattcttgggtcatatctacagtttccctttcttactctactgcattcttttttttcttttctttctttaaagatgggttcttgctcttgctctgtcaccaaggctagagtgcagtggtgcaatcctaactcattgtagtctcaaattcatggcctcaagtgatcctcccacctcagcctcctgagttgttattacaggcatgaaccgctgtgcctggctctattgaattcttgataaaggggagggaaactggttcccagggaggcatgcactggaaacgtctggcagcacttaccacagtgctccatgtgcaataaggcctggaccaggaccaggaaaatgcagagcaggcttatgatgcctacctcccttcctggcccttctctctacttccctttcctctttattcagaacaccgtcctactacttccacctgacagaaaagcagacctgagtgatcaccacgtgttgttcagaacccctgtccactccagtggggatggtacaggctcaagaggctgaagaagagacccagaaccagcagaaaagacctgaagtttattggggacttgcatacaggggagagagtccagtagcagagggctggacaggagaactacaaccacttgcgaaaggcgtgtaatttatatagcattttcatgtaacatcctccctctaacaacctccacctggtaaccttcatttaacctaaaacaaaaggcctccctcccccatatggccagtgttccacagcgttccctgggaagccccaggggctcaaatgttcctcatagaagagcaatggatctccaggttggccactcccagattccttagttgcagactctgaacacacattcaggtggatctgccgtacaagatcactctcagggtatgctcaagtcattgctgtcaactgcgtctgtcatacacaatcgccacagtggtgaaaacagtctatggccagaccttgatccacccagtatgcattctagaagatgcatcttaaagatcagtatcataatgcagatcgtattttctcataggaacaattattataaccatttgtgtcttactgtcctccttctttcaggaggaagagaattaactgctgtaatttcagctctcagtgacatacaacagtgattctccaactttagcgtgcatgacagttccctggagggttgtcagaactcagactgctgggccccacttacagagcttccaattcagtaggtcttggttgagtcccaagactctgcggttctaaaatgttcccaggtgatgtgatactcctcgtccagagaccacactttggatcctgtgctgtatggatggctctcactgttacaattgaagctcagatttatttcaggtgcttcagaatttcatttccaacggtctctagaccactgcttctcaaacttcagtattcatttgaatcatctggagatcttgttaaagtgcagagtctgattcagttggtctcaagtggggtgcaagagtctgtagttctaacaggctccccggcgatgctggtgctgctgatttctcactacacattgagcagcaagactttagtcattgccatccacaatcccaacaagcacagaatcccttggtagtcaaatctcgaattcatattctcttctcctaccatttctgtagcaaagtaggccgtgttatgctgcagtaacaaacatctctaaaatcttagtgatggacaactgcagaggtttatttcttgtgcgcactatatagctatctgttgcaagtcagcttagtatctagtagatgagttactaaataatgactcatataattatttacttagtgttgtaacagggctctgagagaaaagagtatagaattaatctttaataggagttttgggcattggggagggaagatctttcagggctggagaaccttccagggagtcccttggatcctgctaatgaatgcaagtgaccactcttgctgccacagcataaggcaaaactaaaccaacatgagtggtcggttgtggctcacgtcagccttgtgagaccctgagagagaacctagctctgccttggcccagaattctgatctacagaaactgtgagatgataaatggatattgttttaagccactgagtttgtggtaatttgtaacacagcaatagaaaactaatagggattctctcaattcccttgttgctgaactctaaggtaatgaatttttaaaaactttttgtgggtacatagtaggcatatgtatttatggggttcatgaaatgattcgatacaggcatgctatacataataaccacatcacggggaatggggtatccatcccctcaaatatttatcctttgtgttgcaagcaacccaattatactcttaacgtttgtttgtttttttgggacggaatcttgctctgtcacccaggctggagtgcagtggcgctaccttggctcacggcaacttcagcctcctagcttcaagcaattctcctgcctcagcctcctgagtagctgggattataggcacacgccaccacaccaagctaatttttctattttttagaagagatgaggtttcactatgttggtcaggctggtcttgaactcctgaactcgtgatccgcccgcctcggcctcccaaagtgctggaattacaggcatgagccacagcacccggcctactcttcgttattttaaaatgtgcaattattattgactacagtcaccctgttatgctatcaaatagtaggccttattcattctttctaactactattttcttacccattaaccatccccacctccccgcctcagctcccccactacccttcccagcctttggtaaccatccttctactctgtatgtcaatgatttcaattattttaatttttagatcccataaataagtgagaacatgcaatgtttgcctttctgtgcctggcttatttcacgtaacataacaatctccagttctatccatgttgaatttttttttttaataagaccacaggccatagaccacaatgtgcccttcagttcctccaccttcacccttccatctatcctggcagaagccggataaaggattcattgacagccctgattgacaatggtgacccccaatttcaaatttcctttctcactttggcaatgaggaaacaggtctcttgcattctctaatactaggacatttcaacatttcagccttgacccacagaaaaaaggatattttactttaccacccagtttcacaaaacagtattcttaccatgtgcgctgcattctgacatttttcttctagtctatgctgtgctgtggtcatcacccactgaactgatcttaagatgcactagtggtcacaccttgcagttcagaagcacctttctcattgatttattacatgctcatgacacaaaacacattataaaatatttgcaaagcatctcagcttttcttgtctccccttgttgtattttacataaataacctttgagcaaaagaatggcccagttcttacagcacttcttatagtctagaatttgtcaagcccatcctcttccagttgatggaaggattctcacatggaaaatggccaagaagcccccaccctggcttgctcaactattcatttacttttacagcaggtgagcatagaggaagtatgttatttctagttctcaaacgtaaaaaacaatattcagtgatacattaataatccagccccaggatgtagacctggacccattcctttattcactgtccagagtcctttttgcagaccctacatgtaagagccacactacacgtcatttataagagttgtatgtcaaaataaaattgtagaaagtgttgagttgacatgaacaagtgttttttggcctgaggccacctcacctcacctcacctgggagagatgagaaaacaagagtgttaacaattttaaccatgggtgactccaaaactctcgcccgagctgcagaggtaaccttttgtaaaccacgcatctgatgccttgatgggcaccaccccaaggaagactatcattcggggaattcctgggaggtctcccactgatgtcccaccagtctaaccctgagtagtttgcaggagcagaagagaagcacccggagggtggagaactatagctgaggggccataagtacagcaggctttctgctgccttcacactttccctattttctccagcatttctcgtgctgctaagacctgacagtgaaatgatctctgtgtgtgtgtgtgtctgtgtgtgtctgtgtgtgtgtgtgtgtctgtgtgtgtgtgtatttgcatggaatcaatatgtacctgcacatagagaaaaaattaatcttaagtttttcaacttcagggaagatgatttatggtcattggctgcctggtaggttttattctatctaggaagtctgagttctgtattcctccataagggggagagagagagacagagagcgcgtttctactatcctccctctcgttttcttgtctttatttgaacttgtactttaaagggaaatagtgccttcctgtgcataaagcaggcatctaaaactgattctctttcctttcattgtttatacaatctgaaaaattagatggagaaggaaggttagtgaaccttcttggccgttcctccatctctgagtgaatgcacatgcccagcacagtcctccgctcagcactttctccataaggattttctaaggcatggagcagtcatcaaatttgttaataatttgttcacattaaactaagcaaaaaagcctagcggcagtgatcttaggacttaagctaattatttagatgcatgagagatccagattattagtgggcataaatatgttcaggattttaataaaacatattaatttgtgagggttgtcaagagcagaaactttggacttgggcctacttggatttgaatttcacattttctactcattagctctgctaatccaaatgcgagaaaaacgaattcatctatgtcttctaagtttgagaatcttctatctttttctcggtatctactggagaattaacttggtaatccactgacccactctaaccaaaccaacttgtcaagttacccacttgggggaaggcagttaaactttctaagcccgtgttttcttgtctttaaaatagggataacaaataattcctatctcaaagggttattgtgaggattaaatgagaaaaagcaggcgagggtcatgtgactgactagaaaagttcattattagtcagtgttgtctgactgctttagcaaaaagtccccaaatctcaaaggcttaacagaagagattttttttcttgttcacataaggtctgctccagtgtttttggttgccattcttccacatggtagttcagggtccaggcttcttccatcttggggcacccaactcctctaattcctcagccattgaattggaaaagagaatgcaggaaggttttatgggctgggcttggaaatggcctatgtcacctcaccttcattcagtcttctggtcattcctagctgcaaaggagactggggaatttaacccacctctatgcctggaaggaagaagtaacagatttggtgagcatttggccagtccaccagagtgagtcacttggtttggctaaaatgagctctttctctgtggaaatgtattgtctttccaaaaactcatagggattttccagactaataccccatttctctagctgtccagggaaagacaagaaagactttgaaatctaacagctgaatttttattgcacttgggtataaatagatgtatctatgtatgtatgcgatatttcaaaatttcttttaactacagtgagtttatactttttccctataaaatgttttaccataacgataaggtgtcaagttattgtccagtattttaaaatgccaaacaaagtaatcatgtgactgatctcagagcataccttgggtaaattacttggtgctagtggcaggtctagaaattgcaaaggaaaagcaaacgaaggaacacagagccaaactcccaagtgtttcttaagtccatgcccagaaaatgtcatagcattgctcaatcagaattgctgaatcttcctgaaagatttggccatgattagtgctgctaagttctgttgtcaagggccatatgacagataacataatgcaataaagtaattctggccctaatgtaaaatgaaatgtctattttgaaatattgctatgaagttgggtttttcttaatacaaaggcatgaagaaaatattctgttgagtaactactgttaattatatgtgcacagcaaggatttttaatgggtttttaaatatcggtttcattgatcttggaagtagaaaaaagctacaagagaagtaaaaggtaaaaaagttaggccgggcacggtggctcaagcctgtaatcccagcactttgggagtccgaggcgggcggatcgcgaggtcaggagatcgagaccatcctggctaacacagtgaaacccgtctctactaaaaatacaaaaatttagccaggcatagtggcgggtgcctgtagtcccagctactcaggaggctgaggcaggagaatggcatgaacccgggaggtggagcttgcagtgagccgagattgcgccactgcactccagcctgggcaacagagccagactccgtctcaaaaaaaaaaaaaaaggtttcattctttgtatcacgcttagttatgtttcagtttagccatttagccgtggtatttcccagtggtctggattgacagtttcaggaaggagtagcaccttagaatctaaaccagtgactcactttatgagcttttccaaattacctcgatagtctcacttcataaatatgcgtaagtttctgctctgttaatagtgctgaatgggccgggcgcggtggctcacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaatagtgctgaatgggttggctctcttcactaccaacacaaaagcacccaaaggcaatatatgcttttaatttctggagaagtgtattagtttaagttcaactaaaatatctgcttaaatataatttatgtagtataggtaaaaaccaattgcattctgatacttacaagattgcttttatgtaaacagcagctttctgagtagcagaaggtggagaagtgaggcaaaaagaaggcttttttccttttcctatgagccttccaatggcaagagaattaccttggtaattacatggtggctagcatgtgacggctactgcccgtgctggatgtagatgctggttaacacacaataaaacaccaaggaaggaaggagaggcaggggtttgtgtgatatcatcagggtttgcttgagttgacagcctgaagctacccagtcagggctgaatcccaacaggaaagctaatcattagtttatcaggatgcagagagggaggtaatcagaaaagagagtaattctgtcattcttctgcccagactgtttgctttagcaacataaagctgtgggtgagcctgtgagctgtgactatgagttggtagctttataggtatttagaaacccaggactgtggaggcagaagggatttgctaagatcctgtcctgttggaacatcactcatggtgacctttttttttttttaatctgataaggcacattagctcatctctctttgtataagacatgaattagataatgaatggctgcccaaaggaagtgaggtggttatcacaccctggggattcaagagattatctgaggggtaaaggttaataaagaaggataatatcctttgtttgatcaactgttccatactaagttcgttagaattccagactgccttgatggcaaatgctacataaatgataaaactgtgtatgtactaatatttgactagggaattttttattctccatttagttaaatattgaggtcactttgtgtttttaataaaataattatcaacgatctatcattttacactgtgaagctcaatatttgcttgcttagccaccatcaatctgatataaaaagtgtaagagttgcaagtttttctctcatgacctgaatcaaaaagtaatttagaaagaggtcactgtgtcattcaacaaatctttttaaaagccaaacatattttgaccttttatttggatttgctacttgttaattgtttcagcagccttaacttagatcctctttgcagaacatagcttctgtcatctgtacaaagctgtatatgtgaaaattgaaggcaaggagaaggtaattccagctggcattccagtctggatctgctgtcataaattacttagcagagggcatggttcgttactttttatggtcatgttctatatttgtatgtgctggggggtggatcacatgacaaaaccatcatttgatattagtgtttatgtgcaccaaccagtgagggctcgattgaagcttcactgtgcagtacttttaatttgtatatttagctcttaattgaaaatgcaggcacttccataagtactaaaactacaaataatctaaataaattttatataattgtctttaggagaagacaaactgctgtaaaccaagctaattgaaatacactctgccttccagagatttgaaaacaaaattttgaactagctagtcaacattgccagaataataaagaccaaagtttaccattttccattttttagcccctcccctgattagctgatgtctgtttatttaagaggaaagacatttttcaaactaatcaagacagaggaaaaaaacagtctttttttttttttttttttttttttgttctattctccaaatccgttcccctagtgcagcttcatgcttaagtttatagtggcaaacacctcgaaaatgtccttcttgtttgatatttttttcccataactaaacaggaaaaaaaaaatgggcatgtcaggttttggttcatccactgctttgagaactagtgtttccatatctggaatcgtttgttagataaatttgcctgtaagtagttgcttcagatctttgtcaggccttgttcatcttacatactgcagccctctttaatttcctcaactccattaatttatttttcaggcttttctttcactaagtatttatcgcatgcctactctatagtagtcagagcacttagcacgtctgcatctattatttcatttgtatgagaacatactttggaaaataaggtcgggatgatgttatttgaacttcctcagcacctatgtagtagtctctgtcaaacaacaagtaacttctgaaataactgttattttagaaacacttctactgttatttttttgtgcatattttccatcccctcaacaagatttgcagagcctcagggatctttagagttgatatctctttgcttttctgacatattgtggtcttcacaatattttttattagatgccaagtttgatgagaagagaggctcgggttccgagtcacttgttttgtttgaggaataaaagctaggttcggccaggcacagtaactcacacctgcaatcccagcactttgggaggccgaggcgggcggatcacaaggtcaggagtttgagaccagcctgaccaacatagtgaaaccccgtctctactaaaaatacaaaaattagctggatgtggtgacgtgcgcctgtaatcccagctactcaggaggctgaggcaggagaatcacttgaacctgggaggcggaggttgcagtgagctgagatcgcaccactgcacttcagcctgcgcagcagagcaagactccatctcaaaaaaaaaaaaaaagaaagaaaagctaggttcatggattacagtggttcagggaagggaactgagtgaaggagggacattgtcgtttggtgatgctgttatcttttactgaaaaggaacttgatatttggaggtgtatttggtaaggacttagttatcaattgacagcataactggtaacatgtaagtcctggatcagccttgaaagagtattccttatgggaaatgggaagattagagaagaacaagcgagatagtgttggtgaggcatttcatttcaaaggtttgtttctcttacacccccttttactaaatgaatgccttggaagggaccacggaatggttcatttctagatgtgtggcgctaacgatgagaaatgacggcaaccagatttgggtgacagatgtcgctcaagccttcaatgattatagaatataggttctgggaagaatgtgctgattaaattcacatgggctgtggagatccagctggcctgatatttaaatgctgctgaaaaatgttccaattagatggattcttccctgtgcagagttttcatgtaaattgtggaaaacggtactttcttcaggcaatgaaattgttgtgaatgtccaatgtcagtcctctgaagatggtaattatgcagcttgaactacagaaactgcagcgcagaagaacttcagggtttatcctgtctctgtgcagatggaatctctatatagaataatgaccaacacatcacacaaattggatttaaatgacttgaacaacaggagtcccatcattttctttggctgaatatcctatagttgaatgtgtacaggattcctcttggatagtcataattggattatatttcccatacgagcagggttgtaatttgaagcttcatattttaccagcttgacagcaaattaagcacagacaggacaaactatacatcatacaaaccaagatacaactaaaatctttctgattatttaaaatgggaaaatgtggctccatgtcctgtaaagtggttaaaatacagtgtttacgttgattataagagttgctaatgaattctaactgcagtacagctcataaaaaagtctatatcataacttacctatctgaagctgatgatggatggccatagtaaataatcatcaataataattttatttgactctttagaatttgaaatgtcttttcatagaaaagcactggaccacccatatttttaaaatgttttttgtgattaagtgagagctcttgtcttttcctctcttgacagcatttctctggcctggacagatatgttcaaaatcattctgtaattctctaataccacgcttgagattggattatctttttcagaagtaacaatcaaagaatcacagcattctgaggctgtacccaggagtgcactggggagggctcccttggcactggtcttttcattcaacttttctttgttctgccatctcccaaggcttaaatgggaaaaggagaaagacgagaacaacgggaagtatgtgaggagagaggatagagaaagataatcctatccctgtggcttgtcagttagaatgagggagggagttgtgagctgatcatgtggctatgcaccttagaactttttcccacaatacttctctgaactgctttggtcttattttcttacttctttttttttttttttttttttttttgagatggaatctcgctctgctgcccaggctggagtgcagtggcgcaatctcggctcactgcaacctctgcctctcgggttcaagtgatcctcctgcctcagcctcccgagtagctgggactacaggtgtgtagccactcccagctaattttttgtatttttagtagagacggggtttcaccatgttggccagaatggtctcaatctcctgacctcaggtgatctgcccggcctttcggcctcccaaagtgctgggattacaggcgtgagccaccgtgcccggccttattttcttctttctttctccatcttttgcagcctccaaggcagggaagctgaagtgtaggtgttaattagtagcaaggcagtaatgaaaagagtgtaactgtgagatgcagggctgcctgcgctgttacagcatgtcatccggccactttcatttccttgacttatttttgcacctttattttgagtcaggttaccctaaacttagttgtttcctttacattgactatctgtgtccagtgctcataacgagtgctcaacaggagacaaaatgaataaaccatccaaaaccagccagaccccagatatttaagatgattaagatcttttcccaagatcacttattaaatgagtctctgaaaacctcctcttgtctttctgtctgtggaaagtcaaccctaattactttttacagtaagagaaactcaaggagtctggaagagggtttcctccccatatttaggggatgcacagaggagattcatacttaacaagatcatcattgaaacctccccataattatgtcctgacctatcgattgcttgtgaaaaaactattgttcccatgtatataaggaatagcatagatctttgtgattaattttgggggaagatctatttttcttgaaaagaaactgtgatttaaatgtaatcctgtcatttaggttgtttcatgtaactgttagtttcttcttaatgattacaatttttaactttgcttctgttctttgtttagttgttcaggtatgtcctaaacagagttttaacttatataattactaactttacttcttgcattttccacttttcatatatatgaaatatatataatatatataaatatattaattatatatcattaataataattatgtataatatataaaattttatgttgcttgggtcataaacatttactcttttagataggctgtatctattgcaatcctataatgacccctcggttgctttttttccttgagacaaggtcttgctctgttacccaagctggagtgcagtagcgtgatcttagctaactgcaaccaccgcctcccaggctcaaatgatcctcccgcctcagcctctcgagtagctgggaccacagacgtgcaccactacacctacttttttttttttttttttttgtatttttagtagagacagggtctcactaggttggccaggctggtctcaaactcctgagcttaagcaatccacccgcctcagcctctcaaagtgctgagattacaggcgtgagtcaccgcactgggcctctcaattactttttattcagaatacttttttaatctgataacattataaatatcccttttcgtgttgttgtgacctcctaccttccctaggaccttatctaatcaatcatttccttctttctctccctactggatccttctgtttagtctacaagccaaatgagttttctctgtttaaaaaaaccaaaccaaacaaaacaaaaacaacttccttcactgcctaaaatgtctctgtcctcctctttactgccagccttcttaggaacactctgtcctccctgatgtcatgtcctcacttccctgtcactttttaatctcctgtcctctgtctttcctccttatcatttgaccaaaaaagactttcccagtgccctgcttgcttcttaattgtcctcattccattcagcctccttgaagaatttttactgctgaccatcaccctcctcaaagtttttccttctcttgggtaataacactatgctttctgtctgttttacttcatttcttgctctgacttctcttcttccctctatcccttaagtgtacatattcctttaagattcattctatgtcatcagaagaggactttctcaaacctggtctctcccctgtcagtttcatccgttcccatggtggggtccgtcactcatctgctggtggtgcccactgtacgtctccagctgaaggctcttgctccacggccctgggcatgggtgtcctccaggagctcaaatgcagtgcgtctgtaccacacacacacctgtacgtgtgtgtacacacacgtctgtaccacacacacctcctccaaatgctgggctccctcattctttctcccagttgatggaacctcaagccacactgtctcttgaaccagaactcctaagtccttgtgacccctcctttcctccacgcctcacatccagctgatctctgagtcctgatgatgccctaaccaggagaatctatgggatgtgaaaacttcacttcattcccatttgctctaatttggaaaggaagggaggatgagagtgaagaagaggagaagggaggacggaagtaaaaatgaaagaaggaaaagaggcaaggaggaaggaaaaaaggagggaaaaaaggaaggggtagaagagagaaaggaagaagagaaaaagatctgctttttaattttttttttttttttttttttgagacagagtctcactttgtcgcccaggctagagtgcagtggcacgatctcggctcactgccagctccgcctgccgggttcacgccattctcctgcctcagcctcccgagtagctgggactacagtcacccgccaccacacccggctaattttttgtatttttttttagtagacatggggtttcaccatgttagccaggatgatctcgatctcctgacctcgtgatccgcccacctcggcctcccaaagtgctgggattacaggtgtgagccaccgcgcccagcttaatttttttaatataagggtattacaagcttgctttttaaaaatctgtgaaatgaagaaaagagaagaaaaacaatcccaccactctctgacagacactacagtatggcctcttcaaccagtctctgtctcaaagcttccgctcctccagcctgtcttccattcttatcatcgtaactgttgctacaaaacaaaccaaacaagcagaaaacaaagcaaatcaggaatgctgccataatccgttgcctatgcaatcagttccagactacagaggatgacagtcaaggccctttgcaacttatttcagcctctgagtcctctcctccaaaacttctcccccacagcaaatccattatcccaatcacattggacaacacaagtgctatgaacatgtataatgtgactatgcaagggcccaaaatgtccatccttctcttcctaatctgtatatttttcattttaacaggtgtagtgtattccataatttgattagctaggcttggagacaccaagaactgctttctctaaagctcaaaggccaacgagggcaaaagataaacctaaacctggtatattgtaataagggcattgtaataagtattgagctgttggggggccctaggtagcagtcctgaacactgcatagggattggggagttggagaagaggtcacaaggaaggggccccttgaactgggacttgcaagagaagcaggattcatgcatgagaaattgcgcctgacaaatggaagcgcctgaagtgtctttgctctggtattcacacaaacagattcaatctcagtccattctcccccaccccatctgccaagatgacttggtgctaaatgtggtttttttggtttttttttttttttttttgagacagagtttgctctttttgcccaggctggagtgcaatggcacaatctcggctcactgcaacctccgcctcctgatttcaagtgattctcctgcctcagcctcctgcctgagtagctgggattacaggtgcacaccaccacacctggctaattttgtattttttttttttttttttttttttttagtagagacagggtttcaccgtgttggccaggctggtctagaactcctgacctcaggtgacctcggcttctcaaagtgctgggattacaggtgtgagccactgcacccagcataaatatgtatgttttttaaacaagattgttgaattttattttttaatccagtcaattactttctaattctttttaataagcaagtttaggctgttcacatgtgctttttgatatgttatttgtcctgaagcccaagtaaatgtatgtttattgtagtcgttcttgctttttcttttaatttctgtggtttttatggcagattttaaactctatctctttctgaacttggccaaaggataaccttaagtaggctgatgttaacattttaacaataatatattccagaaaaaccattttaactgcttctatttatttcaattaactaagtaaacttggattcttttctaggaaacaaaaaaaacttttgttcatcttcagctgttcattatttgtaattattatctgagatcctttttgagattctgctaatacctgatagttccaagaatttacttgctaatttactaaccatttccattatattctattaatctttgcataacattctgattcatttgtttctcaagtatgtccttataaatctctgtctagttttgtttcctacagtggcaaaatggatacatttctatgtgacacacttttcatatttttaattggtcaatttttctaagtctgaaaatatccttctctgccttcaaagagcaaaatgaccctgggcaagtaccttctcttggccttgtcatagcttttccaccccatcctcccctcctccaaagtctaaggagagaaatctaattagtattccatgtcattaaataccagctctctttacctgtgatcactttaaagctttgccttggcctttctatttctttaaggtgacagacatgcatatgtaggggagttcgggcatgggaagtcacccaccactgagtgagtggctttctctggattctcatgatgttcgtgccaaaattctatttcagttcaataaattttctgttatctctgttcctaattttatactcatcacgatcctttcctttctgtccttcaaagcttgagcttccttattctgttttgtaggtgtattcgtcagctagggctgctggaacaaaataacacaaagttagtggcttaaacaacagaagcctattctttcatagttctggaggttagaagtcaaggcgtaggctgggcgcggtggctcacgcctgtaatcccagcacatgatctggccgaggtgggagatcgagaccatcctggccaacatggtgaaaccccgtctctactaaaaatacaaaaaattagccgggcatggtggcgtgcgcctgtagtcccagctactcgggaggctgaggcaggagaatcgcttgaacctgggaggcagaagttgcagtaagccgagatcgcgccactgcactgcagcctggtgagagagcgagactccatctcaaaaaaaaaaaaaaaaaaaaaaaaaaaaaaaagtctaggcatgggcaaggccacgctccctcagatggcccaagggaagaatctcttctgagactccctcctgacttcttgagggttgctggtaatctggtgtttcgtggcttgtaaatgcatcatactccgtctttatgttcacgtggtttctccctgtgtgtctgtctctgtgtctacatttcccctttccatagggacacctagtcgtacaggaccaggggccctccctactgcagtacgacctcatcttaaccaattacatctgcaacaaccctatttccaaataaggtcacattctgaagtacttagggtaaggacatcatcatatgaattagtggggggacaccactcagcccgtaacactagatttgtcaggcattgttctattgttattatctgtgtaatgcaggcgtcatttgggccagttgtttagcgtgtcctggcttacgccatcacatattcctctgtaccaataactgcttcttctctctctctctttggaagctttcatcgtgagcccattcagacctgctcaggtggagagttccaggcccatttgcccctttaagttgcaaaagtgtgttttcataggagtcaggctgccagttggtggggtttcatttattcgatttctttattgtttatgaagcctatcatactgtgtttgttgtgtcttgttttcttattttctaaaatcttacagataacaatacaaggagggattaccatctgtaaaactccttcccaaaagtgcagggtacatagatagcattcagcaattttcttgatttcttttttttcctccattgttttcctgtctaatttttgtggacagtcatatgaaaatctcggtgacttcctgagacttcacgtgcacacgtagaactgacgtaaaaatgaaggagcggcattggtgtgcatttggtcacactccagggagacatacccagattagaccaactcctcagggtgcagacaaggtgacgtcaaaggacacagttggactgggattcattcttacaatgggataaggcagggcttaggcccctgtgagaaagaaccaagtactggttcctaaaggaaaggtatgaaagacgggaatgcaaaccctcatggagccccagggccccttgatagagaattctcacatgcccagctccaccactgtgccacaaagccttccagaagcccaaccatcaaggctgctgagagattcctctccccggcgtggctgacaggggtgttttccccggcatggctgacggggttgttttcacaccaggagccaccagcccactgctcagtgataaggagcactcatgaactctgcacacgagcaccctgaaaaaacccagaggagcttgccctggatagagccccataggttctctcctgtgtgcttcttgtctgtttctggtcacttctgcttggagttgtgtgagtccagtgagaagagtcccagagagcagagtggcaactgctacactcccaagcttatgtccttggtctgccagcctgagatgagaactatttttgcagaccaaaatgaaagaccacggactcccttttttgttttttctttgcagaccaaaatcaaagacggatggactctatttttttggcagaccgaaatcaaagatgatgggctccattcatttcctttccagagctcttccctgatagcgaagatgttgtgggcagagaaagatagaaaagaatcatttccatagcagttgcacgagtctgcgtctgtgtattcagtgcttgggtggctcccccttctcacgcaaggccttgtcacaagctcctgtgtcatgaattgttggaacctgcagcctggctcaaatgaccacaggggtgcctctttgtcagacatacgctgtgcatctggcggcatcatgagggtaatgtgatatggctcacaattttaattttaacaaaaaaatacatctgtcagactcatttcagctgacaggataaatatcatatttcattgccagtttgtaaacacctcacttttcatctctatctgacatgtttcctgggtggtttacaaattgaaaaatcaaatggaatacatttggggccgagcatgtatgctatgtcagtcaagtctgagggtagtgtttatatggagccgggtccgtgcaagcaatacagaggtggctgaccaggaaatgtgacagtggcagatttgtcttatgtagaattgcctatagtaagaaaacccagtagagaaagtggttttgagaccattcggcagctgctttggacacctggagccatttcttttacagatgaagatgcattgtgtcattgtctcaggatcctcgtcctgttgcttctctggccacaaattgttctttaccaaagatgattttatttcactgtctttgaaaatcattctttataggtagaatatgaagattctctgaaatgattccaaaatgccaaactcaaacactattgtccgatttctttacttgcaacaagagagtagaagggacagtatttgttttgtgatgttggggcgttcatcagggagagaatttgagataagtagaatagcaaatagaaatagtgaaataactagattcccagtcctgggttttttttttctcagtcctgttataaacagtactgatggcattttatgtgaatatttatgagggaccttttaattaaaggatctcaaaattctcttatcacctgttagttaattttcacaatgtcatgctagagtgcgtgcatagtaatgttatatgccaagtacagatggagagatcaaagcctgcagatgttcagttacagaacttgccaagaacctgcagtgatcaactgggctttttccagcctggggcaccagcctctggttaccggtgccacccggctttccccagcttggtaaccagtgagaatcaggtctagggctagctggaaaacgacaggaatggtgactttggactcaccccaaccctttcctgccatgtgaactcccacctcccacccactcatcttcctttcttgtcagtctgtttattactctgagctgatttccactgaccccagaaaaggattaattgataactacaggggttagtaattattgacaaggtcacacttttccaaaaaatatatgcattttcaaatggaaatctaaatgccagccaggtcttccccaggcttggcttcctgctgtcctgcttcaaatactcttttccttcattgttaggaacgagagatgcataagaaccttctacagaagtagccctcaaactacctctccatggcaggctctgccaagccaccacttagcgcagaggcttctgaggatgaggaggggaaggatggaatggaagaaggacatcctgtttgtgttcccacaatccacagcactataactctcaaagggtgaaacagtgaacattgggtgtaccaattctgaaagcctaaagtccctcatacacaacaatcacctataatatatttgtggccaaacatgttctaaaatccagtaaaataagccaggcatggtggcatgcacctgtagtcccagctatctgggaggctgaggtcggaggaccccttgagtcttggagtttgaggccagactgggcaacatagcaagaccccatctctcaaaaaaatacgttaaacaaaccaatgagatagaaaaactctgcaaaatcttgggaagtagaattcaaggaagttgtgacagttgataatttaagctcaagcaaattttctcaagggaaaaacctagataaataattgacagtgggtcaggtgtgggggctcatgcctgtaatcccagcactgggaggctaaggcgggtgggtagtttaagcccaggaattcaagaccagcctgggcaacacgacaaaaccctgtctctactaaaaatacaaaaaaattagcccggcatggtggcgtgcacctgtagtcccagctactcgggaggctgaggtgggaggatcactggagcccaggaggtccaggctgcagtaagccaagatcacaccactgcactccagactgggtgactgagcaagaccctgtctcaaaaaataaataaataagtaaataactgacagtgttgaagcatggccaggatatcataagacaatcgagattattctttagaaatcagcctcaaaataccattgattagatgtttaaagcctagggatctaaacatgttttctcttacccactgttactgtaatccaaaggccaactgaagtcacccttccacttaggatccagtaagatgtgctggaaccctcattccgtgtcctgtggacatgccaggatatctggaagtgctcacacaacacaccgtcacggtcacccccggcttccaggcccagccactgcagaggactcagctgtgtcttttctgctcatggagccctgcagttctccttgattgcattggcaggaggcagttgcagttttaatagcaacctccaagcaaggaactcagaatcatcctctgtgtcccccactgccatcacttttcttgctcacctcattcattaactcagcacttaattgctgagcacgtactatgtgccaggtgctgaagatactgaagaaaagaagccatcctcgtgcctgctggaagccctgtcccttacctgcctttcggagccatctccttctcccatcccccttgctgtggacgtccccagtcgcttatcaagcccctgagaaacactcccaattggtatctgctctgacttggtgctgtccccctttccctgcctctgactctctcctccctgacaggtcagttattctaaacttccaactaggccactgctctgcattaaatcctctcagagctccccaagagcaaatgcctgtctggctcagcagcctcatcacccagaatgccaccaggtgggtttgtttgtttgtttgtttgtttgtttgtttttgagatggagttttgctcttgtcgcccaagctggagtgcagaggcaccatcttggctcactgcaacctccgcctcccgggttcaagcgattctcctgcctcagcttcctgagtagctgggattacaggcacccgccaccacgcccggctaatttttgtattttcagtagagacgggggtttcaccatgttggccaggctggtctcgaacttctggcctcaggtgatccacccaccttggcctcccaaagtgctgggatttcagacatgagccaccgcacctggcccagttttttttgttttgttttgttttgagacagggtcttacactgttacctaggccggagtgcagtggtgccatcatggctcactgcagcctcaaactcctgggctcaagtgatcctcccacctcagcctgcctagtagctgggactacaggtgtgtgccactatgcctagctagttttgtttgtttgtttgtttgttttgtagagacagagtcttgctttgttgcccaggctgatctctaactcctgggctcaagtgatcctcccgcctcagcctctcaagtagcagggacacccacttagttttattttaatttttgtagagatgaagtctcactatactgtcctggctggtcctgaactcctggactcaagtgatcctcccacctcggccttccaaagagctgagattacaggcatgagccaccacatccaacctgattcttactccatgccattcaggaaaatttgttgtttcctgagcatagcttggctttgtgctctttttggtatctttttctgctgttctctcagccttccccttcagatttcttctcatccataagtaataagcaaacacctcccttctggattgtcctacctggtgcaacccacagtcagaccagcagcctcacaagccctcgatggcttggtcccacagccccactgtaaccatttgttcctgtgaccatctcattcatctttgaatagctcagggccaggaaaatggtaattgtgataaattagtcatttattgtaattcttcagtgaatttcacatcttggttttaaaaaaaaacacactcatatcacaagcccacattcagctcagagacaaatgttaaatcggcctcaacctcagtttcctctgctgaaaaatgaggataataatactgaattacaaagtcactaagagaattagcatctatctttgtggaagccatagtttcaatcacatcagagcatctccttatagagctgcagtttgtgttagttctgttgtcatcaaagtttgcacgcgaagttagcacacttggtcttgaattataccctctggacatctaagggattcatgaacatgaacatggtgcacctgctgcttcatatctgttccacgaggtggatattctctcagttaataaggggcagagtcaagactaaaatccaagactgactctgatgcccatgctgtgtggaaactccactgtgctgaggggtctgtgctggcaggacgtcctaccattacccgttttgcctttggcccactccggcaaacacaggaaaatacctccaccagaaagtctacaaactaactttccttccaaaattaataaaattgatggccaccatgagccacagagaaactacctttaaagaaaatcaggctgcgtgcagtggctcacgcctgtaattccaacactttgggaggctaaggcgggcacatcacgaggtcaggagttcaagaccagcctggtcaacatggtgaaaccccatctctactaaaaatacaaaaataagccgggtgtggtggcacgcgcctataagcccagctactcaggaggctgaggcaggagaattgcttgagcctggtaggcggaggctgcagtgagccgagatcatgctactgcactccagcctgggcaacagagcaagactctgtctcagaaaacaaacaaaacaaaagaaaaaacaaaagaaaatcagaatacagtaactaccattcagtacagtttccaacaagcaacagtgttaagtcctcagagtcccacatggtgccccaaagggtgttgaatgaccaaatgtcccacagttggcattacccagtgtcagctaccatcacagggagagttaagttgctactacactcttccatgcacctctctgcttgcctgtttggattagcttcttgaaatgtgttgccttgccccttactacctagggttttgcatccattctctcatttaacaaacactagctgagattctatttgccagatcccagtctggagctgggaaaactgtagtgagcaaaacagatctgccctcctggagtttgtaatctagtaggtccatcatgatagttgtgccatttagccagatcttgagttctccactggggtgctaacgtcctccaaaagggcattttggaaatgcttgaggttgtcaaatacaggaggtttcttttggcatttggtgggcagatgccacaagctcagcaacacacaacacaatgcattatccctcctcttacttgactgtcacccactgtgtatgcatgtaagtgaaaaacatttttaatcatctgagcttagaacctaatttcattccatagtctatattaatatgcatagtaattttaatatatatcctaaattaccctggaatgcagctgcagtgcaaattgagggaagatgacactttattttgttctgaacttttaccatatgttattttccatgtcagaaaatggcatctccagatatctccaaaagacttcttgtatttgatttgctaaaacactcatctgtatgagtccacatctgtggctatctctttctgcaggattctatgtgcagttgcaactttgagactacatcatatcttcctggtgttgttgtggccaagcatttatgtcttgaaattactttccttttatttcccctttattttacaattagacaccatatggatttcttaaagtgatgtgtacatgtagtttatattatctgtgaatttctttcaggctagaaaagaggattataaaacacttgcaattttaaaatggagtattgggttgggtggggtgtaagtcacaaagctagatgttcctgccatggcaacagcacgcctttgcgggcagaggtcctgcccatgagttttcggttgtagtcctaagattctgcatgggtccaatcagaacaaacagaatgagagccttggagaaggatcctggaggcctcctattaggccaggattgctggagtttggggactttgagaagtcctggaagagagactggggcagccagggcagcagggggtacccaaagggcttggaaagtggctgtttgccaaccactataaaggatcatggcgccttaacagctggtgaagctgcccttgtgccctttggctgaatgtcagctataagctcagccctcctgctgacatgtctgtttcccgtgcaagtaaactcttcaggctgtgcccatagctccactgggtaaaccacaggacgtgtgctactaaaagaaatctgtttctctttcattcttcttctgccttgagccggtagaaactcagtgtcattaacatcatgtcccagaaatgtgagtttctgatcctggggttcttctagcacccttgcattgaacttgaacagcttttcccaaggactgtcccccaacgcccccgagattgtcagggtgccccatctgttctccaccttttccagtatgtcccagagtcatgtaagtaaattgcctgagattctcaaaaagagatgacctaagtttccaccccattctaaagggcctgcattgtaagcatgtccttcttaccgcatatcgtgggcaccatgttctcagttctttcatcagctacagtgtttaactcagcaataattattccatttcgtccagctatccatgatatgctttttcttcagtatttgaggtcagtaaaattgcttgaataattacaataatagcagctgtcatttttagtcctctattgtgtgtcagacatgatgcacatattgtcttatgtaatcgtcatcagaaccttacagatgacataggaagaatactggggctcagactagtgtgaacgatacggtttaaacccagatgtttcctgttccgaagccaatgctttttttgttttgcctaagagtattagctgtgggagcgagacatatctgggtccaaatctcagttctagccagatgatcttgggcaagttactaagtatttcttgatcttgttccctcactcataaaacagggataataatgctaatgtttccaccaaagttttatgatgtttacataatatatagaatacaaagtacagtgcgtgatttatagtaagcaatcagtaaattttcatttcttccctccccgcaaactgatcttaagatgatagtcatcccacaggactctcagatttctgcgggcttcctcgcatgacctgctgatgaggaccaaataaatcccattgtctatccagttcagctgctcttggccccagccttgtccctgtgtttattctggaaggagtacttaatgtgccaggaggaaggaaagggtttgaccttactggtctttgcaggaactgtgttctgtactttgcagtacccatgtgcgatgctggaaaggtacatcttagaaacgcagagaaatcttctataatcaaccatgggaaatggttgtctattttttctctctataaatttcccaacttcttgtgatgtttgccagtggtggggtgcatgtattttgattttaactttgtattttggggtcaccaaaaaaaatcaaaacacaaataagtctatgggctggaagtcagaaggagcagaactgagggaaggtaactgaaagagaaaaacaagattggtgaggcaccagagggtctagcaggaacatggaactgcagctggcaggctttattctgtgctgccgatcagcagcaggcatattatatcctggactatgtgccggcgtccaaagtggctggaattgaaagtgaactttagcctatgcgtggctgaattcaggtcagccagttggggggaaaagcagcttttatccctgtccacttcctgatttctcctcattgatgttccatactccgttctgatcagctgctagcatgtgacaggctggctggatcaaacagcatcaaccaaatgttcagtcaaacgttgtagtcagctaaatattttcacataagccttttttacattaataaaatctcccctcctcctctgacccctttgtactgcttcactcctttttttcatagtacgatatccctaatatgtctgttgtttactgtctgtttactgcttgtaaaccccaaaggaaagacccattttccccacttatgtatcgcaagtccctaggactatgcctggcacctagtaggtgctcaataaatattgtaacagataaaaagaacaagaaaacatgaggtcagagttagtggatatcaggcagaaaaaaatgtttatgaaggaaaacagaggaggacataaaagacaatatctgatcattttcttcacgtgtgaataaaaaatctgtatcaaaacaagataaactattaccttctttagagaggtacattttatttccgatttacccagatcacattggacttttcagaagcttaatttttatttgtcacttcagtgttagtttgtgtattcattcacttgttcattcatgcctgttacatgacactatgtttagtataaaaatgcaagctagaccaccagcatccactcatataacccaaataagccacttaaatagtgcacctctctctcacctcaatttgttaagatatgatagagatgaaaccaaggctaaaggttgtttctctctacaggccaacaagttttaggatataatgagtaattgacctgggaaattaaacaaaaataatttcaccgccaaccacagactgtacccataatggaggctggctgtctcacagacttttgctgctggccagagtgaatgactcagcacaagtcaaccccaggagagaaacaatacagagctcacccctggctgattgagggccagaagcgccattcttgtaggtgaggaacagagcatgtatacactgtgttgttctgaattggaactgaattgtactgaatacaggaacatatagcacatttatgaatcatgtgtactggattgaaaatgtgagaagatgctcccaagcaaagacacactgaggagtggagaccagaaaggaactgagctgaggagggggcaaaaaaaaaaaaaaagcaagcccattgcagctgcactgcagatattactcatcagttgtggcccctgggaacacctggttgagggcagccgaaacagtacgtctaaatcggaattcctggtctttgcgctaaagcctgctccttctgccatttcccccatctcagttgatggcgactccatccttctagttgttcaggtcagagaccaaggagtcattcctgactcctcatttgctttgataccccacatccggtctaaaatctacttttcacaatctccactacattcactctggcctgagctgccttcatctcttgtcggaattattgcagtagtctcgaatacgatgtccctagttctgcgtttaccctccaataatctattctcaatacagcagccagagcgatccttagaaaagaaaaccacatcatgttattcctctgctcaaaactccatggtgatctccgctttattcaggataaaagccaaaatcctttcagcagctcccatgattggtgccccaacaccctgtcattttctgtctgacttcaaaccctggccctttctccctcagtcgctccattccagctacatggttctgcttgctccttaaacactggaggcacattcctacctcatgatctttgtagtggccgtttcctctctctggggagcccttcctccagatgtctacatggctaatgccacttccagatatttattcaaatgtcaccttctcaatgagacctgtgctggccatcctattttaagtgggaacccaccccccatatatatttctgatcctcctcactaggttctacctttttccctctatggtttttaacagttaacatgctatataatttagttatttatataattatttatctgcgtctctctccccctgtgatggttaattttatgtgtcgacttggctgggccctggggtgtccagatatttggtggagtattattctgggtgtttttggatgagattaacatttaaattggtagactgagtaaagtagattgcgcttccaaatcagttggagtgcctcatccaatcagttgaaggcctgaatagaacaaaagtctgaccctcccttaagtaagagagaattcttaccgacagcctttgagctgggaaattgggttttttgttttgttttgtcccctgcctttggactcgaattgaaagatcgttggctcttcctggatctccagcctgccagccttcagacttggactggaacttacaccattggctctcctgggtctccagccagctgactgcagatcttgggacttgtcagcctccataatcacatgggccagatccttgtcataaataaataaataaacatatcctattcattgtgtttccctggagaaccctgactaatacatgccccttgccacttaaacaaaagagggcagggacatcagagtgctgtctgtattgtttactgctgtaccccagcacctggaccagctctggcacataaaagtcaccagtatatatttattgaataaatgaagaaacaaatgaaccagcaggtaacaaaataactctctttaccgataatagtgagcacaattatctcattttattacacagtcatgatttataagctttacatctaagaactgagtcaaaaatcaaagaatggtccttccagcacatgcctcatagaaagtagttctggttgtacatcacgtttcatgctggatttatacacaccgttagccacactttccctttggggtcaatgtcaaaatccaggctcagcagtctacaagcactgataaggcttggagtccatgggatttatggcatatggagctatgggactcctctggacttggaagtgaccaaaaatcccccttggacgacaaagaagcatctcagctcaagactcgaagatgaaagttcattggccgtgagtgtgtgctgcaaaagaaaaagactgcaatttagtggcttttttccttaaaaagcctgctttttcacacaagtttaggtgtgtgaaagagaaagcaagaaaatacagagaaagagacaggaaagagactgtaactgtcaatggtgggagttgttagaagtggggacagggctggccaacaaatgacctgcagaaaagacagcaacagaggacagaatcccagtgcagtggggggatagctatgccagcagcccatccagagatgtttatagctcctgaaagcaactgctgtgcatgcgtgtgtgggtggggggggggggtaagtcagggaaaacaggctgctttacctctgttaaatgcccttgaaagcatctccatggttataagtgagacaaccagagaggaaggggcaaatgaatacacagtgagcagcccagcaggcctccatgaaaccctgaagctaccccacaggcctcttatagcagcatctccctgggtctattcacagaataccagttccttagaaaactgtgggtgaaattaaaagctccgtggatcaaaaagcttgaaaaacatcaggttacgcaaagttaaacaggtttctttagtatcttgttcagtattctgaagtgaattgtgggccaccaaaagagggggcgccatatgcagaagcctcccaaccctgttgaccaggaagcacggctcatgttgagctactcaccaaatgagctagtgctctatgggatgcattgctctgttttgtttttttttctttctttctttttttgtaaagatgcagtctcactctattgcccaggctggtctcaaactcctgggttcaagccatctgcccacctcagcctcccaaagtgctgagaatacaggtgtgagccgccactcccagctgtttgctcctgagaataacaaacaatggaatcttaggaagatgatgttacccttaaaagagaaagcagtttccgattaaggatcactggagctaagtatcagtggctcggtacaataatggctcatctaccctgtgggatatcttaacactcacaggggagttgttgaaattctttgcatctgctgagtttgaggtggaaactgtagatttacatcatttcagccacgttctacataaatgaatctcagagaaaagatctggccatccctctaccatgggccacttaagaggagagagacagtgacccagcaaattcagttgactgggctgggaacttcaaatggtggatttggtagtttaaactgagatttatcatttgaaagtagagacaacagatgaaaacctatcagcgtggtatttggcatatagtcaatgcacatcaaatgttgacagaatgaaaaatgaattgcagttcagaagaatttttttcttgctatttcaaagaactaatttctgatcactatacattgtcatagattttataaagctgatgaattcgattggtttcagcagttttctccaatttttgtccctagggattactagtgaagtccctctgggtttaagtaaagctcaagtgagaccctctgctcctcagcttttatgtgcagaatctcacaaagtgaaattataggtgattataaaattcatcgctgtcagaagccagatgatacctccctgatagggtaagagttggtatcttctcagctgaaccagtaagctgaaataagaacaaaatacaaaatgagattcttcttagccacctgatctgttctgttatacttactgtagacaactaggttaagctttggttttcaacttaattttctctccaaaacgtctggtttctctctgcagcaattttgtatgtcgttatttgtcattgcctagtattgatccactacttccttcctggatctcaaataattcagctaatcccatgcccctgccatgaatccagcattttctggaactcatgttgtcaagttcccttatacaagggaaatacactagagcttcctctgtctcccatattcattagttggctgcacactgatgcatgaatggaaaagatatgttttctctgactggactgttagctttttgcactaccagtcaagtatctatcagaacaactgtaatgaaaactataaatctcaacctgagggaacagttaatgtgaagggttttcttgtttgtttattttgttctgtttttatggtctcccaagccctggtgtggcattaagattcaggatatgagctattgtgaggctattgtaacatcgtgggtcattgtgttaaacgtttacatttccattcaacttgacttttcctctcacataacctatccttcggaaaagtgtcagacattgacagcatagagaaaattgtggcccacacatcatgtcaacagaactgtgttcttgttctgatgtataacttgtaggttttagagtgagcactctctcaaattctgcagcacaaaatctagaaatgatgagatgggaatcacatctgtgaacaatggcaaagacaaagaatagtaagtgggaagtgacaaaaaaacgtgtctactgttcattgtgtcagtggccccaaaatcctagagaagactttgaatgattctgacaagttaaaatatgttggtaatgacaacgtagattattatctatctgaaggatacaaaaatgacttcagagaaggcattttaccctatgatttgctgaacacttttgcagaaaagacattgtattaaaaatgcccaatttgcaactgcaagtgtattgttctacctttatagagcagtagaacaatctcatgtcaaacttcagggctgccccggaggtcttatttaaatagttctatgtcccaggctccagatctcttcctttctcctgaagatgtcagtaaaggggcatcgtaatgatgatcctgggcccccattaaacattaaattaaattataaatgggagcctgtcatcattattatgtttttctgtatgtctaaaatagcttgttttattttattttatttattttatttatttatatttttttgagatggagtcttgctctgtcgcccaggctggagtgcagtggcacgatctctgctcaccgcaagctccgcctcctgggttcacgccattctcctgcctcagcctcctgattagctgggattacaggcgcccgccaccacgcccagataatttttttgtatctttagtagaggtggggtttcactgtgttagccaggatggtctcaatctcctgacctcgtgatccgccctcctcggcctcccaaagtgctgtgattacaggcgtgagccaccacgcccggccagcttgctttaaaaacaaaaactattactgaaaaaaaaaatgtgccaatgagattgttgaaagattagcattaaaaattaaaataagggctttaaagtggtggctcacgcctgtaatcccagcaattttagaggctgaaccgggcagatcatttgaggtcaggagtttgaaaccagcctggccaacatggtgaaaccccgtctctactaaaaatacaaaaattagccaggcgtggtggcacacgcctgtaatcccagcaactcaggaggctgaggcaggagaatcgcttgaacccagaaggtggacgttgcagtgagctgagatcatgccattgcactccagcctgggtgacagagcaagactccatctcaaaaaaaaaaaaaaaaaaaaaattaaagtaggagtttatgcatgttaaaaagcttctccctgagataccacgacaacgtaactatccaaagcaatgcatcctctgaaagaccaagtcaccaggttttatattcttgaagaatgatttttagataatataagcaaatatagctccggcacggtggctcacgcctgtaatcccagactttgagaggctggggtgggaggattgcttgagcccaggagttcaagaccagcctgggcacaacatacggagacccagtctcctcaaaaaatcaaaaacttagccagggctggtggcacatgcctgtggttccagccacctgggagggtgaggctggaggatctcttgagcctgggagattgaggttgcagtgagccaagattgcaccactgcactccagcctgggtgacagagtgagaccctgtcataaataaataaataaataaataaataaataaaagcaaatatagtatataaggaatataaggaacataaagtttagcaaccctaaaataaggaatatatatgaaccatcaagtcttataaagatgtaaaaatatttcccaaggaatctgttattattcaatataatggcaactgttgtaaaatcatgtacatgagtggtgctcactaggttttgcaaacattttaaattgtttaaattgtacaagtgtttttgaaaatatctccatggacgtattctgaaatctccaaaatgttcctggacagtaaaaaatttttatttaatgggactcaacaagaagggagctagcctagggaaatacctacaattgcaccaaagcaaaagttaactcagttgaacatttctgatttgtaaaaaattgctgctgactttaaatggtgaaaataattgcttcaattattagaatgtgtccaaatatatatgtgtgtgtccaaatatatatatatatatatatatatatatatatatatatatatatttggagacggagtcttgctgtgttgccaggctggagtgcagtggcacgatctcggcttactgcaagctccgcctcccgggttcaagcgattctcctgcctcagcctcccgaaatactgttcctgatttggataacctttgcttgagaaaactttattcttcttcacctgtataatttattctggcaacttccgaatgtgttttcctaaagcttcttccctgattggaaggaggtttaatattttgtgacacatgcaaacttaacagcccctatgtgaaatattttctacttttgaaggtgtgaaactggttaaaatgttttaaaacttttcccttaattgcaaaggaaatgtatgtacatgttagaagatttagaatatatagataagccaataaaattaaataacagttctatgttgacactttttgatgtatatctttccatacattttctgtgctgtgcactcacacacatacacacatgcatccaaatggaataaactagtgaaactttacacaaaaacacataagccaaagtaataatgattaatatttggtagtgtggtttactaatacatactgcttgatatgagctttcttggaattttaaatgtaggtggaacccaaacctttttcaaaattttactttaatgcttttaagtttgagttgtagtggtaatgcaaatgtcattaccttgaaatcattctttctcaaatgatagagttctcacaatacacgccaggaacgtactgatgggattttatttgtgtgcttgtttgttttcattgaactgtttgaattaaactcttagaatcattcttatggtttgaatcgccattacttaaaaagtaattattattatttctgaaaatatctccagtaattacatctacacttgatcttagccaaaaggccgagaagcaatgaataattacatctacgggaaaaaaaatgaacaccaacttttagcactactttttttccatgtggtggaatgcagaatgtttattgtttacttatgttttacgtctgtatttttcagtgtttcacgaagagcatatattgatttttataatcagaaaaagaaattcgttaaaaagaagtaacaatgactgaaccattttccacctgatacagaactacatgagaaccatgggttccagaaataacaggcctattttgttttgctcagtgatacatctttgaggtcaaactcccagagtttgtgccgtctcttacaaaacagcctgagtgggaatctggttttcctttttgggtaaagtttctacaaagcttgctgataaaactcatcttacttttgcaaaacaattcccttactttgggagccaaacagagatgaagctgataacaggactcagttcttcaactttaaagcagaagctagggtcataaagacatggagtcctaaaatactcttccaaagtacagtcgcatccagctaagataacccttggaaacgtttgctgaaaacatgcagtttgttcatgcatctcttccatgttggtcctttccaccttctgtcacaagccacagaaactaggggaaggccagggagcaggttcagctcatcttcacctgaattctgagaaattattgagaatcaaagaaacctcagtgagacgttaacaaaaagtaatctgagtgacatctatgtaaaagtcattgcaaagcacactagctgctagacatatctggggagctaccaccaatgcactcccttgacagaaaaccaggacacctcttagatgagctccttctttagtggaaaacccttatgtaattttaattgacatcaatgcaaatcagcctgtattgattgagtgtgcctaatatacgcttaatactgaaacaagttgaagtacctctcatagaccccccattgacttttcgtctgacatcccacacaaccagctccagctttgatggaagtcacaccatcactctaatgttctcttctatttttgattcctgccttgaaagtcaggatgaactggtgaagataagacttctttaaagtacaggagaaatctattggcacagaataaaagcactaatgtttattagagttgtgcaaatagctgttgtacttagttctgtcaacattgcttttttttttaatgatgacaattcttcacataattgccaagctaaagcaaaagaaaactttctcaatctttatgatgctttcatcagataaccaatataaagtatcttccagaagactctgtctcctcagactttagagtttgttctagggaagttagagataaacaaagatggccttaataaatctctctaatgttataaatatacagtttctggttctttttccccttggggcagtgggccaggtatcatcaacaatacagatattctggcctttctcaaaaatgtcattacattaagaacattatgacttagcaaattgttggagaaaattaggaagctttttttagtagttctgccatcattaaaaatcagctgccttctggggaaactgatgccacacctttgatcaggtgttgtatttggactgaaaacaatcccccaaagaaggagatgtttgctttctaaagaatgaagctccagggagggtatttaaaactgatttttggcagccattaacaaacaagcatgacataattgtatttggggccaggagtgtttagaggggtttttgtttgttctattgttgagaatttggaggtaaggagtccctgaactgccattacccctgcattggtttgctagggctgccctaacaaagtaccacagacaggtagattagaaacaacagaaattcctcacagttctggaggctggaagtccaggatcaaggtgacggcagggttggtctctccccacgcctcctctgtgtgtgtctctgtcttcatctcctcttcttataaagacaccagtcaggccgggtgccatagctcacacctgtaataccaatactttgggaggccgaggcgggcagatcacaggttgagaccagcctggccaacatggcgaaaccaaaaccccgtctcttctaacaatacaaaaattagctgggtgtggtggcgtgtgtctgtaatcccagctacttgggaggctgaggcaggagaattgcttgaacctggaaggtggaggttgcagtgagccaagatcgtgccggtgcactccagcctaggcgacaagagcaaaactctatctcaaaaaaaaaaaaaaaaaaaaagacaccagtcatattggattgaagcccaccctaatgacctcattttaatttaatcatttctttaaagaccctatcttcaaatatggttgcattcccaccatatttaagatcctttctccaaatatggtactgggggttaaggctttagcatatgaatttggttggggggcaggtgcacagagtgcagtccctaacaactctgattcaaggtcttttcaccaaatccataagccctttgctttgtagttgtcagaagggaaagagaggagacaggaagatattcatggcttttccacaagagctgactagcttctgcagcaaatgtttttgtttttcccctccttcagtaatggatagctaaaaagtccactgggaaccttgagagcactttgctttctttccctgtatttctttgtttcccccaaacagaagtgtgcctctgtccctcagcatatgtcagttaggaaaccactctccttgtgtttgcatataagggatgggaaagagctagtcagtgaactcggccaatcagaggctttgtaactggcagataccttggagaaaaccagccacctgttgtgcacccacagtatacctgaccctttaccaagcatgacatgttctctcatttactcctcctaacatacctgtgaagcaggtactgttgtcaaccctagcttgcagatgggacaagggaatcttggacaagtgtggtaattggtgtaaagtcccagagctgagtacactgtggagcaaggatttgaacccaagaagtctcattctagaacctttgctcttaatctcttctaacacctttccctagtcttattggtagagaagaaacctgtatgtagagaactaaccatatttttctcagcacccagtatcgagaattgtctcagggcctccccgaagacctagcttccagttccagctccactaatcattgctagctggtcttgacatagtcaattaacctctctgagctcgtattccatatgtaaaataggagaattggattacggccatgtttctcaaacttttaggctagatccataaaaagaaatacattttatttggcaacccagtacacacacaaacacacacacacacacttcataaccaaaacaagtgtttaataccaaaatatccatccttattacatgtgaatgccctctgatattttctattctaatctattttcatgatttttaaatattaattgtgacctattctattggatttgtcaaaaagctgaactaggtgacccagtttagactcctggaatcctaaaatcctgttaatctatatagatgtctgtttggagcttctcatatcttgaatgcatatttattttaaacaaatgaatatcacatattacaggggacaacatcctttttacctctggtatgagttaactgcatcatggaaataataataattacttctatttattgtgtacctcccatgtgccagggctttaaaatgcagtatctcctgtagcctgtaggtggtaggtattctctctgatttatagatgaggaaactaaggatctgattaagtaatttgctcaaggccccataggcaccaaagctgtttgaaccaaggccattctaattccaaagcccttacattcaacattcttttcagaggagggtatataaaggggtttagaaggagaggtaaagtctaaaagctaccgcagctgcacataatttatttcctaatagtttgctgtccgtggcagaaatgactgccctctggggtgtgaagccaccgctgcagcaatgattgaaatcacctgggaagcttaaacaatcgccctgccctcacccaggccacccccggacccgttaaatcagaattgctaggggtggaacccaggccttagtggtttttaaaaaccccaaggtggttctaatatgtagccaaggctgggaaccattgctctgaaatctcagaaattaaagagctgtaaggagcttttctattttacctcctgcaaacaagatttactaaaatactgcttaaagctctttaactgcttccacagagctgaagtacaggacctttgctgtttctttggagcacacacaaaaatctgataaacaaccttgtatctgcttttcaacacacctagagaaattagagaatgctaaggatgtagatgaggagatgtttaaagcaactgtggtattctggagaatctagctccgagatactttataactcagctcatgtcattttgtttttcatttcttatttttacttatttacatattttttcagacagagtctcactctggcaccaggctggagtacagtggtgagtcacagctcactgcatctcaaattcctgggtaattctaactctcccaggattggagtctcctgagtagctggaactacaggagcacaccaccacagccacttcatttttcacatttttttttgtagaagtggggtcttgctgtgttgtctgggctggtcttgaactcctggccccaagcgatcttcccgcctaagcctcccaaaatgttggaattacaggtatgagccaccacgcccagccagctcatctaattctgaaagttatttttgtatgaatggagaagtcggttgctgaattagcagaattgagtgtgacctgtagccataggcgaagtggactggggacaatgtagaatgccaacaaagactaaagtcactgtaaatatgataagccatcacattttcttaaaaagggctgggtgtggtggctcacagctgtaatcccagtactttgggaggccgaggtgggtggatcatttgaggtcaggagttcaagaccaacctggccaaccccacctctgctaaaaataaaattatctgggcgtggtggcagccacccgttgtcccagctactcaggaggctgaggcaggagaattgcttgaacctgggaggcggaggtcgcagtgagccaatatcgcgccactgcactccagcctgggacagagtgagactccatctcaaaaaaaaaaaagggttgcgggggaggcctcagtgaaagatttccactttttcacatggattatggcaactgtggtgaaaccaggaagcctctcccaaagcattttccacaggaataggatgaagtcattttactaaccttccggtcttacccaaatttataccaggattattgcagtgtgtgatctatttgccatttgaaatataaatgatcaacactcaatttcactgtcttccatgaaggagtcttcaaaatgggggctgtgccatactgctgggttttttccacatctcaagccacagcattaataatgttaaaaatatctgcaattttcatacttcagacagtaaaagcacggcattaccataaccaagaacaaatgcatgctgttctcaaagatgattatatgtttcttttagaccccttaacagacggcaggtcctgaattctcctgcttaggccaacatggatagaggtgctatgcgtctgctctgtctgtagtaaaagcccccgatgtttgactgcttacagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtggtgagtccaggtgcaatgttgcctcttcacctcatcacacgtttggagtatttaggagaactagtagcttagctaccttcacgctccttgcactgaaggaagcttcttcctgggctgaatgcatccactttctcctaccctgtttaaagttcaagctttctgttctgagatactgtagaaagtgtttttatcaacctttacagagcaacatgtgcctcccactttcaagtccacgcgtctccattgcttttcttcttctttaaggcattttctttcttatcctatttttttttccttctatgcttgggtgacggtcctgttttctcagtctcccaaacctggtccttatgtcaaggagatgaatgacgctgccaccttttacactaacagggtcttaaaggactacaaacacaggtacgtaccttcctttactcaccaaattttcagttgattacttgttagacatttgtccctaaaactcagtccagttaactactgattcctttccaaggctctacactaatgtactataaactttaaaggaaaatctaatctttgcagataaagtcaagtggaaagtggaatcaattatccagataatatatgggttttagaaagtctgcctcagttctctcataatgaataaactctccccacttgaatgcatgtcactatcttatgtattcccacaataatcagagagcttggtgatggaacaaccctatatggtacagaacctttacatgcatcaaagtagagttggagggtgagctatagaagagaggaggaatcaggaaatgaagtgtgaatcaagaacagaaatgaggtgaaacaacaaaccagagcagtgagaaggaaaccagagactcagttaatatgaaatacaactggggtgtacgcagagacacctggaagactagcagccattcagagtgctgctgaaagtatagatgagtctaaaccaaggggctttgcctggtgaaccagcgtgaaaggaccttgcgttcgacagcacaagtaatagatcccagagtaacttaaactggagtcagaatagaaaataggcccaaacggagacatggcagagctgaagaaatatccaggaaaatgtgtcctaaactatttaaaggatatcatgagattccaacccctctgataaggtcgtgccttgtactctaaacagctggctaaatgtgatgtggctggtgcctaggaactaagggaagggatgaggcaaatataagagcaacaaggttctacctgcttctggccctggactcaagagtggatctccctctgagctcttagatggcagcaacagaagtgaccattggtcagcaaatgcagaggcacctggggacgtctcatgtgttgacccagactgttcaggtggaaggaaattaaagaacctgcattattggattattgcttcaattcaccttctttttttttttttgagatggagtctcactctgttgccaggctggagtacagtggtgcgatcttggcatcttggctcactgcaacctctgcctcccgggttcaagcgattctcctgcctcagcctcccaagtagctgggactataggtgcgcaccaccacgcccagctaatttttgtatatttagtagagacggagtttcaccatattggccagatggtctcaatctcttgacctcgtgatccgcccacctcagcctcccaaagtgttgggattgtaggcatgagccactgtgcctggcctcaattcactcctttattttactaatgcagatctgaaaattagaaccagaagaaaagggtctacaacaatataagacaaattttatatggaatatagaaaaattgcataaaatacataaataaatacctagtatacttccaggccattaattaatattacatattcaaaattttcatcactttttttgtagatttttttatttttaaaaatattgagtagatacaaaagaatatttataaaatacacacgagatgttaaggattacaatataaaaaaatacctatacatccatccctcaagttaagaactatgtaacaatatttttttactataaaaagcagaccaggtgtggtggctcactcctgtaatcccagcactgtggaaggctgagacaggtggatcacttgaggtcaggagttcatgaccagcctggccaacatggtgaaaccctgtctctactaaaaatacaaaaagccgagcgtggtggtgggcacctgtaatcccagctactcaggaggctgaggcaggagaatcacttgaacccgggaggcggaggttgcagtgagctgagattgtgccactgcactccagcctgggtgacaaagtgagactccatctcaaaaaaaaaaggagccatatccagcaattccactcctaggtgtatttccaaaagaactgaaaacatatgttcacccaaaatcttgtacacaatattcattgcagcattattcataatagccaatagatgagaacaacccaaatgttcatcagctcatgaatggataaataaaacatggtatatccacacaatagaatattatttggccataaaaaaaaagaatgaagtattgatacttcattcttttattcgggcagcagcatggatgaaccttgaaaatattgtgctaagtgaaagaagccaggcacaaagactacatattgtatgattacatttatgtgaaattccaggatagtcaaatctatagaaagagaaagtagattaacagttgcctagggctggagaaatttagggaaaacttaaactttttaaaatttaagtttttttttaagtttttagtttaagtttttagtaatgattcccttttggggagtaattgctaatgggtgtagggtttcttttggggggtgatgaattatgttctaaaattgattgtggtggtgattgctcaactgagtgataactctgctgagctaaactatggaattgcacactggaaatggttgaagtgtatgggatgtgaattgtatttcaataaagctgttttatttcaaaaaacaaaaagaaaaacaaacagccattgtattcccctcacagaatttagtcgttccatgttgcttttgggaagaggagctttagcagacagaacgccgaattccagggtcttcagtgcgcctcttttcctcttaggggctctgcccaccccgagaaaactttggttaaaacagttgtgctcagttacagactttttgcatcaaggcaattgtgcccaatgatatgcctccaaatgttgccgtgttgtattagagactttagaactgtgcggcacgcatgagaaaggcatcagaaatgcaagatggtctgttcttctgacataaaaataacatttcagaaaagagcaagtttcaattcccaaacctggatatcatatgacagcatgaacatacacccatggtgacttcttttgttccagatatacagacacacacctacacatgccagttcaggacagctcaagcactacctaggtttctgcctttttaccttccacccttggagactattttaattagtatctcagttcatcagctcctgtccttctcccagtccctccttgagtatatgttggggctgtgggtgtgaggggttctccccaggtagcagcatagtcaaaagggttgggcttttctacatgctttttgttcacaaagagggttcagtatttgcccctcagtgttaactctagcaattaagtagaaaatgtacttccagtagtaccaaagatgactcagttaagctcagtggactacctcaagactgtacaagaagccgaagaaatgcagctggaagtgcaaatgcattcgttttactgctaggagtagtcaaagcactcccaggtcacccttgagcttctgaaagcggactaagcagcatactccacaccatgcaacacccatttaccggtggactcaagcccgtggtgccgtctctgtgtcgcagtcatttgtgcgtcactgctgcccactgggcagtaggaccgtaggtagaggagtagaaaggcagacttccttgaggtttaaacaggactgtgagcagtgaaatctgtatctgtgcaacgcttaccaccagcttgactgctcattggctgtttttctctttcttttttattttttttgatacagagtctcgctctgtcacctaggctggagtgcagtgacacgatctcagctcactgcaatctctgcctcccgggttcaagcagttctcctgcctcagcctcctgagtagctgggactacaggcatgcaccaccacacccagctaatttttttgcatttttagtggagacggagtttcgccatgttggtcaggctggtctcaaactcctaaccgcaaatgatctactcaccttggcctccgaaagtactgagattataggcgtaagccaccccgcccggcctggttctttcaatatatgaatacagcaagtcatttattttagctttatagaggtgtggtctctctgagtcataatcattaaaattcacattcccctaccatagcttcttccagagtatatgaaaactgaagataggtttgcagctcctaatgtgtatttgggtcctgctcaatttgttaccccttaaagactgatttcaggtaaaagggcaccatactcttagtccttattacaagttttgctagaacgttcttcaagtcaaaataatactgcattggttaaaaaaaaaaaagaatttgcccatatagacttgaatttcatccactgttaaattttttaatggaaaatatactgaatcagacatggtggctcatgcctgtaatcccagctctttgggaggctgaggagggaagataccttgaggccaggagttcgagaccagcctgggcaacatagtgagacctccatccctacaaaaaaatttaaaaattatctgggcatggtggcgcacatgtagctgtagtcccagctacttggaaggctgaggtgggaggatcacttgagcccaggaggttgaggctacagcaagctatgatctcaccattgcactccagcctgggtgacagagcaagaccctgtctctaaaaaaaaaaaagagaagaaagtatattgaatgtcaacatgctatttctataatgtccacaaacatacatgtgtgttgtatgtacatacacatataaacatagacatatgtgtgtacatttatattgaagtaatgttcatgctctaataatagctatgtgtatactgcttcctatgtgctaggcactgtactaagacccttataagaccctacagacttaggaaactaacaagagagaccgttggagctacacttagtttttgagttttgactgtgaaggtgaggtaaagcgacaatgagatttttcatacatttgatgaatatatcagtacatctaaaaatgtagaacaaaaccacactcacattttttctatttgtggagtgaataattgtgacttcagttcccaatttcactccttctaaatggcatgccttaatacaataggattctaaacatgctggtggtactttagggcttttcaaggaaaacaaaatatgtctagagacaagtcattattacaagagctttaataatagagatttccattcatgattatcttcagattaatggcccaggaacataattaaatttttcttaactcaaatgtcattatttttgcatttaccttgacttctataagtgagaaaaaatatattataggtaaaaattgccgaaaggaaatgcaactatttttacctatctataagtttaatatttctaacaattctttcaatcttgtatgttaatcccattataaaaggtaagcattttactagcccttggttcaataaaatagagataaaaatactggtgatgccttgcctggtttgtattgtcattcaaagtattaaattaagggaatttaagtaaatgtccctttagaagtaaggggtgttacctgtttgtaagagatcaattttcttcctataccaacttctttgtcagtcataatggctaaaattctccaatttggttatacttttaaccaaataattcaacagaattattagaaaatgaacccaatgactttttttttctttttaataccattctcattcctgggagtatattgtctctcattttgcatcagaagcagtgcagaaagaaacagtctcccctccacgcccccgtcacgtgagggctgactgggacagtgcaaggacaccctactcaagtcagcttagctctgtcgggtcccctctctgtggtacctctgctccatacccggagctcagggcatccggccacctgccgcctcccctcaggagagtactgggccagcttcctcccagggttcccttctgaagcccttcacggtgcctgggttgcaaggacgattgctccgggctccagggcccctagtcactagataaccatgtgcccccacaatttttttaaaattttattttagatcctaactctgctttcttcaaccctctttcacaacaaagtgatttgcgtcatgtggattgggtgaagtcatatttgaacatttggagtgaacttcaagcatacatcaaggaacaccacaccacgggcctcacatggagcaaaacagtgagtacgaggccttcctccacgtgtgtaaaaaaaggccatgactatatatacaccctgtggcccagtaatctcacaccttaaaacttacctcaaggaaaatgtaagattaaatgtccatgtggagggccaggcgcggtggctcacgcctgtaatcccagcactttgggaggctgagctgggcagatcattgaggtcaggagttcaagaccagcctggcaaacatgacaaaacactgtctctactaaaaatataaaaattagccaggcatggtaacgcacttctgtaattccagctactcaggaggctgaggcatgagaattgcttgaacccaggaggcagaggctgcagtgagccgagattgcaccattgcactccagcctgggcgacagagcaaaactctgtccaaaaaaagcccatgtagaaacggtttatggaaatgtcatttgttgtaggagaaatttcggagctccctacataacatagaaaagaaatagaaaagaaaatggctggcagggcgcagtggctctcacgcctgtaatcccagcactttgggaggccgaggtgggcagatcacctgaggtcaggagtttgagaccagcctggtcaacatagtgaaaccccatctctactaaaaatactaaaattagctgggtgtggtggcacatgcctgtaatcccagctgcttgggaggctgaggcaggagaatcacttaactcgggaggcagacgttgcagtgagcttagatcgtgccactgcactccagcctgggccacagagtgagacttcatctcaaacaaacagcaacaacaacaaaaaaggaaatggctaagtcgtccatggtaagaatgcaatgaaacactctacagccattaaaatgctttaccagttaatgttaagtgataaagtcaattgcaaaagtttatgagtattaagatgatgtatatgttaagaaattgcgtgatagaggctgggcacggtgactgtaatcctagcactttgggaggccaaggtgagtggatcacccgcggtcaggagttcgagaccagcctgtccaacatggcaaaaccccatctctgctaaaaatacaaaaaacagccgagcgtggtggtgcacgccataatcccagctactcaggaggctgaggcaagagaatcgcttgaatccgggaggcggagattgcagtgagccaagatagtgccactgtacttcagcctgggtgacagagcaagactctgtctcaaaaaaaaaaaaaatgtgtgatagaaattgaagggaacaagaaggtttgaagacaggtgtacatggaaagctatgcagccataaaatagaacaaaatcatgtcctttgcagcaacatggaagctgctagagaccactatcctaagctaattaactcaggaacagaatgccaataccgtgtgttcccacttacaagtggaagctaaataatgggtacacgtggacataaagacgggaaaaacagacactgaggactgctagagataggatggagggaggagtccaaggactgaaaaactacttactgggtactgtgcctactacctgggtgacgggatcattcacacccccaaacctcagcatcatacaatatacccacgtaacaaacctgcacatgtatcccctgaacctaaagtaaaggttgaaattattccaaaaaaaagagaacaagatagatgtcattttaatgaggtggaattatgattaaaatgtcctttaaatgttcttaacttctcttttagtgttctaaagtgtattgaatagtatttttgagtacctaggcgatcctaggactttggtatcttagtagcagcataagatcacagcctgtgtctgttcccactttaattcccatgtgagatgttgcgctgacctttgcccctttcagctttatctctcacatcctctcccatgtctcaccgtgtgttccagcaacccctcactccttgtggtatcctgaacaaagccagtgcttggattgcaccaaatgaaattgatgttgtttcaaaatttaccgaactcatattgtgtaacctttattgcaatgtcctgaacctatatcctgctgtataacctaatttcccccggggaggtacccctacctcttctgcaagactcacctcacacatcacctctttaagaaacttccattgatctccatcagctccccatctgggttgactggctctgctctctgtctgcctcctttgcatcttgagtatacctcagtcatatccttagcatgtggaatggtgctttactgtgtgcttttgggactctcccactagattggaaactcatctcttgtctccagcccctagtatagtgcctggcacagagtaagtgctcagtaaatggtttgaactaaatgatcatgaggggactcttagaatgtttcttgcccttttgaatctctgcacttgcttttcatggaaactcctttccattagaaattaatgttacagtggacttaagggacttgagggaaaggttgggagggggctgagggataaaagactacaaattgggtacagtgtatactgctcaggtgatggatgcaccaaaatctcacaaattaccactaaagaacttactcgtgtaaccaaacgccatctcttcaccaaaaacatatggaaatcaaaataaaataaagaaattaatgttaacttgaatgaaacagcttctttgtgaattccattcagaggtaaaactcactgtcctgaaagcagtaccccagcacccaaccctccatgctggatgtccctgtcagtatagtaagcaggcttcatgccaaaggagagtttgtggtttttcaagagagtgtggggccttctacatttgttttccaacacttttacaaatgttaacacgacccttcaagactgatgtttctttttatattctacttcgcctattttctccatagcactgaaatgcacagtgcaagatacaactaagcggattgttttttttttcctaaccacaacattgtgacttttgagaagagaattcaaaaacatgtgaagggttttaataagtaagggtatgtgtggatatggatgggtgtttatgtagactaattggaattattttttatcgatttccaatgagatagtgttttgttgtacagccatgtatcataaagagaaagtgtcacatctttgccatggtgatagatcattattagagaacagtaaaatgaaaatcaggagcccttggctctattattatttcatggtagataaaggccagaggaatgagaatccatttatggaaaatagtgtcaacaaatgctagcctgttaattctctaatggtgcccatggaaaatgaatagaaaattacttttaaatggtttgaatacctttaatgcaatgtgcaaagctgagtaattgtgtttatgaatataaaagagaattgattattaattacagaaaaatataaatgtagttgtcttcctttgttctaaagtgaatacttattatgttcaagcttcacaaaacaatacttgctcttactatgtacaacacattcagatattttattttttatttcattttttataaaattctggctgagacccaataaattgatttcatgaccccactagtgagtcatatctcacattttttaaaatgtgttataagctaggtgtggtggctcacgcctgtaatcccagcactttggaaggctgaggcaggtggatcacctgtggtcaggagtttgagaccagcctggccaacatagcaaaacactgtctctactaaaaatacaaaaattagccaggcatggtggcgggcacctgtaatcccagctacttgggaggctgaggcaagagaatcgcttgaacccgggaggcagtggttgtagtgagccgagatcgtgccactgcccttcagcctgggcaacaagagtgagacttggtctcaaaataaataaataaataaataaatagttataaaacgtgttacatttatacaaaataaatatgatccatagagcacatcaggcatcatggattgccatgacagctgttatttatattatacatattatgtgctcacataatatgccaggggaatattctattcaaaatggtaaaagcaaagcatctacttcacttctctaatggaagagaaaatgataaagttttggtcagatattaaaaatgattaaaaatcttttgtcaagctttaaaacatatgcctagaaatatatttcctgattttttatcttattcttccaaggtttgggcagctattaaaaagtatattataacaattatatttttgaattttaaaatcaaatttcttttaaattattaaaaacgacttaaagattccaaagcatagtccatagcataaatcaagctaatttctcctctctgactgtggcctgtcgacattccagcaaaatggaggataaacagttatagccagagttgcagcattcttgcagagaagagaaaaggactcctagaatcatctgattgaatggtctttgggaggaaaaaataaagcaagaccatttcatttgtttgcccactgatcacaactctgtaaaaactatgtatttataaaatgataaatatcatgaaagactatagaaagatgtggtgttgatgtttgtggacaccacagtattcagagattttttttttaatttaatttttttgtttttttgagacagggtctcactgtgacacccaggctggaatgcagtggcacaatcatggctcactgcaaccttgacctcttggactctaatgatcctcctgcctcagcctcccgagcagctgggactacaggcctgcaccaccacacctggctaatttttttattttttgtagagacagagttttgccatgttgcccagggtggtctagaacgcctcagctcaaggaatttgcccacctcggcctcagaaagtgctgggattacaggcgtgagccaccacatccagcccagaggtttttcaaaaaaacccattccatcttaacagacacagtccattgcacaaaactcctacttgcaccgtgaaaagtttatgacgacttaacatctcaagtactttcagtaattgttgtttttttctattttcaaattggattttgagatttgcactctgtggggtttttagtgactgacagcctgctgtttgagacctggactgtccaagggcacgtggctctacaaaatcatccttccctgagttaacagttggagctgaaagtccctgatcccatctcctaacctctgcctccagaccgcagctgtgtcaggcaactgctgccctgttcagttgtcagggtgaaatgccaaactttgagaccagcgatttgaagagagtctacgtgtgtgtgcaagtgtgccgggtggggtggggtgagttgggtgggaggaggcagctgtggaataatctgtctggaatgtcttcttacatttaccatggtaaatggaatcttgtcatttctatgagcttttttccaacttattaagacagctgtcaactagaaagaccccacaccagaaactaacttgctgttttcagttagtttcatccttgggactggacctctttttcatatgagtttgtgtcatttcctcagtgctaagtttcaaatgcacttcgttgaacaaattgatcttttggcacaaacccattagcagcactgttacttaggatccctcgcagttggtcagagctgtaatattccttggcatttccttcaaatcagataactaaagtcgaaagactaaggcctagtctttacccttataattattgaaataattgacttttttcctacaaaactcttcatttctgtgaatctataaatgcagactattatcctgttctaaaaacagactattatctgttcagaaaattctgctcagataaaggtcatgtaaagaattctatgattaggagaaatgtgattattttattaactttcggttgttaaacttgttgacatatttctgtcctttcctatatttctgaattactttagctttgggatcaaataagatataattatttgtagagtagaataaaactgcacatggatgaatgtatatacagtcttatgtaatagtgatgtagttctattttttttgttgttactgttttttgttttgttttgtttttttgatacagagtttcgctctgatgcccaggctggagtacagtggcacgattgcagctcactgcagccttgacctcctgaactcaagcagtcctcctgcctcagcctcctaagtagctgaggctacaggcgtgcaccaacatgcctggctaatttttatattttttttgtagagacgtgatttcaccacgttgcccaggctggtctcaaactcctgggctcaagtgatccgcctgccttggcctccctaagtgctaggatgataagcatggtaggatgataagctgcacccagccaatgtaattcttaataatacgggttttaaaaatccatcctatacactatcatccatcctagcctctcctgaacctccaggaaaatgcaagtcgttggtggtggttacaattatagacaaggtggcgtttcatttttcccaaagcaaaatgctttaggatcacttcttttcctccaggtagatatttcttttctttctgtttcttggtgtaaaggccaaatgtctgttaacaaagtgaaagtttaatagcttacttttgatcaaattaaaactcagccagagggtatcccgacttattataaataatgtagactctgtggcatgtcattaactatgaatatgtatgccttgtacgttttcaagtcttcaggcctctttaccttcctcttgctatttacaagagaaaactgttcttaagcttttatatccaaattttcatttagaacttgtaccaaacccacaccttaggggtattaatcaaagtgaatgggcagcgcctcagatgatgtgttggttgtctgatgacaaagctcactgttctctatggctcttcccacggagtggccctggccagtgtacctgaccacagctgcgtcgttctacttagttcagtttgggcttctaggtcccttctggggctctgggtggccagttactcttattctcttatggaagggttccacattgctcaacaggggttagaagtgtcatcaactggctgggcgcagtggctcatgcctgtaatcccggcattttgagaggccgaggcgggcagatcatgaggtcaggagatcgagaccatcctggctaacacggtaaaaccctgtctctactaaaaatacaaaaaaaaaaattagccgcacaaggtggcgggtgcctgtagtcccagctaccgggaggctgaggcaggagaatggcatgaacctgggaggcggagcttgcagtgagccaagatggcaccactgcactccagcctgggccacagagcgagactccgtctcagaaaaaaaaaagaagtgtcatcaactaacaaagaagcctcaaatgcacaggtagatagtaaagttaggttggaagtggctgtgagttcagcctgacagagaccacataattaaaccaatatggcttaagcatctactatgcactgagttctgggcaaggggctaagaatacaaagatgggtagatggcattgtggacacgattcctgtccacggaaacgcgcattctagctgaagaagatgagcaatgcaccatgatagaacagggggagcagtgtgctagggaatccacacaaggcatgacgcttgcatagaccaggaccacgtggaagatacggcccatcctgtagtgcagcatggttctggggccaacagcaacctgggcacttgttagaaagctcaggccccttgattgggcgcggtacctcaagcctgtaatcccagcactttgggaggctgaggcgggtagatcacctaaggtcaggagttcgagaccagtgttgccaacatggtgaaaacctgtctctactaaaaatacaaaaattagctgggcgtggtggtgcagacctgtaatcccagctactcaggaggctgaggcaggagaatcgcttgaacctgggaggtggaggttgcagtcagcctgcattgcaccacgggactctagcctgggcgacagagcaagactctgtctcaaaaaagacaaaaaggaaagaaaaaaaaagaaatctcaggctctcaggccccacctcagccctcccaaatcacaacctacttttcaacaggattcccaggtaatttatatgcatagtgaagttcgaaaagcactgctctactgtatttaagttgggccaaaggagttgttatagggaaatcattcacttttacacgttcatttatttagtaattcacttccttggtaactacttattggctacttaccatgtaccaagcacacaccaggcattatatttatactacagttcttccgtgaagcagcagggtttttattatgatgcataaataaataacagcaatacaaagctaggttggaaaataagccttgtgaattagactccttcctgggtgggcacgaagagccacaaaagggctgacacttgatttggatcttgacggtgagcaggagttccctaggcaaacagtaaagggaagggcagttttggggcagagaattcagcatatgtacgtaagacatgaacaatgtactttgagagaaaggctggtggttttgcagagctgaatgtggcaaaaggtgaggccagaaaggcaggttggggccagatggtgaaatccttatgcattatgctaagaaggtggggctatgtagtgtttgaagttgtttcctttgccataggttttgttgtttgttttttgtttttgagacagagtctcactctgtcgccaggctggagtgcagtggcacgatctcggctcattgcaacctccgcattctgggttcaggtgattctcctgcctcagcctccagagtagccggtactacagccatatgccaccatgcctggctgatacctcaggtgatccactcgccttggcctcccaaagtgctgggattacaggtgtgagccaccgtacccagcctgcatgggttcttaagcagaaagcaacacactgtgaataatgacttaggaattgcataagatagatggagaggggaagagattagaggccctgatacgtgttgggagactttagtggatggctagagggtgaggtagttagtatgtgacctagagtgtgacaatggcaatgcaaagagatggagtagccactgagttggaggacaagggacataaaatctaacacaaaatttccaatctggaagtctgggagagaatcgtggtaatataaaaatagggaaatcgcaaggaggagctggtagagaaggaagaaaaatcttcacctggggtttcactgcattgtgtttgaggtgcgggaggtataggagagacatccaaacacgtggagtcaggaggtgagatttagatctggaattcactgaagggggagaccccgatgtacgtgttgggagtcatctacctagaaaagaccggcaaataaataagatggttaaaaaagagagagtgagatcaaggataaaaccttggaaaacactattatttcaagaatggggtaaactaatcaaggagacaagagataggagaactagaagaatggagagtctcaaagctatagggaaaacaggctggccagtgataccaactgtagtaagctgtggtgaataaggattggacaaaggctgtcatcagccatgtttaccatgttattagtaaccttccaagagcagtttctggaggactggaggcagatgcagttttacagaattaaggagtaaaatgtttttgtaatcaaagtactttgggaggttgaggcggttggatcacaaggtcaagagatcaagaccatcctggccaacatgatgaaaccccgtctctactaaaaatacaaaaattagctgggcgtggtgacgcatgcctgtagtcccagctactcaggaggctgaggcaggagagaatggcttgaacccaggaggcagaggttgcagtgagctgagatcgcgccactgcactccagcctggtgacagagaaagactctgtctcaaaaaaaaaaaaaaaaaaaaaaggagtaagaagttttcctgtaatgatctcttgattatttctggaccagttgtctaatttgatggattatttcttatggcttcaatttctgccttttgaaatttggggtatttgtgaattttcattttaatctgtgctatatcttcaatagaataggtgaaaaatagtcaaatatctccaatttcacacacagtcattaagagctatactgtgaagctctaagtaaatgtgttctatttagaactgtttttattatctcataaatacctttgagttttagtgtcagttgataatgatgcagggaaggtgaaccccaaaagtggggcttagccaggagggttcttggctttgcccaggcgagaattcaagggtgagccagcggtgttagacagcagcttctatggcagcagcaatgtgcagcagcagcaggggtaccataggaactgtgcccagagtagcagctcagggaccattctgccattatatttatattcacttttaattataggcaaattaagggggaagttattcagaaagttctagaaaagaggtgataacttccaggtcattgccatggaaaggggtagttagtaacttccaggtgttgccatggcagtggtcaactgacatggccctggtgggcatgtcttctggagaggtgctttcacctctttcccccattgcagcgagtcttcagtctggtttggcattcaagtcctgcccagccccagtcaagcctgcctcataccttaataagaatctataaatattttagagtatttcttttcttttcttttctttttttttttttttttgagttggagtttcgctcttgtcacccaggctggagttcagtggtggcatgatcttggctcactgcaacctctgcctttcgtgttcaagcgattctcctgcctcagcctcccgagtagctgggactacaggtgcgcgccaccacacctggctactttttgtactttttttaaaaatagaaatggggtttcaccatgttggccaggctggtctcgaaatcctaacctcaggtgatcctcccgccttggcctcccaaagtgctgggattacaggcatgagccaccacacctggccattttagagtattaaatctttctctccatcaatcaaaatagtagtagcttttaaagctgcctactttaatggtcagtattattttatttaccagaactttttcataatcaagaattcaaagctctctaaaataagggctagcaagttaatatacatttattgaacctgcgaggcggttgaacctgtgaggcggaggctgcagtgagcgtagatcacacactgcactcctgcactccagcctgggtgacagagcaagattccatctcaaaaaaaaaaaagaaagaaaaaagaagcttctccaacctctgcttatcaccatgcccaccacaagctggaagttatccttccatcctcagcggctgcatagcacttcttatactctccatttcttttgtgttgcttagcatttcctaccttatatggcagttattttctcattcagtaacatgtttatgaagcacttaaccatgtttcaggcactgtgccacattgaaacatggaattccctcctaagagagttccaaaaaccctacgaaaggaggaaagacacattttggttgaggcttgaaggctgttttccagatagtcagttgggcaagagccttccaaactagacacgccctgagcaaagactcaaagtctgggagccaagtgcctgccacgtctgggaacacagaagtatcctctcttcctaaactatgagctcattgaatgcaggctccatttccagttcagcctgagatcagtagcagtgactggtaccctggttctgggacagcagtgacttgaaaacagataggattcaaacacatttgctaaatccactgtattcatttgtcatcacaatgaaatttccaaagcgttagtccattaactatagatcatgtctgtttttcaaaagctgcatgaaaatgtgtcttttttttttttttaatgatggagtctcgctctgtcgcccaacctggagtgcagtggtgtgaactcagctcactgcaacctccacctcccgggttcaagctattctcctgcctcagcctcaagagcggctgggattacaggcacgcaccaccatacctgactaatttttgtatttttagtagagacagcgtttcaccatgttggccaggctggtctcaaactcctgacctcaggtgatccaaccttctgtgcctcccaaagtgctgggattacaggcgtcagccaccgcacccagccaaaatgtgtctttccttctgtccagtgataggaatggaatggacaatgcattttattcaggaacacccatcaaccgcccacacctcctctgctcctgtcccttgtcacccactgcctttcattctcagttggtataaactcaggaaacagaaggtagtattaacttaagcaaaaactgttttcttaaaaagggaaatgggggaaggtgcagattatcttctaaaggtaaaacaaacccttcataaaacagaacacacaggctgggcgtagtggctcccgcctgtaattccagcactttgggaggctgaggcaggcagatcccctgaggtcaggagttcgagaccagcctggccaacatggtgaaaccccgtctctactaaaaatacaaaattagccgggcatggtggcgcatgcctatagtcccagctacccgggaggctgaggcaggagaatcgctggaacccaggaggcggagattgcagtgagctgagatcatgctactgcactccagcctgggcgacagagcaagactctgtctcaaaaaaaaaaaaaaaaaaaaaagaacacataggcaagccctggccacggtttattggtccagtctgcacccttgatgcaaactaagcatccctaaataaacaaaatgcatatataatatggagccaaaggtaactaatctttctaacagctattgttttgccttaacccccacctctactatctactaagtatagataattggagaaagtacagtcgtttctgtatgcccctgaaatctgaaagaaaaaaacctgaatttagtggtagttcagacttaggcccttctggccaaatgaagtagctgtccagctaattcaagccacatgtccctcttggtctttatataactgttgggcctcttgagtttgtttctttgatgagtatactctgctatctttaaccctggaaagttttcccatggaaaatttaattttatctttccttttttatgagaaattgtattctcaagctggcagacaagaagaaaagacaatctggaaattccagatttgatctaaatgtcagcaaagccaaactaataattatggccacatatcaaggcaatttatgcagaatatatggatcacttgagcatattagattgtgttcattatattctttttcatttttgttctctttctttttttttttttttttgagacaaagtcttgctctgtcgcccaggctggagtgcagtggcacgatctcggctcgctgcagtctcgcctcccgggatcaagcgattcttgtgcctcagctttctgagtagctgggattacaggttgtgccaccatgcctggctaatttttatatattttgtagagatgaggtttcaccatgttggcctgttggccaggctggtctcgaactcctgacctcaagcgatccacctgccttggcctcccaaagtgctaggattacaggcgtgagccactgtgcctggccatgtgttcattatattcttctggactctactctgagggcttggtctgcttttatcaaaaatttttactttgagcatgtagaaaagaaatcaccacctatgtttttagaagggccacatctgggtatacaggtagcagtttgagtacccatacaggcattctgtttttgacttcagtacactatttaataaattacctgagatattcaaccctttattgtaaaataggcttggtgttagaaggttttgcccaaccgtggactaatgtaagtgttctgaacacgtttacgttagcctaggctaagccacgaggttcaatagattaggtgtattaaatgcatatttgactattacaatattttcaacttataataggtttatgggacgaaaccccattataagtcaaggagcatctgcataaattagagaaaaacaaacataaagacactaagttactggtttacaggtactaatatagacagcacatgttattcccaggctgttttctgattttaagctgttgttacttctctaaagcaactttgctttctgctctgtctttttttcatgtactgccaaagctcagatctttccaggtcatcaaaggaatgacatacagggaccacaggagggtgggaggagtggagaatcatgaaaccatcagaaatcatcgacgaaaccatgagatctgagttttttgacctttcccctggtctttgtatcttgggataagggtgtttggagctttgcctctgaagaaaacggatccaaatgggccccacaattccttcatatttgtgggactgtctttttattttgactgtatttaagtaccgttagtactttcatggaaatctgaaattccagtagtgttctgttttccccaaattgactttttaaaaattattaataaacatatatttaaaatattatacagcacttcactgtggtattattaacaattctgtgttcttggaaaggcccccagaaactttgtttttattgacagaagtctcaaaattctaagaagtggagccgggtgcagtggctcacgcctgtaatcccagcactttgggaggccaaggcaggaggatcacttaagcccaggagtttgaaaccagcctgggcaatgtggtgagaccccatctctacaaaaaaaaaatttttttaattccaataaatgataaaaataagagaatggagacaaaagtcataaattcaattcagttacactcacattatacaggatgatcatcttttagttttatgtgcacctttttacttgactatagttgtcttctaataaaagtgtgctataaatatgaatgtaaaatttgcaagttattatggaaattaacaaatttggaaaggtgtcagtttcactaagttattgatcaatgtacatcttgcataaaatagaaagaaattagttttgacattgaaaatataaacacactctgtctgggcgtggtggctcacgcctgtaatcccaacactttgggaggccaaggcaggcggatcacgaggtcaggagatcgagaccatcctggctaacatggtaaaaccccatctctactaaaaatacaaaaaactagccgggcatggtggcaggcgcctgtagtcccagctactcaggaggctgaggcaggagaatggcgtgaacctgggaggcggagcttgcagtgagccgagatcacgccactgcactccggcctgggcaacagagcaagactccgtctcaaaaaaaaaaaatatatatatatatatatatgtataaacacaccctacagtatgaatttgtgaaggaagaccatctgatttatgtgtataaaacattaggtctgttctaaaactggtagttctttcttttaatcactccctcctattatgctatatgagaggcttatcatgttcatgttttatgttccatattacacaaggccatttgggattctttgtctttggaaaaattgataaagagtattttattaaaatattcagttgtcactttgggaggccaaggtgggaggctctcttgagcccaggagttcgagaccagcttgggcaacatagtgagaccaaaaaaaaaaaaagttccattgtaaagcattgttagtctctatagttgtagcatgaagatgtaagtgtacttgtgattgaaatggctttgtgattttgaaactgcttttagtttttgagacagggtctctgtctcccagctagagtgcagtggtgccatcatagctcactgcagctcaatctcccgggatcaagcaatcctcccacctcagcctcccagctcccaggtagctgagaccacaggcacataaccaccacacccggctaatttttttacttttagtagagacaggatctcactatgttgcctgtgctgatctctaactcctgagctcaagtggcccttccacctcagcctcccaaagtactgggattactttactttactgggatgagctactgcactgggcctaacctgcttttaaagtgtatgattggagacctataagttgtcactgctacctagagatcattaatggtaagccgggtggttattgggccaggatagttcagagatgggcagttaaagagaatctaactgacaaacaaaagggagtgtgtgtttgtgtccatgaaggacagttcgaggaggggctcataaaggaaggatgagggagaggaaatacccatgaacagtgccacggcatgtcagctgtttcattttgtggctttatgtacaatcttcacaaatatgtaaagacaggtggctcacaacagtactaccactaagctagctctgtggaagaaacatcttaacaaaaattgttctgtgagcaacataatccacctgttccaagagactgtcaggtgatatttttttcatttttttggtctcccacttttttttttttcagtttgagagcaggtactgtttattaactgaccagcttagaaaaataatcatggtagacaccttagttcattcttctaataagcctgttgatctggtcctccctgttgccagcatctccaccttctacaaaatgggtggtctttttcttcattctgcctcgtggagaagataatttgaagggccacaggaagttatttgcttctttgaagtgttttccaatggtatagatctcatgaatcagatcctccctgcagatgatgccatatttaccgagagattgagccatcaaagcctcatctgtcaaagcaattcgcttcttactgattttgccataaccacacttatggattagttcatttactgacttcagaattgggtacccccatgcagtgtatggctctacaatcctcagcatgttaactgaagccttgttgagcttcacaaaggttctgttgaagatttgacgaagggaagaagctgcaacacctttcagacctttgggctcacaccattgatacctctgatcctgatgacaaacgccaatttgggttctgcaggtacatagaagttgccagcttttcttgccatcctcgccatttgaatttcagttctgtacatctgcctatattccttgtgatagtgcttcgctttttcatagataagcttcttccttgcctttcaaagcatcttttggacaaacttctttctcaggtgcttgatcttcagctctgcgaaattccttcgctttttcttaagcatttctggcacagcaggaaccttcttcttctcttctacaccttccatggttccagccagaaaaagagtggtctctgcttgttaaaaatgggtaagaacactaataggttgtctgacctgtacttaaagttggagatcaatgtcgtctatatacattccccccatgcttaaagcccttcagcttctccttttaggataaagatacctgcaaatcacccagaccgtcctgaggagagctggtcacttccacctttgcaccccagcatccctcatgcatgtgatgtgtggttcatatcacacttcatctacaattacttctttgtgcatttgtcacctccactagattatgagcttcttaaaaaacagaacgtatgcctgtttcctcatcaagtaccccattcccagcaaggtagcccttggtaaatgtttgtttagtagactgacaaagcagccttagttattcaattcacttttaatccaactattaagagttagattctactcaaaccaaattctctactacctctattgttgggtttgaaaatctttttttttttttttttttttttggaggcagagtctcactctatcccccaggcaggagtgcagtggcacgatctgggatcactgcaacctccgcctcccgagttcaagtgattctcctgcctcagcctcctgagtagctgggattacaggtgtgtgccaccatgcctggctaatttttgtatttttagtagagacagggtttcaccatgttggccaggctggtctcgaactcctgacctcaggtgatccgccagcctcggcctcccaaagtgctgggattacaggcgtgagccaccgcgcccagctgggtttgaaaatcttagagtttaggtagggtgcagtggctcacgcctgtaatcccaacactttgggaggccgaggtgggtgaatcatttgaggccaggggtttgagaccagtctggccaacatagtgaaaccccttctctactaaaaattcaaaaaaattagccaggcgtggtggcaggcacctgtaatcccagctactgggaggctgaggcaggagaaatcacttgaacccaggaggtagaggttgcagtgagctgagatcacgccactgcactccagcctgggcgactgagcgatactaaaaaaaaaaacacacacacacaaaaaaaactggaagtgttggccaggcgtggtggctcacgcctgtaatcccagcactttgggaggctgaggcaggcataacacctgaggtcgggagttcaagactagcctgaccaacatggagaaaccctgtctctactaaaaatacaaaaaattagctgggcgtggtggtgcactcctgtaatcccagctactcgggaggctgaggcgggagaatcacttgaacccgggaggtgaaggttgcggtgagccgagatcacaccatcgcactccagcctgggcaacaagagcaaaactccatctcaacaccccccaccaaaaaaaaaaaaaaaaaaaagaacttggaagtgttttccctttcataataaaatctaaagtaataaagcgattagtatttcaagaagtaacatttaatgaaaacaaattttgatgtacattagtatagaactatattaaatagagtatacttatatatagtatatgtatccaaaaaaatcacaaaccttccacacactgcatattggtttcattattttatagctacagttcatatatttaaaaatagaggaggcagctgttcccaggacagctgaaattaacttagagtaagggatttgcagtacagtagctttttaaaaagtctttgtgccaatttaaaaaaagtatataattgaatatctgctctcaaaattaatcttaatagaccttaaatgcagcatttttcggcgttgtgctgtgttcttgcaacagaagtgaacttttgtactctgaatatgggcatttaaaatcatagatgtgcagcttttctttctttttttttttttttgaaatggagtctccctctgtcaccaggctgaagtacagtggcgtgatctcggctcactgcaacctctgcctcctgggttcaagcgattctcctgcctcagccttctaagtagctgggacaacaggcgtgtgcaccatgccgagctaatttttgtatttttagtagagatgggatttcaccctgttggccaggatggtcttgatctcctgacctcgtgatccacccacctcggcctcccaaagtactgtgattacaggcgtgagccactgcgcccagcctcatttttttaagttgtaaaccattgttacaatgactccaatagaacgtactttttcattattcccagtctgaggcgctaagatacttaagtgactcatttcatcaacgtaacaaagttgttttttaaaaaagcatttgtgtatggatcactgctccttaactaaggttaagtctgtctcccttcaggctcctaggccaggatacctccattcagttctcaacttcactttcctgtccatgtggctttgtgcaagttacatgacatcagaatcctgtaggtcctggaagcttttagatgtatgattctacattgtagaaataaaatgaaactaactgttaggataaaacatactataaaagaatttgttattaagaaaagccttcttttgagaaggaccagaaatattctgataatttacaagtaaacatctcttatttggtgtctttgttgaattctccatgtgcagatccaaccatatagcttgtgttcattctgcagaggcacgaatgcagtctgcaggctatggctgcagtttctcaagactgtcactggtaaatggtagggaagagaaccctgtcatgtcttacccatctcagtcaggttcctgggcaggtactgttagttcagaggctcttcctagccctcgttcttggcaccgcctacacaaggtttgcccatctgggagcgatccttttgtatctctagactgatctaactcagattgtaaaggatacaaaatctgccctccgcccgtgccccctctcctgtgggctctgctgtcccacagagcctgttctcccacagttgcccactgggattgagaagtagtggatcactcgatgggcacccaaggctgcaggctctgatctgatcctttccttctcatccagtctagacaacctggtacattacctctgccatgagagtctaactttaaaatgaaatcaccctgaggggtcgtgtttttcaatctctagtctccagaagacaggtcacaaccctatctcagaacaacttgagccctagacggagagtcaagatctgggtacatgtacccccctactgcaaccagtgagtacgcaggaaaaatgaaccaggcaagaggccagtttctagaagcagggcacagagtcacaacaaaaccagcatccagggtgacttaattgtcaaagcacaagacatcttatattcccataggatcaagactggttccagaggtgctgtaggagctcagtcaactgctaaaagtcactgggggatggaacaaggggttgtggagataaaaactgagccagatattgcaccacttcccaatacttctgtcgtatttattctagccggaggcccacaggctgcgctacatatgagtcaaggtagcccagaccttcctttaatttggctaatgactttttttttttttttttgagatggaatctcactcttgtcacccaggctggagtgcagtggcgcaatctcggctcactgcaacctctgcctcccaggttcaagcgattctcctgcctcagcctcctgagtagctgggattacaggtgcccaccaccacgccaggctaatttttgtatttttggtagagacggggtttcgccatgttggtcaggctggtcttgaactcctgacctcaggtgatcttctgcctcggcctcccaaagtgctgggattataggcgtgagccaccgtgactggccatgactttttttttttaagtccaaatatagcataaaagatttccctgaagaaggctttagaatcaaggagatatgtgattcaataatgtctttaccattgactggccatttaatattgaatttaaacagcctttctgatttcctgccgtatttttgttaaagagatatttcagtacagtcccagtaatatggttgtcataattaagattaatttcaacacataggaaagaatgtttattcccaaatttgtctacagattggaatcacctagggaaggtccaaaaatacagatgcctatgttgctacctcctccacccacaagagtatttctgtgacacagcctagtcgtctttggaatttttggcctcccaaagtgctgggattacaggcgtgagccaccacacccagctaatttttgtatttttagtagagacagtgtttcaccatgttggccaggctggtcttgaactcctgacctcaggtgatccacccagcccagccacccaaagtgctgggactacatacaggtgtgagcctccgcgcccagccttctctctgttttttcttgggacatctgaagacagtgtcaggctgtgattccacttgtggccagacataagagaatatagaaagttctcctgtcatgtgctgtaatctcccacagaatgagaagagacggaggcaaagataagtgactttgcaaggggcagctcacggagatccagtgaagggaacatctaatcagtttgatttcgagtccactgtacggtaaagcacctgaatgctaattgaaaagtaaccttggaaacaagagcccggtattgtgctcttgctggggccgatatgggaataagccaggacatacaaaggattagaccaagatggagtttcaactggtcctgagttcccttattttttggcttttattttcaactttgtagcattaaatgctttgtctcgcgttcctgggccagccatctgaatgtatcaaagttccaaaaagttgaatatgtggctttttagtttcagtgtcctttaatggctcttggagagagagtctctgaattctgagagctagggaaccatctaaatcattttaagatttagaagccagcatcatcttccctttacacaaaataggactataaagctgcagtgtttcagatgttgggggaaggggctgtcccttcaccggctgtatgagttatgatgtgcttatgagtaaaagtaatacttcgtggttctcagtgtctgaggactagaatactgtttgatgtccaaagcttatattatactctctttctgattcagagcaaattctcaaattttatcccagtaacatagaaaacatttcaaatactggtgagaaaaatggtcagtctcaggaactgtgaaatcattttctacttgacctaagaaacctgatggaattaggctgctctttcttagaaacaaagactattgcaaattaaatcttcaggagatgagccctccagcctgcagggtttctaaaacatgcattctgaataagacaattatattttattttcagggtaattctacacttaataggaattatataagtgctttgaaaatagcgtgttgtgttgttttgttttgttttgctttgagacagggtctcactctctgttttccaggctggggtacagtggcgtgatctcaactcactgcaacctctgcctcccaggcttaggtgatcctcccacctcagcctccgcagtagctgggactacaggcatgcatcaccatgctcagctaattttttgtattttttgtagagacagggtctcactttgttgcccaggctggtttcaaactcctggctcaagtgatccaagcgatctacccttctcggcttcccaaagtgctaggattacaggcatgagccaccatgcccgagccagcatgttttgttttgttttgtttttaactgaaaactactacagattaagaatcgctgattttgatactgcataatactaaattgtttatgacaataaggatattctgttttcattaatatttggcacttacgtaatgttttacctttcatatttgatattgaaaattgatgagtccaagccacatttccattactcgcaattttttaagcttcgtgactatttaatttgtttatagttccctattataggtatacagttctacttgagggttcaaaagtaaaacagggccgggcacagtggcttacacctgtaatcccagcactttgggaggctgaggcgggtggataatcttgaggtcaggagttcgagaccagcctgaccaacatggcaaaaccctgtgtctactaaagatataaaaattagctgggcttggtggtgcatgtttttaatcccagctactcaacaggctgaggcaggagaattgcttgaacctgggagactgatgttgtagggagccgagatcatgccactgcactccagcctgggcaacagaacaagactccatctcaaaattaaataaaagtaaaacagtatataggccaagtttgtggtatatgtgtgtttctatcctaccagttttaagttctgtgaaaatatcacagatatacaatattttggatattttccaaaatattaaaactggtactttgggaggccagggcaggaggattacttaaagccaggagttcaagaccagcctgggcaacatagtgagacctcatctctcaaaaaaaaaaaaaattaaaaattagccagttagagtggcacatgcctgttgtcccagctattcaggaggctaagccaggagaatcgcttgcgcccaggagtttggggctgcagtgagctatgttcacgccactgcacacagcctgggcagtagagtgagaccctgtctccttaaaaaaaagcaaaactgaactaaagcaagtctctctcttgtctatcacgtcttattgccatttgaatttgttaggctttcatactgaaaacaaaggttgtgctttacatagcagtgaaaataagaataaccatagctcttggatcaggaagaatctaattttcagttggttcactaacagccaacatttgatgaaaagtcatgtggatcctggaccctcattaccttcgggtttgacaagcatcccggtcacatatgctccttgtttgggggtcagtttgcagcaggcatatttggaaaatcaggtccagagagtttctgtatctctctctttcactgcttaaaaaggttcggaaacatccaatcaccactgaatatttttacccttccccacaccccattggtggtcacagtttccagtgtctcaaaagagctaatcgttttatcaattggatcacttttttcttgtgattctaaattggccaaggcccagtgtcatttagatcctgagccttggacctggacttgggagtatggctcgtttgcctctgatttggcagcagggctcattgccgcacagatcctactgatggggccacacagctaagtcatgttccactttcccaagctggagctgccatggttcagatcctcccaaacagacccatgatgcacaggtgtgccctctgggagcctttgctcaggcttcaaccccactctctcattggcagcaggtttcgactctctcgggcaaaatcccagcaagggcgcagtctcaatgcaatgcaatgccctgtcttctgtcttctcagggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaaggtgagagagaaaagaagaccttgaagctgcctccctttccctctggctcccagacacaaaagagccgctggagccccagtgatggatacatcactccatccctgcctccagcatgcagggagagggggaactggtgctgggaagacaggagcctgccatgttccttatgtccatgcagacgggctcagggggtcactgtgtagaccagaaagaagtattcagagactctgggttctaaatggaccactgtgctgcatccttgctttagaccccagtacttccacatcattgtccacaaccaaggcatcaagatcaagtgaaataaaaataaaaatggcaggctgggcatggtggctcacacctgtaatcacagcactttgggaggccaaggcaggcctattgcttgagcccaggagttcaagaccagcctgggcaacatagtgagaccccatctttaccaaaaataaacagaaattagctgggcattgtggcacacacctgcagttctagctactaaggaatctgaggtgggaggatcgcttgagcccaggaggtgggggctgcggtgagctgagatcgcaccactgcactccagcctgggtgacagagtgagaccttgtctctaaataaataaaagtggcaaacattagctcctctgtcctgaagcagtgtacaggcttgtcaaagaattatatcccactatactgggcttggagctaagaatccaaaattctaaatttttctctggctccaactggttctgctgtgccttgtgaaactcatttgcaaagtaaaggaatggattcgtaaagtcaattccatatcctgatatatactcactggaatgccctaaccttttaggctgtgtctggagaatgatttagccgtaagagaagaagtaagacatgatcctttttcgtgaggtggtttgctctttgcagaatttttatctatcattttatctcccaacagaagaggttcctcaaattaaaaaaaaaaaaaaaaatacttggctggtgcagtggctcacgcctgtaatcccagcactttgggaggccaaggagggtggatcacctgaggtcaggagttcaaagaccagcgtggccaacatggtgaaaccccatctctactaaaaatacaaaaattagctaagcgtgtggtggtgcatgcctgtaatcccagctacttgggaggctgaggcaggagaatcgcttgaacccaggaggcagaggttgcagtgagccgagatcacgccactgcactccagcctaggtgacagagcgagactccatttaaaaaacaacaacaacaacaacaacttacagtgcttctgtcaactctcaacttgtacaggactcagctcctgcatcctgacttggagaaagcactagactgttttgaaagtggccttaccaaaagttcttgtgctctttatttacatcatgttgatctagcaagttagagacatttccctttgcataaaataaatgtgtccatgtgtgttgtcctcctagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggtaagtgaagcattttaacctttattttcctgacatgcgccaatgaaaggaccaacagccaaaccatttaccaagatctgaaggatttcttttttttaatttttgtattggtacataacatttgtatatatttatggggtacctgtgatattttgttacatgcgtagaatgtgtaatgatcggcactttgggggtttgaggtgggaggatcacctgaggtcaggagttcgagaccagcctggccaacatggtgaaaccctatctctactaaaaatacaaaaattagccgggcatggtggcacgtgcctgtaatcccagctacttgagaggctgagacaggagaatcacttgaacccgagaggtggaggttgcagcgagccgagatcacgccactgcactccagcctgggtgacagagtgagactctgtctcaaaaaaaaagaatgggtaatgatcaagtcaggatatttagggtgtccattaccttgagtatttatcatttctatgtgatggaagcatttcaaggcctcttttctagctattttgaaatatttaagacagtgttgttaactatatttaccctactctgctgtcgaattagaatttattccttctgactatatgttcgtacccattaaccaccaaggtgaagtgacagaggcaaaaaccactggctagagtagaaaccagggtgtttctgaatgcttccataaactttattttcacaggttctcatgcattcttttcttcaactttttaaattattttgtgagtggtggtaaaatagacgtagcataaaatggactgttcaccatgtttaactgtccagctcagtggcattaagtctgttcatatggttgtgctgccatcaccaccacccactacagaactcttttcatcttgcagaaccaaaaatctgtacccttaaccaatagctccctgtttctccccctgcacccctcccagcccctggcaattaccattctactttctgtctctatgaatttagctattctttctataagcttttaatcaggcagcaagacagaccgttaatatatggaactgggaagtctgtgccccactctgatgtgctgtgagatgtttcgttcagtcccatggatggagggattgatacctctgtaccctactgctgccaccccccactgcccgggctaagtgtgtgagcaggacatagacacttcaaatggtaatgaaagctggtgtctcctgctgatctggagggcttccctaaagatgaaggaccaaagtccctggagagttgtcatcgccttgaaaacacaagggcttagaccactgctgtgacccttcaccagcctgtttgcccaactcctgtttgacacagcaggttttgctgcatcatcaagtccagacttggcatcaaggcctcaacaaaaagctctcacatccctgctccagcctcccacctgctagggtgcctgatacctgatgtttacaaagagatactgacttgcttccaagaagtggttccgtttttcccatcctaacaatgacagagtaagacctgtggtttcatctataaggagatggttccaaaagaatatattgcaaagccatacttcatgctgagctcgtactaatttcagtgtgcagtggtttctgtttatatatgctgatgtttaatatttgtatttgtcttaattctaggagtaccaagaggacaggaatgaccttgtgatttcagagactgagctgaaacaagtggcttacattttcaaatgcgaaaaatcaactattcagataaaagggaaagtaaactccattataattggtagggcagaattatggctctatggttattatgatgttttataaacaagctgtatgtatttagtggagttggttttttgttgtgttttttctccccacagacaactgtaaaaaactcggcctggtgtttgacaatgtggtgggcattgtggaagtgatcaactcccaggacattcaaatccaggtaagcagagcctttccaaccatgctgtaataagcagagcctttccaaccacgctgtaataagcagagcctttccaaccacgctgtagtaagcagcctttccaaccacgctgtaataagcagcctttccaaccacactgtaagctgcggccttgcacagaccatccactctgcctccaagaagcagccttgcagccagtcgcggtggctcacgcccgtaaccctagcactttgggaggccgaggtgggcggatcacgaggtcaggagattgagaccatcctggctaacacagtgaaaccctgtctctactaaaaatacgaaaacaaaattagctgggcatggtggcaggcgcctgtagtcccagctactctggaggctgaggcgggagaatggcgtgaacccaggaggtggagcttgcagtgagcgagccaagatcgcgccactgcactccagcctgggcgacagagcaagactccatctcaaaaaaaaaaaaaaaaaaaaaagaaggagccttgctcccccatggccacctaaaatactcctattcttgttccctctggacacagctctatcatcacctccttggtagacccctctcttacttctcagtgttagttctttcttttcaatctcttctaacagatcccattttgtgtttccattactggcataccatctcaatttcaagtacagctaactggccaggcatggtggctcacgcctgtaatcccaacactttgggaggccaaggcgggtggatcacctgaggtcaggagtttgagaccagcctagctaacatggtgaaaccctgtctatattgaaaacacaaaaattagccgggtggggtggtgggtgcctgtaatcccagctacttgggaggctgagacaggagaatcacttgaacctgggaggcagaggttgcagtgaactgagattgtgccactgcactccagcctgggcaacagagagagactctgtctcaaaaaaaaaaaaagaaaagaaaaaaaggacagctatgtaatctttatagccccagaaacttgcacagtacctgcacatagtaggcgtccagtaaatgtttgatgggtatatgatttgagtgaatcaactaatgcataaataaaagtactgtgagactctcctagtatgattagccccattccaaagagaacttttttctcaggaaaaattggtcctagatcatgaagaggaaaagtttttctaaagaatcagtgagatcatcagaaaaacaacttgagaagtagggttggagttgaatttgcaaaacagaagaaaatctgtgaattaaaatatataataattttgatttagccacatggaattttatgatatgccaaaatctaaaggacttcttggttttggccaattataacttctatctttttttttttttgagacagagtctcgctctgtggcccaggctggagtgcagtggcccaggccaggcgcaatctcggcacactacaacctgcacctcccaggttcaagtgattctcatatgcctcagccccctgagtagctgggattacaggtgaccaccaccatggcccagctaattttttgaatatttaatagagacagggtttcgccatattgggcaggctggtctcaaactcctgacctcaagtggtccacctgcctcggcctcccaaagtgctgggattacagtcatgagccacagcacccagccccagtttagtatttctgatcactacatttatccatttaataacactgctttctctccaaactattacgcatgcaaattttaaggaggttgctcatcttcagaaaaagcccggtacttcaaggatgatcatggttcatagaaacctaatgagaccacactttctgaagagctattttggatggtgggagttcctatgtaaagaaacatgctttttcccactttacattatttttaattttaaaaaactagaagtaacagcagtgaagtaatatttgatggcagaggtgagggtacatgtttagccatagtcatgcaatcatagtgtgtcacagttgaaaagtatcttggaaagaatgcaacctaacacacataccacaaacacaccttaattttagagagtttatttcaagctccctttcattcgtacagaaattaagcttaggtagcaatggtgaaaccatatataagcagttagcattttttttaatgtaaatacatcacatctgaaatacacaaccaagtaaattaagtataaaatgtgaaaatgggaagttctaaatattcatcatgtttttggagggagaaaaaaatcttaaaccaagaagaaacagaggaaattttcaaacagataggcagatatgtctacctaaaaatttaaaacttctgaattccattcagtggaatactgtgtaaccattttttttgtattatactttaagttctagggtacatgtgcacaatgtgcaggtttgttacatatgtatacatgtgccatgttggtgtgctgcacccattaactagtcatttacattaggtatatctcctaatgctatccctccccctcccccaacctcacaacagtccccagagtgtgatgttccccttcctgtgtccaaatgttctcattgttcaatacctatgagtgagaacatgcggtgtttggttttttgtccttgcgatagtttgctgagaatgatggtttccagcttcatccatgtccctacaaaggacatgaactcatccttttttatggctgtatagtattccatggtgtgtatgtgccacattttcttaatccagtctatcattgttggacatttgggttggttccaagtctttgctattgcgaatagtgccgcaataaacatatgtgtgcatgtgtctttatagcagcatgatttataatcctttgggtatatacccagtaatgggatggcagggtcaaatggtatttctagttatagatccttgaggaatcaccacgctgtcttccacaatggttgaactagtttacagtcccaccaacagtgtaaaagtgttcctatttctccacatcctctccagcacctgttgtttcctgactttttaatgaccgccatgctaactggtatgagattgtatctcactgtggttttgatttgcatttctctgatggccagtgatgatgatgcattttttcatgtgtctgttggctgcataaatgtcctcatttgagaagtgtctgttcatatcctttgcccactttttgatggggttgtttgtttttttcttgtaaatttgtttgagttctttgtagattctggatattagccctttgtcagatgagtagattgcaaaaattttctcccgttctgtaggttgcctgttcgctctgatggtagtttcttttgctgtgcagaagctctttagtttaattagatcccatttgtcaattttggcttttgttgccattgcttttggtgttttagacatgaagtcctcgcccatgcctatgtcctgaatgatataaaaactctcaataaattaggtattgatgggacgtatctcaaaataataagagctgtttatgacaaacccacaggcaatatcatattgaatgggcaaaaactggaagcactcccttcgaaaactggcacaagacagggatgccctttctcactactcctattcaacatagtgttggaagttctggccaggggagtcaggcaggagaaggaaataaagggtattcaattaggaaaagaggaagtcaaattgtccctgtttgcagatgacatgattgtatatctaggaaaccccatcgtctcagcccaaaatctctttaagctgataggcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaaaggatgtgaaggacctcttcaaggagaactataagccactgtaaccattttttaaagtgatctataaatacatttattgtactttattaggagaaaataacagtcttataccattatgtagagcatgatttcattcttctaaatgtactcatgtaaacacatatatatgcacacatagatctatagatatatctatatctgataatcctaggtaagtcagaagagatatactacatttcataactgaattgagtgtctgtggaactcctatagcagaaatcacacttcatttgaaacttcaaaattcccattaaaattctgcagcaatgaagacgcatagaaaaaaaaagaaagaaaaagaaaataaagtcagaaacaagaagagaattcctcctgtcattgcttcttgttcaataatgcattgaaagttctaactgaccgggcacggtggctcacgcctgtaatcccagcattttgggaggccaaggtgggcaaatcacgaggtccggagattgagaccatcctggctaacacagtgaaaccctgtctctactaaaaatacaaaaaataaaccaggcgtggtggcgggtgcccatagtcccagctactcaggaggctgaggcaggagaatggcatgaacccgggaggcagagcttgcagtgagctgagatcgcgccactgcacttcagcctgggcaacagagtgagactctgtctcaaaaaaaaaaaaaaaagttctaacctatgcagtaagataatgattgagagagataaaactggaaaaggaagagacaaaaatgcccttatttcccaacaaaataagtgcctttatataaaacccaagagattcaagaaactataaaactaaaaaaacattcagcaagatggtagggtataatatgaacatgcaaaaatcaatagcatttctttctaccacaaataagttttagaaaatgcaatagaggccgagcgtggtggctcatgcctgtaatcccagcacttagggaggctgaggcgggcagatcatgaggtcaggagattgagatcatcttggctaacacggtgaaaccccatttctactaaaaaatacaaaaaaatagctcgtcatggtgcaggcgcctgtagtctcagctactcaggaggctgaggccggagaatcgcttgaacctgggaggcggaggttgcagtgagccaagatcccgccactgcactccagcctggcaacagagctagattctgtctcaaaaaaaaaaagaaagaaagaaagaaaagaaaagaaaatgcaatagaaaataaggttgaaacagctattttgttgctaggtgcaacaaaactgtgaggtacctagcaaaaaaagcaaacagaaatgggagatagttacaaagaatgcaagagtgatgttgtaagtaaatggacaggaagacatcattatcagtggtctcagctatttaatgtgagtttaatgaaattcacctcaaaatctcaacagagttttaaatgaaaaatggtcttaaaattcatttggaaaacaaatggacaagaatagctaaacagtgtgaaagatgaataaggtgaagggacttgcatgcctgatattgactcattgtaaagtgctatattgttagtgatatacaaaaacagataaatgaagcagactagcgagccctgaaatcaatagatgcatagatggaaatttgtattttaggacaattgattatccatgtgggaaaaaaatacactgaattctacctcacatcatacataaaagtaaaatgctaattgtgaaaaataaatacttttaaactttgataataacatgtagaagaaaaattttatgcctcagagtaggaaataaattaattagggtcaaaaagcacaaaccataaagaaagtactggtcattttaactacattaaaatttaaattatatgtttaacagaagacatcatatgaagctgaaagacaagccatggactgaagaaagatatttgcaaggcagataatagaaaaggatttgtatctagaatttataaagaacttaaatcaataagaaaaaggctgctgggcgcggtggctcacgcctgtaatcccagaactttgggaggccaaggtgggtggatcacctgaagtcgggagttcgagaccagcctgaccaacatggagaagtcccgtctctactgaaaatacaaaattagccgggcatggtgacgcatgcctataattccagatactcaggaggctgaagcaggagaattgcttgaacccagcaggcagaggttgtggtgagccaagaatcgtgccattgtactccagcctgggcaacaagagcgaaactccatcttcaaaaaaaaagaaagaaagaaagaaaaaggctaacaatctgatagaaaaatgggcacagaatattaaggcaattcagacaaaaaagaaagtggttgataaatatatgaaaatatgtataacctacctaactagtagaagtatagatgccagttaataccacaattagtgatgtcttctcacactcacccattctgcattcagactgtccttactttgcgtggtgctaggttaactgaatcttatgcctacaggaactacaatttgaggattgcctatatactaaagtctgatgctataggattgctaaggaagtgaaacaatgagaaccctgatacatcagtgttgggggagtaaatctgtgacattcactgcaatgcaaattggcagcatctaagaaagtcacattcatagtctgtgactgagtaatttcactcttagtgtatacactaaagaagccccagcacgtgtgccaaggagacaaatgtaaaaatgtttattgcaatatcattcataatggcaataaaaacaatttaaatgtccaccagttggtaagttaataaataaatcctcccaataggatactagttggtagtttaactcgtatagcagctaaaatgaaccagccgggtgcagtggctcacacctgtaatcccagcactttgggaggccaaggcaggtggatcacctgaggtcaggagttcgagacagaggtggaggttgcagtgagctgagatggcgccattgcactctagcctgagtgacagagcaagactctatctcaaaataaataaataaataaataaatttagaaaagacatctagaaattaccaaaacattactgcagacacattattaaatatacatatatgtgctgtattattatttgtagtagagccctatgtgtacctgaccttgaactacccctgcctttttttttttttttttttttttttttgcactggggctcaattccaactcagtgttcagtttctatggagagagaggaggaaacagagaactagagtgacctggccagactccccacaaggaattctttacatcactcgcaccatcaataaaagttgctcttggtttgcaatccagccttttctccacggtgaaagaagagatgtctttatcgctttaattaccatgacaagaaggaaaattatagagttgtaatatggtctttgggggaacagtccgcccttatggagattttgggggtatgtctgaaaactgattgttagaagagaaatttaaaaccgatcagaatttttatagcacttcgatatttataaacaatacaaagaatcgcctcctcttttgtatgatcctacttatctatataatgagtgtcctgagccaagcccccagttttgtctcctgaaatgaatacatttcaaaatacctagacattcatctcatgtaagcctcaaattcagccactgagatttttatctagcaaaggacttatgtgaaaagaatggtagtgtttcttatttaagttcaggaaaaatctactcagtttttactcaagaatagttttacttgtaagtgacaacattagaacttgttttaatcctagtttcatagagatttgtcaaaagtaaaatttcaagcaaatgaatatgaatgcatcttgtttcttttatcatgaaatcaaatacatgttttgaatctactaacagggttgtgaggctttttctgaacatctagctgctgtttccaaattaatctcttaattttgtctcaggaaagagacactgaggtttgagaatccacttgtgtggtcttttcattctgtccctgagtgacacctatcctattctgcctgaagactttgccattaactcacctccccagctttgacccagtgaattctaatgcttggttaagcccaagctaaagccaagaggaattgagattgtatttattcgagggcattgttatttctgtttctttgctttggtcccaggtattttttcctatttcaggtaatggggagagtgccaacaatttccattaataagacagaaggttgccacatatacctcagtgaagatgcattagactgtgagatcgtgagcgccaagtcatctgaaatgaacatacttatccctcaggatggtgattatgtaagtacctttcaaaaggctgtcaagaatttttctggagccttcattattaacattcttagagattgattaatcagctaccaacctgcgagctttatttgtagcataattcacaggcaggcgaggaattcagggagctgtcttccacatctcttcccgcctattagcttcttgactgtactcactcctggatttccgattctcaaggtagtgtactaataattcatttaatggaccagcgtttatcaaatagcacagcatgcatctgagttcgtattaggtaggactaaatattttcctttgctctggtggaggtaaacaggaaagaaggagaaataaatacttaggggaaaaaatgtgaggacagagaaaagacagtaagtagggctatttgtgcagctatgcttaagtgagaggttaagtgtaagaatcgggaagttttatgaaaatgccagttcccaaatcttccagctggaggttggattcaggaggcctagagtaaggcccaggaatccagatttttaactggcatgtatcccttaagtccatccaatggcccttctgagaaacactagcctaaaagacttggccactatttattttctcagctttctctcctcaacaaagcactttctcaaagaaccatacacgtattctcacactttgaaaagggagtatgaataaataagtacatttcctggttcatgaagtgtgatggatctgctagttgctacttgaaagtgaggaaataaatacagagaaggccaagcatggtggcttacccctgtaatgccagcactttgggaggcagaggcgggcagatcacttgaggtcaggagtttgagaccagcctggccaacacggcaaaagcccgtctctactaaaaatacaaaaattagccgtgtgaatcccagctactcgggaggctgaggcaggagaattacttgaacccgagaggcggaggttgcagtgagctgagattgtgccattgcattccagccggggcgacagagtgagactcagtcacaaacaaacaaacaaacaaaaacagggaaaattccctctaagtctgcctgtgcagggagccagtgaaccagggaaggatgggagaaaacataacttagcaggcaaaacatctggaagaggagctccctcagcctaaggggtcaattgccagggcctacacagcaatcaacacacaggttgatctccttgagcagacggtgtgactgctgccacattctcccttccccacctggcagtaagttcgtcagctctgctcagccacgtgtcatacattacaggccagaattcatcatttcagtttaaaaaaacaaaactctgcaagcctcaggccatgctttactagtaagtgtgtatggacagtctaaccctgagatacagaagagtcctctcttgggccctccacctaaaaaaattcctgaagagctgatgccaacagcttcagagtaggagagtcaaaaattggagggagccctggcctttgcagctgtttaagcagaaggaaggctcagctgcatgggactggatctgctaagaaaagcagtgggatttggatgaacactgcagactaatgaagctggaatctatgggcgtgggacccaggcacctgtaactgttaaagcttcccaggtgattccagtggggagccaacattgaaatccaccggcctaaaggatgagtgtaaatcaaaacctgagcgttcatgctaaaaaccaaggtcttggccgcgtgctgtggctcacgcctgtaaatgccagcactttgggaggccgaggcgggcagatcacgagctcaggagatcaagaccatcctggctaacacagtgaaaccccatctctactaaaaatacaaaaaattagctgggcgtggtggcacacgcctgtagtcccagctactcaggaggctgaagaaggagagtcacttgaacctgggaggcagaggttgcagtgagctgagatcacgccactgcactccagcctgggcaacacagcaagactccatctcaaaaaaaaaaaaaaaacaagatcttgcctcttacaggtcaattaccttgtggccctcttcacatgttctcggttggagctggtagggaacaacacagaggacctgccatgggcattatggtgtgggaatggatggaggagatgattcgtcctgaaagaaattggtctcccagagaagactcgttagcatattactaacccctcacagccaggaacagatttgggacagctgttgtgcaattactatcaaagaggtgccttcatctggcacattctctacttggcctggttcttgagaacaaacaccaagcctcatctacccatccagaagagccccagaaggaatattggctgcacaaacacacacgttattcagattgtgggttctttacttcaagatttttccattgcagattttactcaagaagaatacatcactcattatagcatgggctttgccttttattttatttatttgtttgtttgtttgtctgagacagggtcttgctctgttgaccaggctggagtgcagtggtgcgatcatggctcactgcaacctcgaccccccgggctcaatcgatcttcctgcctcagcctctcaagtagctgggactacaggcgtgtgccaccacaccctgctaatttttgtatgttttgtagaaacagtgtccctgaggataggcagagacaatggagagggtgggattaccatccccactcctgggaatccttccctgcaactctgccaaaagagataccaaatcagagtggctcttcagcagcactacactgtgtaaggcttgtccttatacagtggggtctcgctatgttgcccaggctggtcccgaacttctgggctcagaggatctgctggcatcagcctcacaaagtgctgggattacaggtgtcagccaccgtgcctggcccaggcctttccttttgaatgaatgaatggcttcatcccaaagaaacagttggatcctacatctaggaagataggtacccatgtgtgttccatggaaacaccacagctcatgatcatgggcatcagcttatcagacacatgaggtttcaatgagcaccgcatggactggaagtccgaggaggcccagaagacaggtccaaggcctccttgccttagagaggttttctatcttcttctgaaggtctctgtccttcttccttgccttggaggaggtcttctatcctcttctgaaatgactggagaatcactgtctgggaaagcagagtgttgacttagactacttttattttgactattctctattattctttgtctgtacgtgtgtgtacgtgtattttccaatgggagaagtagagtgccttggtgaagggtaaccaacgtgtatataaccctaggctcatttttacaatttatcaaagagtagagagctacctctgggataaaacctttctactccatgtgattggaaccagcagcattggcatcacctgggagcttgttggaaatgcagattctcattccattccccagacctactgaatcagaatctgcattttcataagatcctgaatcagaatctgcattttttttttctgagacagagttttgctcttgttgcccaggctggagtgcaatggcgcaatctcggctcaccacaagctctgcctcatgggttcaagtgattctcctgcctcagcctcccgagtagctgggattacagtcatgcgccaccacgcccggctaattttgtatttttagtagacacggggtttctccatgttggtcaggctggtctcgaactcccaacctcaggtgatccacccaccttggcctcccaaagtcctaggattacaggcatgagccacagagcccagccagagagaatctgcattttaataagatcctgggtcagaatctgcattttattattattattattattttattttattttattttttggagatggagttttcacttttgttgcccaggctggagtccagtggcatgatctcggctgaccgcaacctctgcctcctgggttcaagcgattctcctgcttcagcctcccgagtagctgagactacaggcgcatgccaccattcctggctaattttttgtatttttttagtagagatagggtttcaccatgttggccaggctggtctcgaactcctgacctcaggtgatccccctgccttggcctcccaaagttctgagattacaggcttaagccactgcacccggccagaatctgcattttcataagatcccagttgattcatgtgcatgttaaagtttagtggagagtagtaggtaagatagagcgcagatttgaattctagctgcgctgttactggccacatcatttggggccagttgcttactctcaggcctctgtttcctacagatggcatccccaagaactcctagctcatagggttattataggagatctgctgagttcatctatctccagtgcttagaaggatgcctggttcattctaaatgatgcttttagctttaatgatgatactggcttgaagtcacagaactgacacatgacatacacaagtctccacgtgacaaagacctccccatgacgcagcttgcaattcgatcgaatttctttgcctatcatgtggcacaaatcagcctcaccatctgtttgcaaaaggaagccttagtttaaataactttgttgtagtttaaataactttgttgttcttgcctttttccagagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttataaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcattttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatg

SEQ ID NO: 37732 - DNA, 124703 bp, Homo sapiens
cggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggtagggaaggggcgggctgcggtctgctggctgctgaagtgtgccccgggcgtgtgcacccggcgtgtgcaccggcgagcgctgcgatccggctctttgcgtgtgtgttgtgcgcgcgtgtgtgtgtccgggagtgcccgcgtttctctgcgcggtggagttgtgggtgactgcggacggtggtgtgtctttcgaatggcgtgtactcgtgggcatccatgtgtgccttaggtgtgcacattttggactgcgtttgtggaattgtgtgtcggggcgcagttgctggtggggagcggtgcctggcgggtgtcgtgtgtgagcagctgtgcgcagagcggggtggcggggtgggtgtgggtggtccagccccacgcccagagccccctgtccctgctggtcggcgcagtgcgtagcttaggagcctcgaggacagctgggacccgacgggcaagggcgggcctcgcgggcaggctgggcagccctcagggaacaggtccgtgcggcccacgtgggtcgcctgtgagcttctgccaagggtgggggcccacgcggaggcgatccgctcgttcctcccagggccatggggcgacgaggagagccctggcctccccgcgacccgcactgcgacctgggccagacgcgccaccttccccggtcgcggtttgcttctctttaaaatgaggacagctcctcccttgggggctgtggtgacaggtgaaatgagaacgcactgaagacagctcttggtccaaagccccgcacacagtaggtactgtgttaattggattagcgtctcctgtttaaaatcctttttttttcccctttatcgtgggtggggccttacattttccccgggcgtgttttgtgcctctccctggccctaacttaaccgcgaagcactgagattcgagaaagtttagctgccagctgcgctgcctcctgcagcacctcccgggcggcgccgcctccgcgagtgcccgagagcgccgcgctgggcgccggccctgccccagcccccaggctcccgcgcaagcgtgggggtccctctcctggccgggaggcagcgactgcggagttgagaaccctttggttcaacaagttcctagtccgggaggatgcagctcagctcgtggagtccgagagtcacggcgtaaaattggcgcttcccgcacatgcagatctcgggctcccggggtgtcccggccgccaaaggccacccctttcctcctggctgaccccaattccaccagaggaggatgtttgccagggacgccgagtccagctgctggcctcggcattagacaacccccagccccagcccctgccatccctgctcccttgcagccagcctcatgccgggggtgccacatgggacacctcctcctagtcccacaccttaatttaaaacatttacttttgaaacctactagtcgtaaaattgaaccgcagtgaacgagcacccagctcttaccacgactcactctctggagagttctggcgcctcggcgctggctcggacgcagcaaggccagctctaggggtcgggtggctctcggccagagcgaaggatattctttcccttcatcgccttggtgtctttctctgggggaaaaaaatcgcctttaaccaagggagccaagatctcaccagtgcaggaggctctcaaaatggagcgccggcatggggttgggctgcggaggggacagcatgggcggccttttggtatggatgcgcttcccaactgtcaggggctacgtgatggtgttcccagagaggcgggctgctttgcgggcttttaggagccagggatagaaacctggtccggttcctttggtttccctcggccgagactgaagccctgcaatcctagccatggcaggccagggggatgcgatgaactcattttctcatttttcatcctgacttagtgacaggggcacacttagaatgcaccctgttttctgtttcatcaaatgattttatgtcctacaagaaaaaagggcttttggtgtgaatcctactctttcctcataatcaggttccataataatattaaaaaaaaaatcagtctggctttctcagctcagaagacagacccaaacccaggtttgtgttttgttttgtttttgtttttttctagttaaagccagccctttgtctcaagcaagccagtgttttggccttagatctatttctgtttcacttttgaaagtgcctgtaattactgagctcttgaggttttattggataatgtggcaaagggaaggcccgggggccctgcctctcccttgcggtgggatgtggtgccacggtggcacattctagccttgcctgctccctctgcgtcccactttcatgctgtttttaaggtggaacagaaatgtcaatgtgtgataacaatttgggagactttgtctttggaatccaataaatggaaggtcctttgatctgtggagaaaccagaacaagtcaaaaccccagaagaacagagatttgcccaaactccagccaatgacccatttatttccaacaagccctcctagagatagattctaagtgaaatacaagaacgtggacacactccgtcccctttctggccacagggctgtgcagaattagaagtgcagtctatggaaggacaaggactggacttcgcttggtgcaaacgccccagccaggcgccccatactcacctagcaccatttcaccctggagctgtttcctcctgttgaagcgctggtgctcacaccccctaccttcagggctctgcaagcacagttccaaggtctgcagcgcgggtacagtgcatgccctgctgagtgtgcgtcagagcagttgtctccctgtgacacttattctaagaccctttttgctactcataagtggtagagtaccacactcactcatgaaccagtgataatccagggtactaacgggggccccggagtttatttggcaccgaagattaagctacttggcagctgaatttttatctagattggggttaggtttgtattaaaattttgcattccagcaagccctaaaccgtgcttgttcattgtgggataatgcgttcaactgatgagttgccaggccaggattgatgggggattatgtgtattctgctagtttgtcagcacctgatgtcactgtgctggggggtgggggaggcatgtttggagttaggatgagcagacacttgtagattttaatcacactctactttggggctccctgctctcctatggtagcagggggtttctgtgtcgttcttatgtcctcatgtaaagctgcacatctgtgaatgtcaggtagctcttgtgcttttccccttagattgagtttctaatctgggaatgacagagggtggctgtatatggagacagcagcatgggcttaggggctcttttggtgccagttaccctacggaaaaaaggtttcttcaaatcactttctacaaagactaaaaaatggttggaatctagtggtgcagattgtaatatgacttcaggtaatcaatacggtttgacaggtggaacatttcttagatgctgatgagcagggcgcaagtctcaagatttttaaatcatctgaaaagcacagtaaatcctttaaagagccctaccttggccatgttgtttcaagtaaaattgaatttcagaggcaaagcttcacatcggaggcatgacgaactaaagaaatccttcccagagacctccactctcttcctgttgccaccctcctctgccagcagcagggcaggaaagatgacttcttggggctgtgtgcctttaccttaagaagcaagtgcaccctgaatgcttctaatcccgcagctgggttgtctgggtatttggatctttttggtgcttgaggtactacccaagttggcaggaagccaggagcctgggggtggaggtgtcttagccccacctgtggcatgagacaagaggtcttctccagcaagggatgggtctctgacccttggctaagaaaactcaggattgttaaatacgtactgcatggataaggttgctgtgaccctgaaaaaaggaagaaggcttttgggtggtgcgtggttctcctcttggaagtcttcccagatttcgcctcagtactctcttgccctagcttaaatctttccttgctctgtgtccccttaggcaagtgaggtctcctctcaggtaggcatgatattaagtgcatgtctagaggacagttccttctacctgcccaggtgcactggctgaactcacctatgcccacatctgtgcattggcaggtgatatagatatacacctgagctgtccccctgagctgcagacctaacactaggtgtgggctccgagctgttccacatcaaaacagagccgaggacacatctccctcactgaagctgtgtctcctacctattatggtcaacacgtctcatctactcatttgttaaagctagaaatctctggagagttttggagctctttctctgtcttcacttgaaatctctggagagttttggagctctttgtctgtcttcactttgccatctaattgggtcagccctctctgagggctcacacccactcttccggcacagcggagccttatctgcccttggcccagagaatgcttccagttccttcactccagccacaccggcagcacttcccagtttaaaacgcagatttcatcatcccactgtcttctgcctccccaaccccaccaaaccttggtttgttctcttaacgcagtaagtgcttctgatacctactgtgtgccttggaccaagctggagtctgagaaggttgggcccaggcatcctccctacctgtgcagagtttaaggtcttgggctgggggttgtatgtggggtacctatcaaataagaccagggagcgtgaagtgctatggaggggagctcctaccccagtatagggggctccctggagaagcaccctctaagctgatacctgggagagttgggggtgcaggggaggggttggagttggggctggattgttcgatgcctttcttctgtctcacccagacttccttatctgctaaactcctactcatttttgttttaattaataccaagatagaatttatctctcataaagcatgcccattctaagtgtacagtttaatgattttcagtaaattaatagagttcatagccattaccacaatccagttttggaacatatccatcaccccagaaagatccctcttttgtacaaactccctgtccccgtcctcaagccgccagtcccccacagatttgctttctgtctctagatttgccttttctttctatgtttcttagtgtgttttcataggttcggcccaagagctgtttcatttgggccttcctagagtcttctagttagaatcaatttatcccccagcaccgacgaagtgagctgggtgcttggccatcccgctgctagatggcgagctctcttacctgcctctcctgcctgcacctggctcagcactggcacctacagaatacccaaggtgtgttggctggaccagctgaagttgtgttcctcacatttcttttgtataactcctgagtatctagcagagtgtggggatttaaaatacagcgcatgtattgatgtgtcaggtgatgtgagccctgctacatacataccttaacttgtttcatcaagaacttgtgaggcaaatggcaaatcaaaaacaaaaacaaacaaaacaaaacaaaacaaatctattttctaagccaggcacagtggctcttgtctgtagttccagctactagggggtgctgaggtgggaggattgcttgaaatcagggatttgagcctgggcaatattgtgagaccctgcttcttaacaaactttttttttttgagatagggtcttgctctgttgcccaggctggagtgcagtgatgtgatcccagctcactgcagccttgaactcctgggcccaagcaatccccctgccatagtctcctgagtagctaggactacaggtacacaccaccatgcctgctgatttttaaattttttgtggagacgaggtcttgctatgttgcccagactggtcttgagctcccgggctcaaataatcctccagccttggcctctcaaagtgctggaattataagtgtgaactactgtgcctcagcccaagccatttttctaaatgaaaaaactgaggaggcccagagcaaataagtagcccaagggcatcagcagaaagtagaaggatcaagaattaaacgaggtcactttctcttccgcccttgttttggtagtaatgatatgcccttttatggccttgcctgggctggtgttcagattttcctgtacgagtcttgtcatcccttcctaagccatggaagctccttctagggcatgagtgctgtgtgacacatgttcacacagtgttgccccagtacctacctagtccacaactgaacaggtagagatggttcaagcaatgtgtgtgtgtagagaggtctcctggtaaatagaaggggctgggggagggcgttgaatgcagtggtgctgtggccttgggtggcttggtgcatttctgatgcatttctcaccttggatcattttcactctttgaggaagagagcagaggatgagatgccatttgacagatgcacaaaccaagacacagaaattgtatacccattgtacgccaggtagatcacaaatgaccgttctctcccatggttgtagagaactctcatggtggacagaaaccatgaaagaaatcatggtggaaagaaccaagacattcttgaatcggagtattagaacctcatttgcaaaataccttggaaagatcagggacactggggtttgaattgtagtctttgctctgttgtttattggctggtgatggtctctgaatctgtttgctcaggtgcagaaaggggttttaggctgagctcagatattgacaggaactacaattcaaacccaggtctgcagatgtggcagactgggtttgaactgtagtctttgctctgtttactggctggtgatgttctctgagtctgtttggtcatgtgcagaaaggggttctaggcgcagctcagacgtagatggggacgcagatgtgagtacctaggtgagtctggctggtcacgtgtggaataagtggtggtggctgccattactctttaagcattcttggatctagtgcctcctctgccactgagtacagaattccttttcaaattcgggcttatgaggcatgttttgatccaggctgtcgtagcaagggatttgatgctggagtctgtgactgctgtgcgtgtggaggcttccggaaggcagccagtgctggttactgcttggagtttggggagctgccattttggattgtcctagcctcatgccttctgagaagcatctgtcagggtccctgatgcacctacagagaccctgagcttggtggtgggggttgcacagagagagctgcaggttgttcctcaggcataacgaggcccggagctggtggtcccctccctctgtgagtgtgtgcagagcatggatcgggtctgggagtgttcgtgctggcaggccggaggaggactgctgggcacacttgcagaattgcggttctgtacagcagtgtgtatcgactgcagcgctctttttctctagcagcaaaatgctcagctctctgccttctttctgtgcatttaacagacgtttccagaaagcagaattgatgacagccccaactcctccctttcactcccatcttttctatttgctgccctgtaatcaatttttggagagaagtgagaacctctcgaaatcgatcacctatgttgaaaaaaaatcatttttaacatcatgcagttttccgtatttactgtgtgtggctggagacactcctggcagaatgagtgtgggatgtaggaggtccagaaaagcccccagcttcaggggctgagatagggccatgggtggcagaactggttgtccccccgccccccaatccctcagcagtggttgaggtgtgctttattagaaactcttcagtcatgcagtttggagcccgtgctggtgatgcagcctggatgcctggcaggggcttagcctccaggggtgggacatgagatgtggctgccgtggcttctctgtgtctttcttcccagcgagtaaaggtagacgcagggctctggcaggtgctaaggccctgcttgccttcatgctggaatgctggcaggtacaatttattcttatttcttaggaggtgctttcccctcttctttctgaagacatccagggataaagaattgctgcttttatgagcacatgttcttggtgatatgctgttaccttatctaaaaacaatacggcctggctgattattctcagagctcattgtaaggtgaaaggttatgcatttgagaattattttcacagtgtggatgggagtggggggagaagatgtagagcacaggtaaggaattccaggttttggggccagggatcgccaagcagtgtaaagggctcactgtggcctgtagctccttccccctgtggtttgtgctgggccagttgctggctccccaaaaccattatcaccattatcattatcactatcatatccatcacctcaccatcattatcactgacatcatcacttttctccatcaccatcatcatcatcatcactatcatccccatccccatcatcatcattaccatcatcattgctgtcgctatcatcatcatcattccattcatcaccattcatcatcactgtcatcatcaccatcatcatcactgtcatcaccatcaccaccaccatcatcaccatcgccatcatcactgttatcgtcaccattcatcatcactgtcatcatcatcgtcatcactatcatccccaccatcaccaccatcattatcaccattctccatcaccatcatcactatcatcctcaccatcatcaccattctccatcaccatcatcatcatcactatcatccccaccatcatcaccatcaccatcatcatcactgtcatcatcaacatccatcatcactgtcatcaccatcatcatcactatcattaccatcaccatcaccaccattatcactgtcatcatcacctttctccatcaccatcatcatcatcatcatatcatcatcatcatcatcatatcatcctcatccccatcatcatcaccatcaccaccgtcattgctgtcatcatcaccattcaccatcaatgtcgtcatcaccatcatcatcactatcatcattatcaccatcatcaccatcaccatcatcattactgtcatcatcaccattcaccgtcactatcatcactgtcattatcaccatcatcatcaccaccaccatcaccatcatcactgtcatccccatcctcatcatcatcaccatcactgtcatcatcatcaccatcaccaccattgccatcaccatcaccatcattatcactgtcatcatcacctttctccatcaccatcatcatcatcatcatcactatcatccccatccccatcatcatcaccatcaccaccatcattgctgtcatcaccattcaccatcactgtcatcatcaccatcatcgtcattatcatcattgtcaccatcgtcaccatcaccgtcatcatcaccattcatcatcactgtcatcactgtcattatcaccatcatcatcaccaccaccaccatcaccatcactatcatcgtcatcatcatcactgtcaccaccatcaccatcactgtcaccaacatcatggtgcttctcaacctttgggctgctttgggtcgtgcttgacatggcacattcctggtgagttagctgttctttgggggttttctactgttggtgtggtgattagggtagtcaggacaggatgagtataggcatagagaacccaagtggatgatggtggagtgtgattcttctgaaagggtcttcatgagaaccactgatctagaagattctgggagaatctcacgtattctttcaggcccaggagtaagccagtgttacctgctctgtggagctctcctttgtccctccagggaggacaaattctggctggagcctgaccttactgcttgtccatctctcccagggtggtaggccactttaggtaggaccctgtggatttctccttggtgacccccgcattctgggcacagagcctggaacacaatgtctgcccagatgtgtgactgaaccaccccccaattccttaactgtaggatggcggctgccttcattagaatcttaacaccttgcctgagggctggctttgcaggtctgagtggctaggtcagggcactgctagtgttttctatgtttgtagtcaattggtgagagtttgttttacgcatttgttaaaactgtgggacagtggtctggaagccaacaaggctttagggttggcagagtgactcccatcccatcattgatgtctggctttgacttggcatgggagacattgcctctccagatctcagttctctcgtttgacaaatggggcttagggttgaacagcctctaagtcctctgtcagctctgcaattcaggaaagatgtttaaaaatgcatacttgcattgtaggtacatccaacatagagcaaagagagaattttcctagctaaattgactgcaaaaaaatgaaacctcttgggccgggcgtggtggctcatgcctgtaatcccagcactttgggaggctgaggcgggcaaattacgaagtcaggagttcaagaccagcctggccaacatggtgaaaccccgtctctactaaaagtataaaaattagctgggcttggtggcgggcgcctgtaatcccagctactcgggaggctgaggcaggagaattgcttcaacccaggaggcagaggttgcaatgagctgagagatctgagccactacactccagcctgggtgacagagcaagactccgtctcagggaaaaaaaaaaaaaaagaatcctcttataatatgcaggcatcttagcaactgccatcttagcaactgccatcttaagaggcagcattatgattcagaagaaactgataacattgaggaatacatttgtggagcacagattaggagagattggtgcaggggtggggggtggcaggaagatattaaggttggaatttagggaggtgagctctgtgggttggtttcatgcatccagctcaccattcaacctttcctgttaacttcctatattaaggaggctgagattaagaagacagggactcgtggcgtaagggcgagacagacatagaggtgagtgactgcagtgggatattcactgtgggagcattgaaggttggcagtcagctagattcttaggctgtagatcgggggccttatttagaagctgtttactgttcccttaagaggatcctctagcaggaaaaaccactgctagggttgttgctttcctcattataatgatgtctttatgttcgtcttaggaggtgatagtactgattatttaagaaactggtcagccaaacttcttaactaattgtgaattagagaaaagtcagaagtagggagtattatagagataagtaattgtattattttcagacaaaagtatatgtagtaatgtaaactactgaccagattttgtttcaaattgttttttttaaatgaattgctaagaattatttgaaattagcacattagcggtaataagatagtagatattagatagattagattaggatagtaggtagtagatgtaggtataaagagactgaaaatcagctgtttaaacatttttcccaaatgtggggctaggaagcaagataaagaattatgcaggccaggcgcggtggctcacgcctgtaatcccagcactttgggaggccgaggcgggcggatcatgaagtcaggagatcgagaccatcctggccaacacggtgaaaccccgtctctactaaaaatacaaaaaaaattagccgggcgtggtggcgggtgcctgtagtcccagctacacgggaggctgaggcaggagaatagggtgaacccaggaggtggagcttgcagtgagccgagatcgcgccactgcactccagcctgggcaacagagcgagactccgtctcaaaaaaaaaaaaaagaattatgcagacagtttcatttcatttatgtttggacggggaagaaagtcagaaaatagatgggaaggaaacatatctaaatgttaacggtggttgtattccatgggatcatgggtctttcttgatttttcatgttttgccacattctaaattttcaccagtgggcatttattatttttgcaattagacaggaaagagcctccaggaggaactccaaatacccatcctttatttaccctcttaatttgcttaccaaactttcttgttatggttagactggctggcatccataatttccatacttgtgattatttaaattaatggaaatttatcataatcccttattaaaatttcttcgctgcactgaaattcaacactgagcaaatctgttacctaggacataaagaaaaacattcagtccacgtgcggtggctcatgcctgtaatcccagcactttgggaggctgaggcaggcggatcacttgaggtcaggaggtcgagaccagcctggccaacatggtgaaaccccatctctactaaaaatacaaatattagctgggcatggtggctcacgcctgtagtgccagctactcgggaggctgacacatgagaatttcttgaacccaggaggtggaggttgcactgacccgagatcaggccactgcactccagcctgggcaacagagtgagacttgctctcaaaaaaaaacaacatccagagtcttccaggaaatttaccgtttcagtgtggcatagtgtagagtttgtttattatctagaatatggtttttcttttttgtgttcttgaacttgggcgttcacttcgtttgttgacctggaaggagccatctcggcgcctgctgtttgaaccttgggtattttaatgaagtggtttgatgtcctgataccaccagcccctgctgttgcttttcacggccctggcttttccaggaataatctccttactgtttgtcattctaatatgtttcagctccctttttgaaaataactttttctgctccccttccctgcccattcttcatgacccccagagaatgggcctgctggtctctagcccctgtgaattggaagactcctggcgatgatccttctttttctctctgtgactcaggcggttgatgttgggttgaccgtatttctttgctggctggtaagcagggccacctcagcccttgtgagggccatgcctgactttcaatggcttccctccaaaggcttcttaggccgttcctccccatcgtttttcagaggtttaatctgtttgagtccaggatattgagtcagcagtggaaagttatgaagatgaggccagccatcagaaaaattggctaatatgaaagattaattccagggtgaacaaaggagagggatgctggggccgggctgcctccccaggcaaatcacatcactgtaaaatccgagaaaccagaagttgcctttgctactcactcagtggctgcttgctgtttcttggattagatattgaaagaatcccatctttatagtctactgttcatatttatggtctggagaagaaaatgtaattttcagcaaaattctatcacgtctggtaaataatttcaggatctttacctatgataccacattaaaaaaaattcgtatggcttcagcattcagaaattgttcttttcaaactctgggccctcgggttattacaagatttaacaccgaggcaggaagcctgctcgcctatcactggagacaggtaggttgctatggagaccaggtgtgtgtccctgcggtttcctgggtatcccagttgtcctggaaaagaaatcagctcactttatgtgatatttctgcaatagtgtgtgtgaattaagtttttctaaacacagatcagatgtttttgttgacttacagtgtgatttctgacataattttgtcctcggttttgttttgcttaattatgaatcctacataaccctaccttttcctatcagaagcacttccatgcatcaagaccccctatccaaaacagccacaacaacttcaccaacaaaatctcttaaagctagagatgcctgctttggtgtgaatgatgattaccccttaaaataattcaacaattttttttttttttttttgagacagggtctcagtctgcctctcaggctggagtgcagtggcgtgatctcggttcactgcatcctgtgcctcctgggttcgagcaattctcctgcctcaacctcctgagtatctgggagtaccgggatgcaccaccatgcctggctaatttttgtatttttagcagagacggggtttcaccaggttggctaggctagtctcaaactcctgacctcaggtgatccacccaccttggcttcccaaagtgctgggattacaggtgtaaaccaccatgctcggcctcaacaattattatatatggtttgccagatcctggcctgggcactggggatgcaagatagagcaagaccattggaggccctgccctggcggagcttgtattagggttgtgatcctagaccacatgaagcccacaagggggccctgggctcacccgttcctggctcacattcactgtcagccacagctaaacctcggggcctggaacctctcttgttgtccccatgggacgagtgggcacatgccttgttggatggacaataacatcatctgtttttgtttgatgtgttattattcagaggcatttttcagaatggagaacagtgccttatcagtctgcttctgataattttatacatgaaaaaaatcctatttgtgcatattcttgggtctctccccatttctaaaggcagtcaacttggtggttggctgtaaaaagctctttacacttcctaggacttgtcaaatattgacaagtctttctcctttcatccagttcagcaccagcatcctcaaactcactgaaacagagcatcccacagtggcagccactgtaggccccaggtgggtatcctactcctccacccccgccccagactcccccaaccccagctcgcacctgcagaagttacgtctttgcagttatttcaggagaaaaaggcggccactctttctctcccttctttgggtttgtgttcagcaagggtctactgcagtcccggtgccggacagcctgttttgcccatgcttgttaactgatggggtcctcaagtggccttgtgacaggcctgataaggccgcacgtgggtgtggttagagttgatgaccgctccggacattggcgatgtgaggaaagtgacagactccagcctccatgtgcagccggtgattggccgggtgggctcggttttctagtggcaaaggatgctgtgatctgaataagaaaacaaacctcaggccccaagtgccacgggcttagagacttgagaggaggtgcttgcaactccatctgggaggctaagggcagccaagagctgctgtcttgaggctgacccactcccttgcagtgtaatgggtagtgaacaggccatcctttttaaaggaaaataagtgcctccctatggactctgttcctatcctgctaccctccctgaagcttgaatagcacccacccgtgccttctccatgccagcccttgggtctgccgggaccactgccatgcttttgatggacacggccttgtagcgtctatatcctcatctgtgaaatgggaattccacagcctccctttcgcaggctgcttgtaatagttgccattaaacctcttctgaactctaaagtgctgtatcaatgtaaggaccatcatcaacatcattgtcgtcctcatcgtgagtctttccaaattcacctcctgctgccccagcacgggagtgtctgagactgcaggtttccttgatgggttcctggggcttcccttgtggaaatttgagttctgagccttctgcacttttccatcccccagtctggagtcaacctgtatttttcattttccctctgcaagatgtcagcccataggagaggcctggaggcttgcaggggaaatgggacgatgtttgaaggaagcccccgtgcctgtgggagcatgcagcctcctccgtctttttgtctgccaggcaggggagtaatttgccgttatgtactgggcagtctgggagctggactctcagatgaaaaatgcttgttcaagcacagacagccaggcatggctcaaatcagagcatcgatttagcaagcagctctgctcaaacagccagctgtgtgatcaccttttcaggggatgataggctgacgggcaggtggggtggggtggggtggggtggggtgggcagactaatacagggaccctgtgtttgggagcctctgtttaagcagagaccgggcctggagagagtatccctgggtagggaaaggtgctctcacattagtgggttccacctggccccttggtggagctcccattcattcattcactcattcactcattcattcacatcgtgtctactatgtgccagtctctgtgctaagagagtgatccaagcagaaggtctgaaatcctcagggattcgtttcccagccgacttatgccttactaagtggagcaggttctgggctgcaggggactgacttgctgctgcaggtctgggtcttgaactaagggagaaagacaatgcccatcttcttcttggcgcagtcatttgaggagaggagcatttgcttcttgccaacctgcctgcctgggaggccctcttgctcctgcagccccccgagtcccctttgcagctcccagtcttgcttggggttgcctcctccaagaagcctcctgggctagctcaggcatcctgtggaggcactgctgggccactgatgcctgagctcctgtggcctggctgtctgcagggcttcagtcctggcctttcacttcccagacatgagtcttatctttccacttggttagggcctccccacggacatggacggatatggtttggatttgtgtccccacccaaatctcgtgttgaattgtaatctccagtgttggaggaggagcctggtggggggtgattggatcatgggagcagagttcctcttgctgttctcatgatagtgagtgagttctcacgagatctggttgtttgaaagtgtgaagcacctccccctgctctcccttctgctccagccatgtaggacgtgcctgctgtcccttctgacgtgattgtaggtttcccgaggcctccccagccatgcttcctgtgcagtatgtggaaccgtgagccaattaaacctcttttctttataaattacccagtctcaggtagttctttatagcagtgcgagaactgacagggaccgtgtgtttgggagcctctgtttaagcagagaccgggcctggagagagaatccctggggagggaaagctgctctcacatcagtgggctccacctggcaccttggtggggctcccattcattcattcattcactcactcattcattcacatagtacctagtatatgtgccagtctctgtgctaagagaatgatctaggcagaagacctgcccgctcagggcttctgtttctagctgggagcaacaacagtaaactaaataagcagattatattgtataatatagtaatacttagaaggtgatgagactgtggaaaacaatacattagtgaagagggtgagggtattggatggaagagcgtgagtgtattaggccgttccacattgttataaagaaatacctgagacacggtcattaataaagaaaagagatttaattgtctcacggttcttcaggctgtacaggaagcatggtgctggcatctgctcaacttctaaggtggccttgagaagctacaatcatggcggaaggtgacgggggagcaggcacgtcacatggagaaagcagaagcaagagagagaaaaatgcaaggtgccacacacttttaaacaaccagatcttgtgagaactcactatctcgaggacagaaccaaggggatggtgagaaaccattcatgagaaatccacccacatgatccagtcgtctcccaccaggcctcatccccaactctggggattacaattcaacatgagatttggttgagacatccaagccgtatcagtgagagatgcagtttttttttttcaggggaaagtgttgttgttgttgttgttttaataagatataatttacataccatataccatgaaagtcgccatttaaaaatgtacaattcagttgcttttagtatactggcaaagttgagcaccagtagctactaatttcagaacattttcatcaccccagaaaaaaatctcatagccattagcagtcactcctcaatctcctcgtgccctaggccctggaaaccaataatttactttaggtgtctctggatttgccacttctggacattttatatcaaggaaatcatgcaatatgaggccttttgcatctggcttcctttaccaagcacagtgttttcatgcaccgccaatgctgcgtgtgtatctgtactgcatgcctgtagatggcggaataatattccaatgtatggatagaccacattttgtttatccattcatctgttgatgaacatttgggctgttttcacttttggctattctgaacaatgctgcgaggaacaagttttttttgtacaagcgtgcaagttttttgtggatgtatgttttcatttctcttaggcaaatagagagacacaattttactttttatttattttattttttatttttttagagacaaggtcttgctctgttgcccaggctgaagtgcagtggcgccatcatagctcactgtagcctgcaactctatggattacatgttcctcctgcctcagcctcttgagttgctgggactacaggcataccccatcattcctggataatttttaaatgtttagtagagatgagttctcactagattgcccaaattcgtcttgaactcctgggcttaagtgatcctcccaagttagccttataaagtgctgggattagaggcatgaaccactgcacccagccacagttttaaatagggtggtcagagaaggtctcatgagaaggtgacatctgagcaaagacttgaagaaaataagggcagaagccacacgaaaaccccagcaggacagcaggtgcaagggaacagcaagtgcaaggatgcttccaccaaggggctggaaaatgaaaggcttgacttcaccagctgcctcccaaccagggggcccagtgagtttaggcctcactggccctttctggctgaggggcagcctgctgcgaggggtttccctttctgaataaagagtcaaagtcccaagacagatgatttttgacccatgcatcttcttcctgcctggaaagcagatgtgattcctggagatggggcagctgttctgtggccatgaggttgaaatccatgtgctaaagacagtagagcagaagaagactgggaccttgatggcattcttgagctaccgcctgaaccttggatctcctgcacctgaactttgctctgtgacacaaagaagaccctttcttatctaagccactcttatctaagccaccgcttgtcacgttttatgttgtttgcagccaaatgcattcctcattgatggaatgtccaacattgtccccaagtcccccagatagatccctgggggctcttgacagacagacagcaggcaagcctgggacacacgctgcccccttctgctttcctgtccctccatcgtgttaagctggtctctcaggtgggcatcaggattcagctatcccaggctgaccctgaggtccaccatgactgtgctgcagccaccaccactggccgcttcatggcatgtttccagcacaactctctgacctggctcccccggttccccagacgcgttccccacggagtcccagcgtgtatgcatggggtcacggtgctccacgctctcaaccgttggttgcaggttcccgtccagcctctcaagctggctgctcccctttctcagttgtcccctgtgcctcttgtaccctaacttcagtgttagagcacctttcagggggaatggcgtaaaaaagccttcctttccagtagacagagtgccctggccagcagaggccaaacacattcccattcagctttgtttcatgctggatctggccccaggcctgcacctggccctggcagtgggcgcacgttaggtgggattgctgaagacaatgggtgactgaggcagttacaggtgtcagccccagatgaggctccccaacctgtaccctttaccctggagctggccccatctctcacagcccagtggtgtactaccttaggtaagcaccagttgcgcctcactctaatgaaaataataaaagctcaaatgaccagcactgtcctactgctttatacgcatgacctcaggtaatgagaattagcccacatccattcattccacaaatatttatggagtgcctactgtatgccagggattcttccaggcactggggagacatttaaaaaacaataacaacaacaacaaaaatctgcgtcttgtcggaacttccatatacacttccactggctacttcatggaaacatctggaacatctgatttttctagtcttcccattactaaatgtggcacaagaacgtagtctaaaggatgtacttcaccatgcaaaagctcttgtcatttcagaaaaggaaggagaattaagtaaaatgtacttcaagaaagtcagttaagaatttttccagttaatgaaaatttaaaatgattggctttcatcttgctgttttccagggtcccactattaagaactcactcatcctgttgttattaagggtgaaacccagacatttccttatgtaaaagccaattaaaataaattaaatgcaaatactgtttcattgtcatgtcagttttgagaaccggatcaatcagaggttgtggaaatgccaaagttgttaaggctgtggttaccatgacaacagctctattgtgtaagtggtctgttatttgggaattcttccttaggtcaggctaacagtgatgtcatttctcagggaaggggacggagttctctggagtcaggtctggggccaggagacctggtgagcaaaaactggggttcagccagaactaccagttttgtgaccatgggagacagtcccttccccttttgcctcagtttcctcgctttggggatagccattgcacagctgtgagtatattgtggccattcagcacttctcaaaagttgctgctctgctaaaaaattttggggattcctgatttgccggctggttttcagcctatgttttggggaaatgcaaatgataggaaaccacccctggtcctgccttaccggttctagcagacctttggtgaaactgggagttcttgggtcctcttggctagtggctagtgaatacctgctgggggagggggtgtttgctttgctttgtgttgggggtggggttgttattggtttttacattttgtttgcaatattgggtttgctggtttttgtgttttttttttttttttttttttttgagacagagtctcgctctgtcacccaggctggagtgcagtggcatgatcttggctcactgcaatctccacctcccaggttcaagtgattctcctgcctcagcctcccgagtagctgggattgcaggcctgcaccaccacgcccagcaattttttttttttttttgtatttttagtagagacagggtttctccatgttggccaggctggtgttgaactcctgacctcaagtgatccacccaccttggcctcccaaactgttgggattacaggcgtgagccactgtgcccagccgggttgctgttttagttggtttttgattttagagagagggtctcgctctgtggcccaggctggagcacactggtgccgtcggagcacactggtgccgtcatagctcactgcagccttggccccctgggctcaggcgatcctcccgacatcgtaattacatttttgcagggttttcagttcacaggtgtgctctcccacatccccatttaagtttacttatttttcagccccagcctctgaggctatcattattttacagacgagaacaccgggactcagagggtgatttgtccctagtctcagggctccaaggcggcagtgccagcgttggtgggggtccccagtgccaggccagggtggcactgttctccctgtgcctctctgcttgtccccactgcctgcttctgcagaggcctgctcagagcaggtttccagcaaccttcctcgccagcatcctgctaagcaggccctggagggcggtttccctgcttccccacaccgggccagagctgccttgatatttatttcagggcatccctgcagagggaactgctaatgcagtcatggctttaagacgtcacaagccacagctgcaggtgcttcatcttaaacatctgccttcctggctgggagaagcccgggagcacctgctgcaggtgtctttgcacctcggtcctgctggtcccaggcccagctgcggccaattagcacctctgttgggcaccatggccatttccttgctgcatgggagccgctggcctttttccactgtgttgggggaaagttgttgggaaatgaggaagcagttggggatttaaaaactctatgcaggaaataggctgttgggttaacatttaagccactgaacagtcatggagtgtttgcttggaagtgaggcccacgaggctgcagagggccatgagattcaaggatggtgttcgtcaggcctgtccgtcatcctctctgggttcgacaccatctcagggtactcatgcctgttaggtgcttggtgaacaaaggcatcccagacagaatcaacccagaaggaagaggggtgggtggtaaacgttcgttaacttagccatgttctcttagggtttcttctcaaaataagggcagatgggagatctccctgcctcaaggggtccctggccaaggggctacaggcagatattgcccagtcagccccagtgaggtgacagaaggcgggaggtggcttcagtgtgtttgaaggaggctggcatcacaggttctaaagcagatggcaggagccctgtggctgggcctgcttcagaaccttggctggctgctccttggaggtgaggtgggggcaggcagtgttggctggagacttgtggggggaattggccgcctggggtgcgtgctggcctgcctgccttccgcttccgtgccatgagccccttgttctcagctgtgaaggtaggtgaggctgccctgcaccagccagcagactgggttaaggtgggaatcaaaggagaggaggtgttcagctggctggagacctgctgagccccttgcatgaggagggatttctgtccagcgcccctggtcctcaagctcctcctcagcagcgttcatgagcacagggtgtgggtgtgactggtccctttgggcagaatctgagagtgcccccttctccctccctgtgcatttgaaagttggctggtgctcgctgacagatgccgaggctcccgtttggcagctggccatggcagccgcttgtcctccactctccctagatttggctgagctgggcccctgctgtgccccacatgccccggctctttgtctcggttgtccctttggctcagctctgggtgtcggctcctcggaagcccttcgtcacccaaccagagtgaactccttctcccaggtggccagagcatgttgaagtgaccctgactttcttctgtgggtcctacattttagcggggagtacaagtgcctcttcactgcagcatctcctaaggaagtgagcctgtggggaggtctctgatgctactgggaatccagcttcaccttcccccaactcctgggatttgcagccacagctaagagtgggagaactttgccttgtttgcattgctccagatcgtgttaaacagaatttcaaaacatgcattttgtaggtagtagttctgtcatccagaatgtgtaaagtaactctctaggtagctgttatggatggcctgcaggaaggatcataccagtgacttcttttgagccccctgccgagtggctagcgtcaggtgggggattagactctggttctttgcttcctggccctgtgagccccaggcaagtcagttaacttcttggagcctcagtttcctgacatgcaaatcatactgacctggtaaggctattgtcaggattatatgagctattatatcctaaagtatattatatcatactttatagagcgtagtatatattcaactaactgcatttgtgttagttcctttattttgttaacatggggatcaatggctttttttttctgatttggtatttattttaagactaggttgggaaccaattttccatagtcatctgtgggtataagtactcttaccttcagccaggacttaattttggccaagagccttggcttattccagcagagagtggagttatttagagccaaactgtaggggactgaattctctgtgtagcactttctgcagacagtggtaacattaatgacttactgcatatacattcataagtgggtgatttatggttagccccggatccataactttcatttcctgactgatatatcagaagcttcatgtataaaggcgcattagatttagtaagtgtaaaagacttaagttgaggtcatttctgtccacaagctgttcatggtgtagctgttcatgtagctcagctgtgggaatggcctggccctatgtgatgcggaaagacagccaagggggacagtggcacatgcctgtggcacttggttctgtgtgtggtctcctttgtatccccaggaactctctgcaataggaaggtgatggccaggatctcattttacagaggaggacactgaggcccagagaggttaagtgacttgtctgagggttaacagctcctgggtggcaggatttacattggcgctcagatgcatctgaaccccaacctggagtggtgccagcacagagcaggtgttcagtaatgtttgctgacctatgtgatggttaatatcatgcgtcagcctgactgagccaagggatgcccaggtagctggtaaagcataatttcaagttgtgtctgggagggagtttctggaagagactggcacactgagtaaggatctgccctcaccagtgtgggtggatatcatccaatcattgagaacccagctagaacaaaaatgtagagaaagagtgaatgtgctctctctgcttgagctgggacacccaccttctgctgctcttggacatggagctcccggttctcaggcctctgggcttgagctggagtgactccaccggctctcctgagtctccagcttgcagacagtaggtcttgcgactcttcagcctccataataacatgaaccaattcctcataatacatttctgtctgtttatttctatatatttattggctctgtttctctgaagaaccctgactaatacttccccatctgaactttctctgccccttttgttcgacatgtggggggttgctggggaagctaattagaatacaggttcctgctgacaccccacccccactcccttccttcatcaagatcactagtggtgagcctttaaatgcctgtaagctgtccgaggggttcttcctaaattaaattaaatttttaattttaattacttaatttttttgagatgggatcttgccgtgttgcccaggctagtctccaactcctgggttcaagtgtcctcctgcctcggcctcccaaagtgctaggattacagatgtgagccgccactgttggtctctaggggttcttatgcacctagaatttagagactcattgctccaagcttcattgaatctttcctgaacagtcttgtgataggcgggataactcccacccctcagatgctcacatccgaatccctgggacctgcggatatgttgccttatacggtaaagggctttgctatgtgatgaagattgaggaccttgaggtggggacagtatcctggattaccagggtgtagtcactgtattcatgtaagtccataaaagtaaggaacctgtcccagctgcagtgagcccgagggaggtgtgactctggaagaagacgcagagatgaaacactgctggctctgctgacaggaatggctttgagccagagtgtggtggcctacagaggctggaaaaggcaagggaacagatccacccttaggtcccccagaggaaccagccctactgacacagtctccgtgggacctgtgtccacagacagaactgtatgaaaacacgattgtggtgtgtaagccactaggttgatttgttacagcagtgacaccgggctttgtctctgcttttgacttttcctccagtgtgatcccttcccctgcttctgacccgtggatcccagccctgcccaggcccagatcctgggctccaggtgggcctgggttggggctcccagctgcaggaatgcaaagttcatggttctacaaagtgctttgaggtgacgttggtcacatcagctcggcctcagatttgctgctttttttctaaagaagagacagctccaggccctgcctgactgacctagttggggatgcaggccgaggccatatcgagcagggtaagtttccaagaatctggctttaggattagtcgggccacacggaaggagttcctggtctcgtgacacctgcacaaatggtcttcaaccctcaaaacacttcctgttatttaaatcttggtcctttgattttttttttttttccttttagagactatgcacaatttatgtggcaagctagagatgctttctttttcagagcggcctttatgctgtgttcggggctgtctgtcggcgccacagggaatgggggctggtgagtcgtgctcagaaggtcccagtctagatgcttctgacatggacaaaaggagaattcctgactttttggtggatgtttgcaattcccagaatgcttattcttatttagtcctcataggagagtggcgaagggcagcagctttggagcaagggccaccctgcccctccccaccaagccctgagtcgtctaaccttcccggtgtattagtcagctctggctgctggaaacggggtcatagtctgggtgccttaaacaacaggaattcttttttttttacagtattggaggctgatgtctgagacagggtggcggcagggttggtgtcacccgaggcctctctcctcggctccgtgtagccctttctccctctgttctcacacggccatccctccgagtgtgtctgagtcccagtctccttgtgaggacaccagccctagatcaggagccacgcagtgacctcattttaccttcatgacctcttcaaagtccctgtgtccaaatacagtcacatctggaggtagtaaggattggggcttccacataggggttttgtgggggacacactcagtccacgttaactcacttcctgcccacggcaggggctctctgtcagtgtgtctccgactgcggaccccgatcatctttgtgagaatgcaggttcccaggcccacaccgtgctggttgagtcagagcttctgggtgcagcctgggggtgcagcaagcccacccctgcattcggagagccttagcgggaagcctgttgcttgtgcctcctttgcagccccggcctctccagttctctgtgtcttgccatcttggcttcttcctcatcccgcctctcgctccatctcgtggcctcccatctgctctcccggctgcaggagcggtttctctaagccttgcaagtgaccgcaccctcttactgcatgcgggccttgccaagagcctgcagagggcggggcgggctctggggacagcctggactctcctgcctgcccccaggtgcccccggcccagccacagggtgctggctgcctgttactcagcacgtccgcctctcctgcctcctgagcccacaggcgcccttcctgtcacccgagcgccctctccttcctcacctcgccacctacgcatcgtcacccctcctcctgcgtttcctcctgtctccccggggagctcggagttctgcaggcacggggctggctcctttcttcatgtcccttgtcccacaggacaccgtttctgaacccaggagacactcaggaaaccttgctggtggaacggatgcagcagcgaggttttccggggcaggaacaccctcccaggagcttttccacggccaagcgctggctggtggtggagctgcgctgaagtcagtgtgtgctttgggcccagctgcactgtgcccggggtccagggatgggtgtgaggctgtctgccccccactgcacgcccggctgtcagaggcatctgtctcttcccccgcatgcatctttctccccgtctggcatggtgtttctagtcttttgtggatggggacataaacaagccgccatcaactgcttggtgacattggccaatcctgtggtggccccagctgggcttgctgcctgtgtgtggtgagggtgcccttcttgtcacccgttgtcatttacgagacagccctgtgtcacctgttgattcagagggagctctcctcatcacctgttgtcatttatgagccccgtgtcacctgttgttgcttcacagggagcactccttgtcacctattgtcatttatgagccccgtgtcacctgttgttgcttcacagggagcactccttgtcacccattgtcatttatgagccctgtgtcacttgttgcttcagagggagcgctccttgtcacccgttgtcaggtgtactcactttgcttctcccttcctgcttttggggacgatcacaggacagtggcttcagaggggaagtacctcgacctggctgaggtcatgcccagagcctgactgctctctccacccacccatgatcccgtcagcttcttccccctccttctccatctgatctgagcatttaccatttccttccatttaagcttcatttgagttgcatcatgatgttctccttttttcaaagttccatctgcccacaggtttccattttctctagaaccctcctccttcctctctagcccctggcccgcccctctgcggttctcaggaagcccctcggtgccccctgccccttatctagaacagcttctgcctagggtgggcaaggcagggtgggaggtggggggtagccgtgcagggaaggggtgaagcgggcccctgtactccctagctgggctgcaggcttggaggaaaataagagtcagacgcttgttaaaacagtgaggacagctttattcgaggaaaatgcagtcggggttgaccttatcagcaggggagagatcagcccaactcctaatacagcaaggaagggacagagctgggaagtggagtgggctgggtgagtggaaagtagctgcgagaagacatcacaggtagggggattcttgccaaaggcagggggggactttgatgtcaaaggtggggatgaggactgattggatctcaagggtggtcagatgtgaagggcgtgagaggctcactaaactgactaagcaggattcttgctgagactgggccaggcaggctgaagacaggaggcagaaagagggctcagaggagcctgagtgaagtttgatcttggggtgaggggtgcaggggggaggggcagggtgggtctttgttggggctctgtgggagatttcagggctcactggatgtgtggggcacagtgggccctgcctgagccccatgacgcctggacgctgccaccaggggcctgacctgctgacgatctctgcactgggtctttaatcagcctcttgggcattgtaaatgctagacaaagattcttctctttttaaagtttactaatttccctacgataaaactaatgcattttcacaggagagactcgggaaattaccaaggagcgtgaatcaggtggtcacagtgaattgtggatgtttgtgtctgtcttggggaactggtgtaacgtttctccatctgacccctgctgtctgttggaggtcaaggagccagcctggcctcacaacttcctcctttcagcaaagtcaggaggccattccctccagggatgggtgggctgcagcctcttggcacctctcgggatcctgctggcagatgtatcaccgtagcccaagccagcctaagccagcctcctgtggcccagcaccttctcttcccacgtgggcagctgtgttcccaggcaaaccttcctggaattgctctgtgctctcagagctggtgtgctttggtgttcagctgtggccattttggctttgagtttgatttgatttttgaagaaagtttttatttctttacccaaatattctatgtctctttggtaagactggaaaacacagaaaaacagagaaaaaaattcccccataactaccctgcccacctccatataacttttattagcattctgagctatacccctccagactcatttctgcctctccagaagtgtgcataaagtctagaaacataggtgaagagacctaatgccatcaagaacatcaacctgtaaaggaataaaataatgtcatctgtgtccagattttacagatgctttgtagatatgtgtaacagaaatgtgggtatgttttagcaaaaataagaccatatttttgttttattttgattgattgtactataaattccagtagagcattacagagccagcccaagcccatctctcctcttctctactcttttctttccccagtgaccaatagccactctgcggagggaagtagggatcatatttgtgcgcgttttacgctcttgctacacatgtgcgtaaccttaaacaaaacattagtttttatgtgttagaaatactcataaatggtggcccaggcatggtggctcacgcctgtaatcccagctcttcgggaggctgaggcaggaggaggcttgaggcctggaattcaagaccagcctgggcaacatagcaagaccctgttttgttttgttttgttttttaaacaaacaaaaaaaccaacaacagttaggtgggtgcagcatcatgtacctgtagtcccagctcttcaggaggctgaggtgggaggctctcctgagcccaggagtttggggtgatagtgagctgtggtcacaccactgtactccagcctggatgatggagtggagtgagaccttgtctttaaaaaaaaagaaaagaaaacagaaagaaatactcataaatggtatatatatatatcactttgtaatttgttcttgactactttgtcaacaatttttaagctgtatccatgttgatacatagatgtggttcatggtcttcttttttctcctttttgttaactgctgtatacaattccattgacttttttttgaggcagggtctcgctctgttacccaggctggagtgcagtggcacgatctcggctcattgcaacttccacctcccaggctcaagcaatcttcccacctcagcctcccaagtagctaggactacaggtacatgcctggctaatttttgtattttttatagagtcagggttttgccaagttgcccagcctggtcttgaactcctgagcgcaagtgagccacctgccttggcctcccaaattgctgggattacaggcgtgagccactgtgccagcccccattgtctaaataagccatcgtttctctagtcatatacagttaggtcacttccattttttcattagtataaagagtgccatatgaatattgatcctccttgagtgctgtggaaggaagcctctaagatgccgccactggtccccacatcctggtcttcacacccttgtgtaatcccttccctcgggtgttggctggacttaactgacttgattctaacaaatagaacacagcaggaggaatgggacatcacttctgacatcaggttataaaaagactgcagctgccagcttgggtgttctctgttgccctcttggattgccagccctggagggagccagatgccatgtctcaaggcagtcctgtggagaggcaggcctaggtgacaagggaccaaggcctgccaacagccatgtgagtgagcttggaagcagatctccatccgctccccactcccagctgagccttcggatgagactgctgccctgaaaacagcaaaggggaacctcatgagagaccttgagccagattcccagcccagagaaattgtgagataatgtttgttgttttcggctgctgacttttggagggtcatttgttacacggtaacagataaccaatacgagcacaccctgagaattccttagaggtctagaatatttagcagtggaattgccaggtgctatggtattctcacgctcaacagtactgtttattactaaattcatctccaaggcatttgtggcagtttcactcccctctacaagggtcagtgagctccttttcctcatacctctccggcacttgtgttgtcagactttaacatctgaacactctgatgggtgtaaaatagtatctcatgattatttgaatttgtacttccctaagttctagtgaagttggacatattttcgatacattattgtcctttctgctttcctctgctgtaaattaattgcatgttcgtatcctctgctgtaaattaattgcatgttcatatcctctgctgtaaattaattgcatgttcgtatcctctggtgtaaattaattgcatgttcatatcctctgctgtaaattaattgcatgtgcgtatcctctgctgtaaattaattgcatgtgcgtatcttctgctgtaaattaattgcatgttcgtatcctctgctgtaaattaattgcatgttcgtatcctctgctgtaaattaattgcatgtgcgtatcctctgctgtaaattaattgcatgtgcgtatcctctgctgtaaattaattgcatgttcatatcctttgtccagtctccttttgggtggattatctttttcttagtgatttgtagattttctttttttcactctagagactaatcctttgtcagttcatgctattttatactctgcttttttcagttagcagcgtattgagaatgttcttctatgccaatgtatacatcattttattgacattccattgtggagatgggtcatttatttatttaggtggacgtgtaggttgtttgcacttttgcattagtaggaacatgactgtgtgtcggtcagctgggctatgctctggtactaatgaccctccaaatcttagtggtttgcagcaatgaagaattctttgtccctcaagtgacatgaccatcacctgttggttgtggctctgctctatgacgttgtccctcagggagccaggctttcagagcagccccatctgagacattgctggtctcatggcagagggaaaaaagatggtggaacaacataattctatttctgtttttcctctttagagacaggatattgctgtggcacccaggctgcagtgctctggtgctatcatagctcactgcagccccggaatcatgggcacaagtggtcctcctgcctcagcttcccaagtagctgagactataggtatgcaccaccacacctgggtaatttttactttttatatttttcgtagagatgggggccttgttatgttgcccaggctggtcttgaactcctggcctcaagtgttcttcccaccgcagcctcccaaagtgctgggattacaggtgtgagccactggacccggcaggaacaatatacctcttaaagcttctgctcagacgtgggaatggctatgtggtgcgtgtcagttcccctcacattgcattggctgaagcaaaccctggggcccaaccagtgttggcggggttagaagtagacccctcccatagggaggccagggagggaggattttgagccaagaccactcaccacgtgctgtgatgagcagttgcctccccctcctttcgtgtcttcgtgcctcctcacgtattcttacaagtagaattgctacattaggaatatgcatatttgtaaagtatttactatttattatgtcagctaggttttaactgtcactgcatttgctgtgaattataggtaattattcatcctgatgaccatttaaaaaagaagaacaatattattaggtagaaatagtccctggctccccggttgcccaccgtgactataacagcatatctagcttggtagttttcaaattatttccacgttttatttacttctcacagcctccctgtggggttgcaggtgcttctccactcctccactgacaaggtgcctgaggctcagagaggctgagaaatgtgctctgggctgcacagctggggatgaggcgtagaccctggccctgctctgttctgggctctttctcctccactctggcctttggaggctgtggctaagatcttcccccagccccttccttcccaccttcccttcctgctcttgtgccccgtttttcacagtcctcagtggctggtttctcagtcccccaggaggtgcaggctggttcttaggaatggtctctgtcaatgttcccggcagtacctccgagcctgccctctgaggatgggtcggccatggctgcgccggcttagtctgtatttaggtatcactgactatcactggacttggggaggggatttactatttttagagaaagtcaggggagctccataaatcctgttagtcaacagaactgcagagaggtggctgtttatgaaggagagtgacttttttagaagtggcgcatttagaagaccacatattctatcattctgtgtacatgagcggtgcagaataggcaattctaaagagacagaaaatagattcgtgattgcagggagtggggaggagggatgggaagcgactcctaaggggcacggggtttcttctgggggtaatgaaaagcgttctggaattagatagtggtggtggctgtaggacctggtgaataataaactgaaaatcactgaatcgtaccccttaaaaacacacaaagcaaattgacaaattattgggaggcaacataagagaatggggtgtgaactttggatcagtgcggcctggatatcagctgtgtggtgttcaaatagattgcataacctcgttgagtctcagtcttcccatctgtgaagtagggatcattcctacttcgtagggttggcatgagactccgtgagatgaagttggtgggtcacttggctggggcaggtgtcacggagcgggacctgtgattgttcagccacctactctgtgcccagtgctgtgttggtgaccaggtatgtatgaagtcagtaagccacagtcctgagttatggtgcagaccccacatgcacccagagtcagcttggcaagaccccttgacaccacgtgcgtggagggtgcaggtcggagagctcacctccatggattccgtagagctttgaggcgtatccacaaagtgtccaggagaggtggcgtcgcctccacttgatagaggaaaaagcagagatggaggcagccagaagcatggtgcagtggtggggtttggtcattaatttgataatcacatggaatacaagctaatgtttattgagtacttactgcctgcctgctactgtaactaagtgctttactcctgttatctcatttaattctcaaagcagccctgtggcactgaggtggctggagatggagggatgtgtggctgccatgtgtttgccaggaagcagcaggatgggagtgagggcacagacagacacacatgccaggacttgtttgcacgaagctgaggaatgggtgcccatcattcattatactcatctctctgttttatgtatatttgaaaaaaaaattttttttgagatagggtctcgctgtgtcacccagactggagggcagtggcatgatctcggctcactgcaacctccacctcccgggttcaagtgattctcctgcctcagcctctggagtagctgggattacaggtgggcgccaccatgcccacctaatttttttttttttttgagacctgtcacccaggctggagtgcagtggtgcgatctcggctcactgcaacctccgcctcccgggtttaagcaattctctgcctcagcctccccagtagctgggattacaggcacatgccaccatgcccggctaatttttgtatttttagtagagacgggatttcatgcctgattaatttttttgtatttttagtagagacagagtttcactatgttggccaggctggtcttcaactcctgacctcaagtcatctgcctgccttggcctcccaaagtgttgggattacaggcgtgagccaccgcgcccagccatatttgaactcttttacagtaaaaagtttaaaaaacaacaatcctatgaggtaggtcctcttatttgtgctttacagatggggaaattgaggctcagagcatgtaagattacacagcaagattcggagatagctcgccatgttcatgcccggcaggacgtagcaacagggctggcgaaacggaggccccaggcttgtgggcctcctggggttcctgtgcgttgaggcctgagcccctgcgtgcgcccagcggagccagcactctccctgtggtcctactgggcatcacaggtgtgtatgtgaggggtatggggaggggattcttggttagtctgggcttcatgacattgggatgagttctttcacttggttttgttgatctggtaaaatctgtggtcctgtgatatcaccttgcttctcatagtatgagccttcaacatttggcctcagtggtggggtgtgcctgcaccgccttcccccatccctgcctcggctcctccccacaacaaagcggaaggaagacatagacccaagggtgcacttcagcccctcaaccagctgtgtggctttggagaagcggcttaacatctctgatcccagttacctttcttgaacgggaaagatatcaatgcttccttcactgattactggagcttcttggtgtgcagtgtctaggctgctttctaaccatgtaaggtgtagccacagtattgtaggacctgttgctaagaactgtgccactatcttgataaacatgttttccagggactggtggtggaatgttctagttattaatgtgcctttaacgttggatgactcagaatatccctcagatagtaggaataggtagctttgagaggtcatctgtaggagggcgcaggaacatcccaggagggggtgtcatacctgttggcaccatggggatgcaggctcagaggggactgaactttccagggccacgcagtctgtaagcggcagagctgggacgcaaccccaagcttgctgctctcaaagctttgctttcaaactctcacttcagacatcagggcttcctttcagactgagtcttatccctaagcactgttggagaagaaagtctccaggctgcagggccccgcagttcccccatatccctgcccttccagccagcccacgcctggggcctgtcctcccctgttcctgaatccctgtcctgttactgccctccgggtaagacagcactcttataatcatgcttcatgccgagttcatgaaattaactctcaaactcctcttctctgggttaaattatttcacttttttcccttcctcatagaatatcattataaattctagatactatattggatatgtaataaaatcagaataaattacatgtgatggccactgaactaacctcccttcatgtgtctggaggcaggttttctgtggagttatgctttaaattggctgtccttcgcgatttttcttaaagcctaggttgactactcaagggtctagatttatgatagaaactgtgggctggggtgcagtgctggggtgctggggtgcctgtaatcctagcactttgggaggctgaggtgggcggatcatttgagcccaggagtacaaaaccatcctgggcaacacggtgaaaccccatctctacaaaaaaatacaaaaattagccagacacggtggtgcatgcctgtactcgggagactgaagcgggaggatcacctgagcccaggaagtcgaggctgcagtgagtcatgattgcgccactgcactccagcctgggcaacagagcaagaccttatcttaaaagcaacaacaacaacaacaaattgtggcacaaatgtatgcatggaggtactgagggccttctttatagtaggctcaggaatgaccaatgggtgggggctttgggggaagagacgggggtctttaagcagaaactctcccctcaacacaagaaagctgctgaaggacttcagaaacctaaacacgagccgtgggcctttctaaagtggggagggattccctcctgcctaggttatgttgcaaggctgcccgagagagggtggaagggggcaggagagtgggcattggctgggtccaacgcttcccaagagatgtgactgtcttaaaagcaataccttcctgattaccacgggaaaaattcaaatgttttgaaaagatctacaagtttggggttgaagaagtcctttatttcaaagtttctctgggctgggcgtgctggctcacacgtgtaatcccagcactttaggaggctaaagtgggaggatcacttgaggattgctttgaggccagcctgggcaacatagtgagactctgtctctagataaagttttttttttttttttaaattagccagatgtggtggtggtgtgctcctgtagtcccagctacttgggaggctaagttggaaggatgacttgagcccaggaggttgaggctacagtgagctctgattgtgccgctgtgctccagcctggtgacagagtggaccttgtctgtaaaaataataataataataataaagctttgctccccgtttcatttagatggagcgtttgtgggatttaagacagatttttccttgctgagtggttatcattaacctgttgaataagcaacaggccgaggtggggaccctgcctcgcccgcctccaggggcacactgcattctttgtggaagtgtccctggaatgccacagccctgcttctgtgcgaggccagtcagtctgggtcctgggatatagccacatgtgcagtccgtgcctccagcgcgcagcctgaaagggaggcgtgcagaaacaacgtagctccaaggaggactgatcagcccagcctgggggagggtgggaggggactcccagggagcggggcttgtgctggactttgcaggatgccagacttttggcaggggaggaaattgaggtgaaagcattccaggcctagggaacagcatgtgcagaggtgctggctggaggaaccccgtgtgtttgcactgtgctctgagctccctctcatgactctcattctttctcgttgagttttgttttgtcacccagccggactcctgggcaaagagaggcacaatctgttcccggttgggccagctgccctccagtagctacgcaggatgctctggccggcctctgaggattctcttcttctgtccatctcatggctgaagaccaaggctatggcctgtgggtggcagttggtacctctccccgctgccttcccccggcccctttttggacaggatgttgctccctggggcctggctttggagatggccagtgctggtttgaagcttctgtcttctgtgtgggatatcagtgccctgccagctgttgcaagttttaaactcaatgtgcctctggatgtgtgtgtagagtaggggtccttccccagctccaggccctgtgtgtttccaagtgggcccgcagctctgatgtgcagtgggtatgcactggcaagccgtgcactgtcacaatattaaaataacttccatggtagttggtaaatagccccatcacccctctcctgggaccctggacctctagcacaccatggaggcctgccccgtccccataaaacacaccacattcaaattacttatctcctcttcccctgccactctgctgagaaggctgatctcaatcctcggagtaatgactctcttctaggagcaagatgatgctaattctcactagcatgtgaaggactgatagcaccatatctccctccaggactcccgggtgggaggtgggtgtttgcataggcaggcaggtgagccagcctagtttgtccacagacttccatgcaagtgattcctgctgttccctgggtcttcctttcttttgcttctgaacttggaggtttcttgaagtctggaggatttttagggtgggcatggctttaggtgggacctccactatatgggtttgcaagctgccactgctttgactgcagacactggattgaccgtggccaatgccaagtccaagagatcaggctgaaaccaggctaaattttaagagcagaaacaaaactcatccttgcgaagggacttttagatcagtggcagatggcatagaaagtctttctgctgttctcttgtgctgggcgtggctcagggctgaggggagagaggagagatgagggcagaaagagaagagggggcaggcctcagggatgaacacatggcccatggctgtgcgcttcccaagcaagcagttctggagtgaggcttgggcctccatgcctcctgggaggctgcacctcttgggatatagagaacgctggcttcagacccggcaggagtaccggcggctgtgtggtgcatcctgcacagagctgttgctttctaactgggttactgagctgtcgaaggagcagggatgaagactcccttattaaaaactaaacaaaacacaacacgaaaaagccagaacaaaacaagcagacggttgaggactgcagtgaactcattaaccctacagctttgatctcgaagtctcggccgctcctggctcagaggaccctggggacgtggtctttgatgcttgctttccccataggcatcacttcgaccagcgtctgtgtggggtgtgcagcagccctgagccaaggattaattacgtaacaagcccagatcccatccctgcctgagcaggccatgtgccagcaaggggggccccgaagtgccgctaggtgcctcacgattagcataaggcccgtttatccaggaagccagaaccagtgcacatctgttaagcgcatgcaccaagcggcgattccatagttgtatagtgattgtctttatggaactccagaatagcttcttagatatcactcttcaggccctgaaatggagccctgtgcaaagaaatgaagaaaagctatcggggcatctgcagccactattataccatctggcagctcagaaatattttataatcaaatgagtaagacgggcgtcccacactccacagtactctgctcccccttcccttcctcccaggacttgctctgtctctgtctctttctctgtgtctgtctgtctgtctctatgtgtctgtttctctctccctctttctgtgtgtgtctctctctgtgcctgactttctgtctctttctgcttctctctctgtgtctgtctctgtctctctctttctgtgtgtgtctctctctgtgcctttcagtctctttctgcctctctctatgtgtccgtttctctttctctctgtgtgtctctctctctgtgcctttcagtctctttctgcctctctctatgtgtccatctctctctctttttctgtgtgtctctctctctgtgcctttcagtctctttctgcctctctctatgtgtctgtttctctctctctctctttctgtctctctctgtgcctgtcttgcagtctctttctgcctctctctgtgtgtctgtctctgtctctgtatgtgtctgtctctgtttctgtctgtcttgctctctctgtttcaatctctctatctctgtgcctgcctgtctgtctgtctctttctttctgtctctctgtgtgtgtctctctctccgtctttgggacagactagaggaacctttttcccaggagtgataatactgtactctgcgtttttgccacttgctagctgggtgaccttgggcggctttcaagttcccttatcctgggtttcttcatttgtaaaatggaagcactacttcacagtgctgttgtgtgggtcaagatgagatgaatgtgacctactgtggtactatttattatttgtcctagaaaaacttttttttttttttgagacagggtcttgctgtcacccaggctggagtggtggcacaatcttggcctactgcaaccttgacttcccaggcccaagcgattctcccacctcagcctcccaagaagctgggactacaggtgtgagccaccacacccagctaatttttgtattttttgtagagacagggtcttgctatgctgcctgggctggtctcgaactcttgggcttaagcgatcctctcacttcagcctcccaaagtgctaggattataggcataagccactgcacccatccagaaaaacttttaaaaattttgtgttttaactttttctgaatataaaagtgatacatgcatgttcactgtaaaatagaaaatataaagaaactagaaaactatttatgacgcccctcccccaccacaaaaggggcaaggactgcgaacttttgccgtattttggaagatttcctaagtcacacaagcacacagatggtctgttgatccaaaccaggaagaacaattgtgggaataagtggaagtgtgagtgtgtgggtgtgtctgagtgtgtgccctgggggtgtgtgtgtctgtgtatgtgtgagagagccaggctgtgtgtgtgtgtgtatgcatgcaaacacttatgtgcaatgccttggggtcctcagaccccccttggtccatcaggggctggtggcctcccagtaggacactagcacagctgcactcatgtccttctttgagggggggtgacggggagaaagttggggagcagcagtgactgctgatgttgtgggggccatggggagcctcctggtattctgtctcgaggctctggggatatggtgggagaagccctcatgccagaattgggaggggatggaatgggactgaccccatcacagcccacgtgcctcattcagggcttggctgtggagtcttgggggaggtgctccctcatcctcaaatgttaactttgtctgcctggccccagtcccctctgtggcttttttcctctttcaattgggaggcagttctgtcttaaagagatgtttaaccctctaggtctccgtgcaggcatttttgttgtgagccagtcaggctataaatggtccattaaaagcactgtccagttgacataaccggtctaccaggctgagacccacagacccgggactggcatttatttatggatatgatgtgcaaggagagtgttttccagtagcaggcgttggcatcatcaaacagaatgaagtgtactgtgttttcaccatgatagtacaaaaacgagactgtgagagcttctcacttctctccccttcctccccttccttctccatgtctttgtgctcctccactgctccctccccagcacagacaggccctggctccctccccccaccctcttccttctctctccttctaactggggtcaggaccaccctggaggatgttagattttaaacatttgttcctcttgtcatccccaccaccccacccacccacccagattagtttctaagggatttatatttgtttgcagagtggtgcgaactgttttcatcctcagaggagcagagtgctcatagatgagtttgacattactgggattcactttcagaagtctctagagagccccgcaccgcccccgccccccgcaggtgctggagttcagcctgacacacaggccggcctcagtgagagggagtgtctgcctccctggcatccgtgacccatacggtgggcgcctgttctttagaacaacttgctccttccgtcgttggcttggtcacccagcccccggcccacccttttctgagcctgtcatccacaccaggcagagccctgtctcagagtctcatggggagcagggccttcagggaaggcccatgtgctgggactgacttggctcacaggaatttcctgatggtataaaatgtgccccccagcgcctgataatggtcacttcgcctaagttccagccccagatgtggaccacggtggggcaaaggtgggcgtggggaggaggaaagaggtttaaaatggccacacccactacttctcctttggaagtgcctcctgccaccctggggtcccaggagctgatctgtgggtgtctgtcctcagcacccaccctgcttttccttcaggccccgctctggctgtctgggcctttctggtgctgttcctcacaggtttaaacactccagcagcagcctttcccatggcactgtgtctgcggggcggggttgggcattttctgaggcttcctgtgtttcacggggatccagtatgaagcctggcacggagtatgggccaaatcggtttaatgtttagctccccaaacccttcacttctgtgtcctcattaattcagacaaggttgggtttagcaaactgtgtctcaaacataagaaaatgcagcgtgggaatgggggaggggaggagtgctgtagaaggaccatttcagaagccctggtttacaggagaaagattggtatcttcataagtcactcttaagcttgcatttgttcatgctttaacacagtgattagatacctactgtaagcctagcatggtggggatataaaagcaagatcaagttcaagggggcagggatttagggtcagtgagacggacctcttaatcacttattttgtacacatcagagcagtgacattgtgtttctttaaaaatactaggggccagcccgggcacagtggctcatgcctgtaatcccagcactttgggaggccaaggtgggcagttcacctaagatcaggagttcaagaccagcctgccaacatggtgaaacctcatctctactaaaaatacaaaaattagctgggcatggtggtacacacctgtaatcccagctactcgggaggctgaggcaggagaatcacttgaactcaagaggcggaggttgcagtgagccgagatcgctccactgcactccagcctgcacgacagagcaagactccatctcaaaaaacaaaaaacaacaacagaaaaaactctgggccagctgtggtggttcacacctgtaatcccagtgctttgggagaccaaggtggggggatcgcttgagcccaggagtatttgcccagcctgggtagcatagcaagatcctgtctctacaaaaaaaaaaaaatatatatatatataaattagccaggcagggtgatgtgcatctacagtcccagctacttgggaggctgaggtgggaagatcacttgagcccaggagtctgaggctgcaatgggctctgatcccaccactgcactccagcctgagcgacagagtgagactctgtctcaagaaacaaaacaaaactctggattctggccttctcctgggaaatccagatttgtctggtatgatgttcgttgaacccatttagtccagcagcctggctttccaaaagtatgtctgcctctcacggtgcccagtagctttaaccaaagagctcaggaaagggcctgtctgaattcaatcacattcagcatctatttcagcgttttactagctttcaattaaagtagccacgcatttgagcctgatggtcttattgttttatgttgttccttttgcacatttcctgcttgtttatctttgtggcacaggggcatgttcttggctgcagttaacaatgctggccacggcagtgcagcgtttccaaatttcttccctttattaacaggcggtaatggaatctgaatcttcaaaaataaattttacatacttgttctctaccataaaagtcatccatacttattagaacgtctcaaacatactaagaggtaagaaggagacaaaaaataatattttgtcacccctgcccaggtagccactcttctatttgagtgcttgtaagaagcctgcttttccagtattatctgacctggcagggagttgggtaattgaaaaagattattaaagaggggatcataaaaatgatatagacgccgggcacggtggctcacacctgtaatcgcagcactttgggaggctgaggcgggtggatcatgaggtcaggagagaccatcctggctaacacggtgaaaccctgtctctactaaatatacaaaaaattagctgggcgtggtggcgggcacctgtagtcccagctactcaggaggctgaggcaggagaatggcgtgaacctgggaggcggagcttgcagtgatccgagatcatgccactgcactccagcctgggtgacagagcaagactctgtctcaaaaaaaaaaaaaaaaaaaaaaaaaaaaaaaaaaaaagatatagacatattgagcatttcgttttgacataaaacgtttcattttcatataaaaatgcatttattccccatctcttgatacagggccaagacctctcttggattatgggtccactggcttctgtcctgatatgtcttttttgcactatccacactgttaatgcattttctgagattctcagtttctgtttctgtcaagtaatgtaggaactagcaccaaatccttgccgatttcatataccactgatattatacagttattttgttcatgcctaattgaacagccatcttcccccaaacattcaactctgtttcataaaaccaactccttttaattcctcttctgagggtttgcataaaatttaattaactttggtaattacataagtactactggtataagcaggtttggaaacaaacgtaactgagtcttggtgggctcagagtgcacctgcccgaaggttcccacatgctctatgcacccagaaggggacagagcatgccccatagtccaggggcaattaggggaagcagctaatgaagtctgctttcttctggccttttaaaaatctatgtccttttttttttttttttttgaggcagggtcttgctctgttgcccaggctggagtgcagtggcatgatcatggcttactgcttcttgggctcaagcaatccccccacctcagcctcctgagtaggtgggactattaggtgcatgccaccatgcctggctaatttttgtattttttgtagagacaggatctcaccatattgccttggctggtctcgaactcctgggctcaagcgatccatctgcctcagcctcccaagtgctagtaagccaccacacccagccaaaatttaaaacacctgtgcctcaaagaataccgtcaagaaagtgaagagacagctcacagaataggagaaaatatttgcgaattgtatagattctagacttgcatctagaatatataaagaactcttacaactcaataatacaagacaacccagttaaaaaatgggcaagggacttgaatagacgtttctccaaagatatacaagtggccaagaagcacatgacaagatgctcaacatcattagtcacgagggaaatgcacatgaaaacaacagcgatatatccagtaagactgctagaatcaaaaagtcctataaactccagcggagatgaggaaatggagaaggtggaaccctcatacgctgttggtaggatgaaaatggtgcagcctcttcagaaaacagcctggcagttcctcaaaagcttaaatctagagttaccatatgacctagcagttgtactcctaggcatataagaatgaaagagaaatgaaaacttacacataaatgtttacagcagcattattcacagcagccagaaagtgaaaatgaccaaaatgtccatcaactgatgaatggataaacaaaatgtagtctatccatacaatggaatatcactgagcagtaaaaggaatgaagttgagattcatgctacaacatggaccaaccttgaaaagatatgctaagtgaatgaagccagtcacaaaagaccacatataatacgattccatctatgtgaaatgtccagaataggcaaatctgtagagacagaaagcagattagttgttgcctggggctgggactgggaggctgaggggaaatggggagtggcagtgaatgggtacatggtttcttttggggaagataaaaatgttctggtcaggtgccatggctcatgccaataatcattgcactttgggaggctgagtcaggaggactgcttgagctcaggagttccagatcagcctgggcaacatggcgagacctctgtctctactaaaaagaaaaaaattagccaggtgtggtggtgtgtgcctgtggtcccagctacttgggaggctgaggtgggaagattgtttgagcccaggaggttgaggttgcagtgagccatgatcgtgccactgcactccagcctgggtgacagagcaacaccctgtctcaaatataaaacaaacaaacaaataaagggcaaaattctccctgtctgaaaaagggggcagtgattctttacaaaattgatcatggtgataagcgatggttgcacagttgtgtcaccattgagttccttccttccttccttctttctttctttctttttttttttttgacggagtctcactcttgcccaggctggagtgcagtggcgcgatctcagctcactgcaacctccacctcctgggttcaagagattctcatgcctcaacctcccaagtagctgggattacaggtgcgtaccaccacacctggctaatttttgtatttttagtagagaaggagttttgccttattggccaggctggtcgcaaactcctgacctcaagtgatccatctgcctcagtctcccaaagtgctgggattacacagccaaccattgaatttaaatatgtgaattgtatggtgtgtgaaccgcaagtgttctgcctatccatatacctcccactcaccttccctctccccatctcactgttctggtgagggaggttcttgctttcctttcgcctgtttgggacctcacttcctttttcccttccccatccctttgtagccccttctcaagagagagaagacaccttgattcccacctacgctctgctaaaacttttccgttctagtcttaaatctctctctcttaagaactgatttcccagtagggtttatgtttggagctaaattagtcctcctggaagcagttgacttcatcctccagcagctgtgccatcagcagaggccatgcatgctggggcaagatccaggcctatctcttcctctgcagtcccctggggacgtctgggatctggttccttggttgggccacgcttagctctccttcgcatgggtgtctcaatgccagggtgtcaggagagctacagtagccagctcaggcccccccagggagagctggggagggagctgagggcctggtgccccccatcaggagggacctttggagtctttcttggctctgcccaggccttctgagcacacagagatcactccagccctctgccctctctgtagccaaatgaaaagactcttctagtctttctggccaactagtaagctctttgaaggtgggtaccattcttgacattagaaaaaactcagagccgtttggatactgaatatttttgacatgctctggtcactgaacgagaagactcttcatgaaaatgatgctttgtcagctctgtagagaaaggcgattggaattttggttgaccaggttagggtaagggaagaatgaatccccagtgtcctaagctggcaggcagtcgtgccgatgcagttctcatttctgctgtcaatttgccaggagactcagaaaaaggccgctatgcctttctgcacctcagtttcctcatctgtcaaatgggcagtgttttgggcgtgctgggcacaggtttgtctgagaaccagctgaggcctgtgttgcgcatgggacctactattattctttataatattaataccaaggacatttaacacctgcaacaacaagaacaagcacagtctcagaaggaaagcccgtcctctaaaagagtgtctgtagagcagagaagcccccagtgccatccttctctttctgccaagctcctgtgccagtgctgtcgtggggggccctgcctgcaggtgtggggatactggttcagggccagtggcccctggcaactggtttgtcttttagagaaggcaggactgaaatgatcagctttccatgtagggccagactctgggcaggtttctttttaaattttttaaatttttttgagacaggatcttgctctctcacccaggctggagtgcagtgacatgatcagggctcactgcagccttgacttcccaggctcaagcaatcctcctgcctcagcctccccaggtagctgggattataggcgtgtgccgctatgcccggctaatttttttgagttttagtagacgaggtctcactatgttgcccagattggtcttgaactcttggacaatcttcccacctcagcctcccaaagttctgggattacaggcgtgagccaccacacctggtctcaaataaaattttattggaacagctacactcatttgctttatgtcattgtgtccggctgccctcatgcagcaggcagagatctgctgacccctggtctagaatgtggaatgctggatccctgggttgagggactattttaatggtaagtacccatatttagatcttttttactgtggttttgtgatgtgatctgtcatctcctctgggcttgcatttctccagtgacaaggcgctcactcctcccacggcgatgcattccagccgtcgaattatgtagttctactgcttaatccttccttaacttgctcttcctgaagcctcaactcactcatcttctttctcaacccctcaggcccagcagaagtcctctctgtcttctccaggcgcagcccttcagccatgcaatcctgcgtgtcctcgttcttcattccacaaatacgttctaagggcctcctgcatttcaggcacttcagaggaccttctggaagcttcccagggcctgctatcttccctgtactgtaaggggacactttgctcaactgttcacttgaacagagtcttcaatgtcttctagtgaattctgggctgaaaccaatgtcgacttggccaaattaaggccacggtcttggtcagccaccttccaggttgacttgccagggtgtcctgggttggtttgttttacagaagcagagctcccagggctcatcgcacagccatggccgaggtgtcgggactcaaattccgggcccttggctgtgcttctcacattctttccattgtccgacgcactgaggcagagacaggaattttaactactcaaaaactactgtttacgtattttactttgacttctttctgggttcttgcataggcttcaaggagggaggatatggatgtgagcttattgtacaaatgccctgggttttccaaacgtgtctgatcttaaatacacagccctgcgtgctgaccttgtgttagaacttaatgatgcgacgtttgctttgcaaactgtggtcccctcctcatagatccttcaattcaacaattgaattcaacaagcccctgggcacccaccgtgcaccaggcactgtgttaggtgctgcagagatgaagatgaggaggatgatggcctgtgcccaggcaggtaacagactagcagaaggacaggaagcaaagtgggcatgtgtaccatgtgtttaaagcctgagggaacagctggtaggatcctcctggggctaggtggtggcagcagcaaagagaggggacatttgaattgggctttgaagggtgcataagagtttaacggggccgggcgcggtggctcacgcctgtaatcccagcactttgggaggccgaggcgggcggatcacgaggtcaggagatcgagaccatcctggctaaaacggggaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaagagtttaacgggacagccacaccactgatcactcagaagtaggtgggttgtgaatcttcagcattctggaaaatgtaaaaagttgttcagtgggcagcagtaaagagggtttcgttttcctggagacactgttgctactttgctggcttatacagggacacccagagagcggctgggaaaatcaagaactgtgtcacctcctccgttcttgcccactgtccagggctcaaggagattggggagcagtttgcaaaggcatttgaagattaggctccacagagatggacactttttttttttcctaaatagatacagagtagccttgtgaaggtttcttttgggtctgagtaggggacgcacagggcatggctatgagggtctcagaaactggtacctactttcctcttatttggcaccgggagcccctgccggaggacatgttctagtgacagccctgggctcaggcttggagagtgcattctcttccccaggaacgctagtcacagctcagtaattcaccccagggaccgcacagagcaggtgggatggtattgatttgtgggccttttggcaaaacatactcattcctaactggcgagggaaccgccagttcatttattcatttactcttctgagtccagcaacaaccttaagaggcaggtgttacctctggtttctgtttaaactgatggccagcaaggtagggcaatttgcctaaggacacgcagctcctaagctactaaacctcccgctcgcctggaagagaagacaggacgggcctatagtgaatcatgagtgcagcatgagagtgttaaaggtcacaggacgcctcttagtgccaagggagttcatagtggagaccccttttgcctgagggactggggaggtggtagttttgaactgggacttgaaggacagactggggtaaaagcaagaggagaagcttgagggaggacggtgtgtgccaggacggtgggactcagagggtggtggggggcacatccactgtccccttccatcctgcagccactccctgaggtggcatttccttgaatgacaggagaggagcctgaggcacgggaagattaagtaaccggtcctacgtataaggtggcatttgaacccaggtctacctggctccatagccaggccccgtgccccacacaccacaccacctggcgcttggccaacaggaaatcacgtcccccagtgtgtaagtcagggaggcagaggtgctgagatgctctcacctgtgggctcccgggcccagccatgctcttggtgttccctcaggccctggcttcccccctccctccaggtggacccatgcttgtgcccctgtgcattctcccacagactcctccctgcggggccacccatctccaaatcccagctgcatatccacaactgtagagtgttttaaaatagtgatggtagcctaggcaacatagcaagaccccattacccccaaaaatacaaaattagctaggcgtggtggcacatgcctgtagtcccagctacttgggaggctgaggtgggaggataccttgagcccaggaggttgaggctgcagtgagctatgattgcaccactgcactccagcctgggtgacacagcgagactctgtgtctaaaaaaaaagatggtgatgctgtccaggcttgacgtaggagccttccgttcctcctcagggcctgtgctctccttttgaggaacagcctccttttagtaaatgtgagggtggctgaggtgggacatgagaggcttgcagtacccaccaagccaggccagccacatggccttctcaactcctggcccagcccaggttgtcagctctctcaggttttgctctttctcctgcgtgctttccccgtgttcttctgcactgttatctttcctcttcatctgaggccatgtctttaccttatgtggtgctgatgtgggccagggaagctgtggcaggggcccgggaaccaccccagggggatgcagagggagtggaccctgtggggctcggccatggcagaattctgctctgattggctttagatcgtcgcctgtgacagcgtttcctccgcggagtgtgttaggaagagcagaaatgcctcctgcatctttattagatccctccaaatggaaatccagcagaaagccgatgttcttgtaaatatcacgacctccctccccatgaggtgtttgtagaacagttatttactcgttttgttttccccacctgcagtttacagaagaaaatcaagaaagcgtgtttttcctccatgcataatcccatccccgactgtaacaacaacaaaaccgtcctcctgttaggaagcagcagtgacttctttaggcaggaaaaaaaaaaaagcgtgctatgccagaaagcaggagcagctgggaagggagagggagggggccacacctggcctacccccagtcaccttttacccagggatcccctgaggaaaacaagctgtgaccttgagccggcaccagccccagggctgaaaccccagccctgtctgaagggttcctttcccgtgtccaccacggccccgtgctgtatagcagccccggtggaaagcctctttctcctgtacctggaggagttgctggaagaaggagaaggctcagcaccagcttctggctaaaatcgtggccgatggctggatgattccggccccactttaataaacaggatagatgtgcggtaacatcaggttgtcaggccctattttgtgatagaaaggatgaggagggaaacaagcacaaatcagtagtgtcacaatctcaaccacttcttccattttcgttaatagaatcggagtctcactatgttgtccagactggtcctgaactcccagctgatacggaagtggggcagggaagtgctgggaggagaagggcgggtccctgtcgagggctccacccctgggcccatgcccacagccctaggtgaggacagacactcctgcctttacacccaaatgctgcatttcccaagaccaccctggcccaccacactcccatcctgtgcctataaaaaccgcgagagcctagcaggcacacacagaagcggctggacattgagaggaacacgtgggtggaagaagacacacgtggctggatatcaagaggacgtcgggggaacatgccctggggaagagcacacaacagatgccggcacgctggcaggccactgaccagcagaatgccccggagtttggctggggcggtcggagaagagtcaggaaaaccatctcccttctggctcccccatctgctgggtgagctcaataaaaccttgcactcattctccaagcccacgtgtgatcttctggtacaccaaggcaggaaccagggatacagaaagtcctctgtccttatgataaggcaggggtataattgagctgactaacacaagctgcctacggatggcaaactaaaagagcaccctgaatgcccaccggggcttcagctgtaaacattcactcctagacactaccatggggttggagccccacagcctgcccgtctgcatgctccccttgaggtttgacccgtctgcatgctcccctcgaggtttgacccgtctgcatgctcccctagaggtttgagcagcgggacactgacgaagcgagccatacccccatcacatgccctttgagggggaaaagggaacctttcccgtttcacagccacagtttcctgctgttttctgaaattcctggtggccactcccttggtgtccatgggtgtctggtgtgtgcctatgtttgctgcgggctggctcggcgagggggaggtgggcagctgggggctctctggaccctgcggctggcatgggttagtggctccgtgtcacctggttcctctcacctctgttttcccttctagcccctgcaggcaggagacttcaacgcagagattaagaagttgagatgtctttgttcccagaggaaagtccctgcaggccccggcctcatggcctctgtgacagcagcaggattagaggcagagttggcccagagggaacatttctcccaccctctgtccctcggggaccccacttcccaggtggcctggaggatgaagtcagggctctggcctcattgagggcctggaactctttagagcccatcaggaccaagctctggtggccttccaggcccactcagtggctggcggtcccacctccaaatgcaggcagaccacactccctgaagggcagtggcaaggccaggccagcacctctccactctgaggaaggggccttacccagatccccgtgtcccccacagcggtggcggttttattgatgtattgtgaaggcacagggagggccctttccagagcaggctgcatctcccctcagcttccacactctgaacctgcctcctgcctccttccacagtgcccgccgggtccacagcgcccgccgggtccacagcgcccgccgggtccacagcgcccaccaggtttgatgtgggctgagcacaccgtcactaactcattccttcattcattcttcactgtgtggggtgtcgggacccagcacgggctcctggcgcagcaggcctcagaccctggggagagctttgctggaggaagtgcagtgccaaggacccatgtcctcattccccctgggtagagcgtgtcgggtgactctgctgcggtctccaggagctggcaagggaggggtgcaccaccagggaagggaattccaggcagcaggcaccaggagcctcatccaagagaaagagaagttccctagactcccaggcagggtgagccgaagggccttggagagtccctgaggtcccgtttcatgggagacttctctcacaaagcgaatgagctcaaatacggaagatggagaaatggaaaacagaaacagaacagaacctccacctgctgggtagatgttaactgaatcttttttttttttgagatggaatcttgctctgtcacccaggctggagtgcagtggcacgatctctgttcactgtaacctctgccttacgggttcaagcgattctcatgcctcagcctccccagtagccaggattccaggcacccgccaccacacctggcaaaatttttgtatttttagtagagacaggatttcaccattctggccaggctggtctgaaactcctgacctcgggtgatccgcccacctgggcctcccaaagtgctggcttgagccaccatgccgcccggccttacctgaatcttatcacacattcctttggaaaatgaatctcctgtgatgggaaaccagccattttcctggtgaggcctcagccctgtagccattccagcatagttaacctgggactctcttctcctctcttgtctctcctcttcctcctatctggcctgcttgctccatcctcccctgctttctgtctctctcctcaccacgtgcctttggatgttctgaatatgcttttgtttgcctgtccagcagtattctctccacggtctcctcctgggtgtctggcgtgtgccttgcgtgtgctgcgggctgggatctgtgggaatgacatagtcggacatggtcctgagcctgttggcctggggactccttttctgtcatactagatgagacaggcgagactgccctggaaagcccggcgtgtctggcctccccagtgctggacggtggccagtgtggttttccaggcgagtccgtgggctcctgggtgggtggtcgggctcgtggggagatcccaagcaatggttgtagagggatgggagggaatgggtggatcccagagagagagagagagagagagcaggctggttccactgtggcctcgttgtctaatgaggagagtgtacagataagtcatgctttgttttgctctgtctctggaattttaatcagttgccctaattgccttcaaattattggaagggaaaaacgccagcagagggtcctgacagatcccagctgtctagctgaggacttatcttctcattgttcttgggaaaccagtcaggtttagggacttgaggtggatgattcattaattcttttaaactgatttcctcagccatgtacacaggtgtgaaagcccttcttatgttatcagtattaccctaatatatcagagggctaggatttctcataaggcgactgttatcttttgataatcacataaataacgtttccatagttctcgaaagcttgccagatgctttcatgtacattagctaacttcttaaatttttttttttttttttgagatagggtctcactcttgtcaaccaggatggagtgcagtggcatgatctctgctcactgcaacctctgcctcccaggttcaagcaattttcctgcttcggcttcctgagtagctgggattataggcgcccgccaccatgcctgcctaatttttgtatttttaatagagatggtgtttcatcatgttggcctcagactcctgacctcaagtgatccatctgcctcagcctcccaaagtgttgggattacaggcatgagctgccatgtgtggctgacattagctaatttaattcttacaataatcttatgaattgggattctcatctcttttaaaatgaggaaactgaggctcagagaggttaagtcatgtgcccaagatcacttagctagtaagtgatgggcagggctgtggagctggttcacttgactctgctgccattgcatccagtttgctctgccagcgagtcaattgagcatttggagcatttgctgtgtgccagcctcatggaggcaaacggagcttcggaacccaggtgtcgagaatgagctgttggcactcagtcctggagtggcagcatggggggcgggggcaggagcatgggggacaacagtccagggagggccacatgacagcaagcagagcctcgaatgcctgagtcctggctccagagagaggccagcctgagctcctccatgtcctactcctgtggatagaccccccggaatgcagggggccgggctgagcaagaggaggagaggacagggaaggaacatgtctgcttctttccttcaggaaaggaaaggtgagctgggcgatggggaaggcctccacggtgttctgttgtaatgttctgccacttggcagcctcaccagggacatatcagccccaggctgattatctgcagaccgggatcccatttctgctgctttgggagagaagggagggtagccctgaggccatcccaaatgcgagtctgttcacagaggggctctcctggcaccttccccagcccagacgctgaggagggcagccagaagcccctgcatcaggtaggagtgctgagtcatgagattgggttgaatggcggctttagcacagctgtggcctgtgttagagagggtgagtttggaccattcctgagcagagggggacctcagaggacagtcggactggggaatccctggcccagagagggaaactggttttcccagagtcacacagctaggtgcccctttgatggttctctcagtgactcacgcctgtaatctcagcattttgggaggccaaggtgggaggattacttgagcctaggaggttgaggctgcagtgaaccatgatcataccactgcattccagcctggccaacagagcaagaccttgtctcaaaaagtaaataaaaaataaaacccattctcactctaacccatgctgtatctgatttttttcctgaggtaggcttgagatgggagggttgttattttttgtaaatgcattaggggcggagtggtgggagagtgattcccctgcagcccttctgaggtcactgccacaccatggcaagaaaagtatttctgactcctggagctccacggtgtgacaggtgggcaggagctgctgggggtgctgggcagacgtttaccgtccagcacccccatttctgctgctctgataacttggatcgactgaagaacctcggggctttcttggctgtttgtaggagcttccagaagcgacctttcgggatgcctcttacatagtcctgcctataccctctacacgtggcgtttcaggtctggagagtcatgtggtgtagctgtatttctgggaagtgtgtgacccgaagcctcctcctgtcagaaccaccggggagctcacaagctaaagtgcagattcctgggtcatcccagacctgctgaagccaaatctttagggtggggccaggaatctgcattttaaacaagctccggaggtggctctgaggccagccacagtttgggcacggcaaggctggggagccaggcttgtttcggatctccagtccttgtgtgggctgcgtgaccttggatgagttatttcccatctctgagccttggttctctggtctgttaagtggcaatcttgccccttctgttttaggcactgtcggggttgcctgccttctggtaagcgtttagtgccctgagccgactcagctggtgctcagggaggcctgatgattcggggcgcttggccgggtggtggggtgggacaccccagagggaagggcactggtcccagcttggtggggcaggccacctggaggaggggtggaccttgggagtgggttatattagggcctccaggcctcagtttgggaggagcttgcagtgaccttggagatggtagtgaccttgtcctcctgccctgcctgggtgcacaggctcccagcacgtgggtggcaaaggtcctagagagcacccagaggcgggtgtctgcctggggtcgagtgtgggagctgggcccagagcccccacttctgcctggcatccgggggtccctccgggaagctgaggttgttttcttgaacagtaaggactggccagagccctgagcaccgagaggtgagggtgaggccccccctactctttcccccaccctcctgggaatgactgccgacatcagggaagggaggggccccaaggccagtgacctggaatgcgatggccagggaggcaggagctggaggctgtgtggggcacgaggaggccgatcgggtgtcccgggggagactcctcgctgcttccctcgggatggtttccatgaacttccctccccggccctgacggcctcctctcctaagctcccgcctcctttttttttttttttggagacagtggctcactctgtcacccaggctggagtgcggtggtgcgatcatggctcactgtagcctcgacctcccccggctcaggtgatcctcccacctcagccttccaagtagctgggactacaggtgcatgcccccacaccagactaatttttgtatattttgtagagatgagttttgccatgttgcccaggctggtcttgaactcctgggctcaaacaatcctcctgcctcggcctcccagagtgctgggtttataggtgtgagtcactgcacctgaccatccctccccgcttttatgtccttttctccctctctgaggtagggggaccaagccctcctccccaagccctgtccactgtggggccttctacaatgtgagcttgtacatctctgtgatgtcacccaggtgccaccaggtgtgtgtgtcctgatgcctttggccaccagcctcaaaatctcccagagttccaggtgcttggtggaagggattcatgtacccctatccccatccctaaatgagagtgtccacaccacccgccctgagttctgaacttagccacctcatgtacggaaggagaaatggaggccgccagagaggtctaggcctccgaccctgaccttgctcctcttggatggtattgggtggcattccaggacagctgggatcttgatcatccagtgggtgccctcactgtgcacctgcctccaggtggtggcgcggtaattgcaagagcgtgagcccctcctctggggcatgttcttggaaataaatacacctcgtgtcatggagatgggcagacgaggtgccagctatttgaacggacagcccggagtctgtgcaggagttggaggtagagcgggtcgaaggcttgcggagggacaggtgggtctcccatggatggcttttcttggaggctgcagccaggagccattgtttctcttcccacctgaccttgggtggttccccttcagccctggcgttatgatgtcccgcccaacccccgaccgcacacctccctcccccttagctgcttcgaagccaaaggtgtggcaacagctaacaggtgcttggtggtccccgcccaccctccttcaggctccctacacccacctgagtgggcctttctgtgttcacttcagggatgaggcttggagaagagggtgtgtgagggggtgcgggtggccctccagactggacctaggcctgctgcattctgggttgaggtcctcttgctgcctctctgtgagcgagcctcgcctgctgggtgctgagcccacaccgcatgtcctcggcctcccattgagatcagctatacgtgatatagaccagggatgcacgcctcatgaggagacgctcactcccccagacacactgagtactctttcctcaagctcagtgcagttcgtccacgtttgcccagcagcacgcctcccgcagcgttgtcaatatttattcgtggttgccgctgcctccctcctggaccgcccattccctgggccctgtctggtggtggctggccttggagagctggcctctcagcacagcaccgggcaccagggctcaaggtcagtgggtgtgtctttgggtcccttaaggagcaaagtctcataatttgctttattttgttttattattattaattttttttgagacagttctcgctctgtcgcccaggctggagtgcagtggtgcgatctcgtctcactgcaacctctgcctcccgggttcaagcgattcttgtgcctcagcctcctgagtatctgggactacaggcacccgccaccacacccagctaatttttgtatttttggtagagacggggtttcaccatgttggccatgctggtctcgaactcctgacctcaggggatccacctgccttggcctcccaaagtgctgagattacaggcgtgagccaccacgcctggccccttaatttactttaaataaagatctggttctcccagatgaggttcacagacagatgttccaagagcacatctgtctggcatcaggagactcacccataccaagctcacagtgctggccatgatccgactcccgccctgcagctcaagcttggtctggagaccttctctggcacctgccccggctccccagccccgggcttcctgcattgtgtgcttccactcccgtcttctccactaggagctctgtggtacgggctttctgcaccttgacctctgggcctcccaccacagcacggtgaaggcaccaactatttcactgctagatccaaggatgctggggccgggggcagctctgagtgtgtctcatacagtgaccttgtttgaggaggctgtgtaggcccaggattttcctggggtgagggacgccaggttccttgatgtgttgggacaaagacgttggctgggcgaggaggctgcctgagatcccacagtgaggctggccctgcccttgctcgcccagctgatctgacaccctccagatggcccaagagagaccgggaggagcatctggtggaggacctgggtgttctgtctggagatttcccattgcttttccagtttattgtcatctgcttgggacttgagggtaacttcatctctcaaaataggctgagactttttacagttagatatttaatatacagatgacgggcggatggtagtgttgttttaaggggggattttgttgctgtcgttgttgttgttgttttgagacagagtcttgctctgtcacccaggctagagtgcgagctcgatcatagctcactgcaacctcaaactcccaggctcaagtgatcctcccacctcagcatcctgaatagctgggactacaggtgtgcgccaccacgcatggctaattttttgtagagatgggatgttgccatgttacccagactggtcttaaactcctgggctcaactaaaattttaatctccaattcatacatttcagaaagtataataatatgtaaagcaaaatcataatagcaacaacaatcactgtcatcccacgggttggtttagatgtaaattttatgcttccttgcaaaaatttgtcgaaagtgccagaaaagcccttgtcccatatcacagtcccatgacccacactcccatggaaagccttagaactgatgtcagtgtgagccctgtgctggagtggagggtgacagagcttcggacatgagcagcctctgctgctgcggccaccctcgccggccctggatccccacacagtgtggggtgttcaggattcctcatgtgacccttaccctgcctgccctgggactgtgtgcctgtgtgcttgcatgtgtgtatgtgcgtgtgtgcccatatgcgtgtgtaggtgtgtgcatatgtgtatataggtgtgtgcatgtgtgtatatacctgtgtaggtgtgtatgtgtgtacatgtgcattgtagatgtgtgtgcatatggtgacctcagttccaaagctttccatgtgtgtgtccatacacatgtgtaggtgtgtgcctgtgtgtgcatatgcgcatacacatgtataggtgtgtgcatgtgtgcacacgtgcatgtgtaggtgtgtgtgtgcattgtgtgtaggtttgtgcatgtgtgtgcatacgtgtgtgtaggggtgtgcgtgtgtacacatatgcatgtgtgtgtgtgcattgtgtgtaggtttgtgcatgtgtgtgcatacgtgtgtgtaggtgtgcatgtgtgtgcacatatgcacgtgtgggtgtgtgtgcagtgtgtgtaggtttgtgtgtgtgtgtgcatatgtgtgtgtaggtgtgtgtgcgtgtcagcatatgtgtgtctgcattcactcggccagagctccttgagggcagggtggttcccacctctctgttcccccagctcccagctccggcctggcttttaatcacagagtaagtcaagcctgctttgggagccttctgactcccccagacacactgagtactctttcctcgagctcagtgcagttcgtccacattttcccagcagcacgcctcctgcagcgttgtcaatatttatttgctgttgctgttgcctccctcctggaccgcccattccccaggccctgtctggtggtggccgcccttggggagctggcctctcagcacagcgccgggcaccggggctcaaggtcagtgggtgtgtgtttgggcttgaactgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggaccgcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgtgagtcacatgatgcccgtggcctgatttctgtgcccccatcttgcctcttagagtttgttgacctcagggctcacatatcccttgtaaggggttgtgatggcttccacggccatcatggctagttaggattttcctccagcccttgaggaattctctcgggattttttctggccttgcctgtctgcagaatccatagaggacctacaggaatgtctgcctctgagtccatagtacttgcaggcctgggaggctggatcaaggtggatgttgacacttggtggggccggagccctggcttcctggctgcctcatagctcaggcccgtttgacagcatttgtgagcacctgtcccaggcaggagcaagttcaacagcagcaagggctccaggcagagggaggtgggctctgatgggactcaggggcagcctaaatgtagcagagaactgagaggggatccctgaggccttcttggaggaggtggtggttaagccagctaactttgtccattggaaactgtcaccaggtccttattaatcaaataataatgaatatgccgtgttcggatccactagggaaagctgaaattgagctcaaaggaggcatagaagttcagcttgtaattttgaaaaaggaaaaggctctggcctcattaggctgcccccagtgtgtccttgagacctccttactccttgaaatgtgcttcttaacgttttggaaaaaacaactttctccttctatacttagcccttatctcaatgtgcaggcgcctacctggcccacttatcttcaagaaatgtgctgggttaggcctcaggagtggcaggcacatagatactgtatttggccttggccttctgcccaagtggagtctccgcattcctttgtatgggcccattgggcatgcctggctaatctgcgcaccctctttccactctccttcctgcatttctccttcccttcagtagtggctcccttcccattccccaaatcgcctctgcttttatcttcttccaatcgaattcccgtcagtcgtggagcaggtgggacacctgtgtatgttgcgggggcacagagaagcagcctgtgctcacccatgcctgcctgcaggtgcatgcttgggacttggcagtgggggaagattttggggttaggatttccaggctggcttgacactgacctgttttgttccaacccatacaagccctaaaccctcatgtgcagatcctgctggctctctggggaacacttagttggatgcaggtaggaagaggcttcaaggagcagaggaggggctggctgagggccagccactttgtctggtccccagagcggggtctaacatgtgggaactgagcagcaactgtgagctagccctcaggcaaggctgccccatgatgccagggcacatagggcagactccagatgatggggccactgctggcattggccttttgcagggcacaggagtctgccaggggtgtgttttggagccacccatacaggtgtaccagcttttggaaaatcccaaagatgtggtgccctgctcctgggggtcttgggggctcccaggtagcaacagcgttctgggaggacgtgggctcaaattccaacttttctaccaggttttggctatccttcatccccgtggggctcagtttcctcatctccaagctaagggggcccacctaaagttgtcacagaattggacgtgtgacggggcagcccccttcacctgtgggatccgaggcagagctggcacctccaggctgtgggtccagtgacccggcatggagccagcaaacagaggaggcacctccaggctgcagggtccagtgacctggcatggagcaaacagaggaggccagtgggcaggtgggtgttaccagggcctggagcagcaggggtggagccctggggccaggcagggcgggtttggggtggcatgtggtttgttgtggccctgtcatttgcagtttgggttagtgggtctggctggccaccggggttggaggggaatgccagtgggactatacattgtctccttggaggtgactgtgcccccagaactgagtggacaagccaggcttgtgtccacacctgcccccgtcttttaccctcttctggctctcctccaagaagagcttttcctaaatcattcgccctgttcacctgggctttgaggccccaggtgtaggcccagggggtggggtggggtggggggatggtctctgactggatagccccacctgggtaggaagcccccagtgtggccccaccttggctgtgacctgggggtcctgcagagtcctgtgtcctgttgcagtgaggggtcagtcagtgggaagagtggacaattaggagacaccatgtctgtctcctcgacgccagtcaacactgttgcctttgttcccagggcagccttccccttgccttccattccaaactcctcctcctccctctaagattccctattcacctcctagaggaggccacctgagtgtcagccaggcactggacctgggcctgcccggaaaggtccctgggcctggtgtgctccaagaacctcgctgtcaggggtcagcgtgccatggaggatagggagaggcatgtgcccttggggacgtctggctttgtccggggggttttctgctgctcactggcttcaggtcagggcttggctctgtgctgcagccttaagccagcgggcccaaccgcctcctccaggcccgccagcgcctcagatgtttctctccttcttagagggtgtttcacatcctttcttttgtttgccctgattatttttgcagatgaaggaatacacacaatggtcatctttgtcttatttgaaagccaaacacgttgcttacacgttgggtgcacagtgaatatgtatcagtccagcgcttttcaccatctggtctggttttagtgttgctttatttctggtcattcctcaatcggggctaaagatcagaaaaatcgcatctccaggtcctgagccatggcgaggaagctgggtggtgccctgtgctgtgtggctaaggtgggggacgagggttgtcggtgggggaagccccatgggggccccactggagtcataggagcgaatggagcacccactccatgccttctgtcaattacaaagcacctattatgtcccggatactgtgtccaacacagtggacacattgatgggtaaggcataatccccccccaggagctcccagttggattgaggaggcagacaggcgagcgtatggctgtgacacacccagcaactcccagttggatcggggaggcggacaggcgagcgtatggctgtgacacaggggggcaagtggcgtcaccaaggcagaacccagcagccggggcctgaagccccctcacccagctgcagccttcccgaaacagctgagatcagcctggagagctcttcctccctgcctgcccggagggtggcgtgggtcccatcgctctccgtcagccacggccagagcacacctgtgctgctcctcagaagggcatcacctgtggagacggtgacagctgttcctgttccctgccccaaggacaggatctggagcctgtgggtgtgtaaggagccaactccctgaccccaaaactgtggccagttctggagaaggtggccaggctctgggtcccgggactgtggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcaggtgagagcggcagcctgagagctgcgagccggggccggggttttcctggagcagcaggagggatgagttgggtttctgtaactacaagggccaagaagagggagaggatgatctgggaaggagagtggctttgggccagcatttgggccagcaggactcagaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaatgtcccctgggctgaggtttttttttgttttttgtttttttatgtttcagaattctaaggcaaggatgaaagtcttctctattcttgaggtgctggggttcctcagcctccaccgtccagcctcgagcagctgccccctctcacctgctcctcagccttctggaacagacaggccccccacagcagcccagcccaggccaccagcaccacccccagaggtttatgccatcttcatgcagtgggaggctcagcccccacactgggacctgtccactttagccccaaggatcttaccaaggtcaaatctttggaactcagggtctttgggaacttctgggccagacaacccggccatcacaggggcttctgcggggttggctttatgatgcatttgggtcaggaggtctgtttttatcctttgggcctctgggaaagtccgtcctggccaagtcctctgtcccctagtctcatggctggctggccctggagctcgggtggcctggcccggcccgcctgcttccccacaggcagcggctcttgcttctgctgcctgcagtgctccagatgctgcaggctccttccttccttcagggcatcctaagtcccccgagtctcgaatccccagtctcagctgagtcctcgaggtcagtggggcagaacgccagagccctgggacaacgggctgcataaaacacttattttaattataagagtgatgtaagaacatatcagaaaattggcaaaatacagggcaaaaaaaaaaaatcactggtggtcgccttctcacacagtcacacacagtggtgtgcagccttctggcttttggttgctttgttgcagtattggcacctgcgttacaagattttgtgttgaccattcttgttcttgctgtggtctttaaggtttacagcgacagctgttcctcttcaggatgcaaggagaccgagcctgcctgccctcagggagctgacggtccagcaggaggcatcctgtctgcagggcccatgcgggggacagggcaagaggtgcggtggaaccagaccttgccctccagaaatgcagggagacagacacgggcgtatttaattcaactatagcatgtggttctgagaaggcttcttggaaagggcctggggttgagctgggcaccagcagggaggtctcagagtggaggcggcagttccaccctacggcgtagaggaggcgccctgatcactgcctttcagccgtggccctgcctgtaatcttatcctttttgttgattgttgttggctgatgttggctgttgctgtgtcctccaccagagtggagaactccctggggctggaccccttgtccttattcacccagagaataggtgccttaaaatactgactggacagaaggaggaagagatgggttggggggccgtgtcatggaagaattccttgggccagccgcagaggagtaggccttggcagagagctgggagcctggaggggagctgaagacctctcccatagtcagctgcctttagggaagaaatactagaaagtcacagaagagaaaagaggcggggaaggggaggaaagcatttccacccacagtcctgtcgggagaggtaacattttggagtacagtgtgccctgccccagcaggccctggctggatgcatattcctatagatataattctataagtgagatcattccatatctactattttacaacctgtttttgttttttgttttttccacttagcaacactttgttcttacctagaattcaccaggcaggacagggctgatgagggagcccctcccacctggacactcagtggcccctcccaggactcggggctttcctgggggcctcagctgcggagcaacagctccctgtgcatcagagccgtgggggaggggggccagggggcataggtacgaccaccactcccatttcgtgtcctttaggaagcttgaagaaaagtggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagccccatgacagccccttatgcatggtaggcactcagcaggtgctggctcccttacggcccgaaggaatcgattgacaaactctcaaattaatgacataattcaagagagtagctgcggagacaataaataattatagtagctgatgtggtttggatgcgtgtcccctccaagtccatgttgaaatgtgatccccagcattgcaggaggggtctggtgggagttgattggatcaggggggcagattcctcatgaatggcttgggccatccccctggtgatgagtgagcaatttggtcgattaaaagagtgtgtcacctccctattcttttgttcccactcttgccatgtgacacattggctccccatcgcctcccaccatgatcgtaagctacaccagaagcagatgctggcaccacgcttcctgtacaggctgcagaactgtgagccaattaagacacttttctttataaattccccagtctcaggtactcctttgtaataatgcaaacagactaacacattagccatagccatttattaacataattttaaaagatttcagtcttgtgctgaaattgttatgttgatggttacacatttgtcaaaacttagtgacctgtacacctaaaaggatgaacttaattgtgtgtaaagtataccttaataaacttgactttacaaaaaaaatccctcttttttttttttgagattgggtctcactcacccaagctgcagtgcagtggcacaatctcggctcactgcaacttccacttcctgggttcaagcaatcctcctgcctcagcctcccaagtagctgggattacaggcgtgcatcaccacacctggttaatttttgtattttttagtagagatggggctttaccatgttagccagactggtcttgaactcctgatctcaagtgatctgcccgcctcggcttcccaaagtgctgggattacaggtgtgagccactgcccccagcctttatatctcttgactgtcacaaaatgcatattttatttaagtttgccataaacagaacatttttacatactgtattgtaacagtatataatacaatacataccgtattgtattgtgtgtagtacaatacatagcgtattgtattgtgtgtagtacaatacatagcgtattgtattgtgtgtagtacaatacataccgtattgtattgtgtgtagtacaatacataccgtattgtattgtgtgtagtacaatacataccgtattgtattgtgtgtagtacaatacatgtatgtaatacaatacatactgtattgtattaatcagatatgttgtcctgtgttattaaaatcatcccttgtggcccaaatttgaaggcagtactctgttcctgggtgtgcaccgttaacttctttaatgaacatcctgctgttcaatagtgaggctgcatccttctagaaagcgctgttgagaggtgtgaggaggctgccacgcaggccgcgccgccccgaatggcaggtggaaggcggctgagtggagccgcagcaaatgcaaccctgcccccgagccaggccccaggctgcacctttccactgcttcacaccagcagtgctttacctggaaaggtgtctgaacagtgcttgcaaaggtaactggcattctgccggctgctcaactctgtggacaccagtacagtcaacaactctcactcgccgcgggcacctgctgtgcccacctgctgccatctgagtgtcacgaccacacccccatccctgtcctttcacgcactgtctgcccgcacacactcttccaccctctgtcggcagggcccctgccacctctgaagccccctgccagctctcggcagccccctcctccccctggctcccgtgtcctgcccacctccccacactggcacctcctgagcagccctggctgagcatgcactctgagggcagaccctggccgggcaccaagatacaaaaggttatgagggtgttctcttgaggaactgagtccagtgtgaacagtgaacacagaaacataaagggacaccagaatccccatccccatccccagggtggtgagccaccgaggggggccaggcacgggggagggtattcaagggcggcaagccaccaaggggacggggcaggcacagggagggcatttcagagagtgcaaggaggcggcgaagatgctggttgagggcacgggtgaggcggggaggcgtttcgactttggactgaaggccttaattgaccaaggcggtaatttccagtcctgtgacctcacgacaggctggacattggaggatgggatgacactggctcttctggggtaacttgtctgggtttaaggttcttgatggggtttaggacatggcgggaccctaaggatggtgccagcatctgaattctctgccgtcttgcagagtcaggattctgcagctacttgcccaagaaaaagtagagaaaggtggtttcatgtttttttttttttttttttttttttactgctttgaagggaggtgtgggactcgtttgcacacacagttaatatttccaaggcttgtgcagggccagacagatttggttgcagctgttagttttacttcctgtcccgataaaggagggtgcttgcctcagctctcacctgctgccataacaaagctccatggaccgggccgcctaaatgcagacacatactcagctctggaggcgggaggtctagatcagggcgtccgcattgtcaggttctggggagggctcttcctgctttgcaggtggcttttttctctgtgtcctcctgtggaatgagagcaaactatagtctcttcctcttcttacaaggacactaataccatcatgggggcctcactctcctgacctcaccgcaacctaattactttccaaaggccccaccccctaccaccatcgccctcggggttagggcgcctgggtacacatttgaggagagggcacagccgttcagtccatgaccacattgcatgttccagggaggaactggagagaggctgctgtttgctgggcacctgagctggttatagatgttaaatcctcacggtagaaaatgtggaaaatacagaaacaattataatgcataatcctacaattcagagatcatcacagcagacatatgggtccatttcttctggtcagtattcatttacagcgaggcggacagactcatgctgtaattgagtcatgctatgtatttgtttcaggtcccgctttttctttccacttaagacaatatcattcatttcctgtatcattaaaaatatttgcggtcgggtgcggtcgctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctcacaactggtttcccagaaaaattgtgaggatgagcgaggtgttgcttgtggaagttactttggagggaaagtgtttgtgacaccccatgggtgtggcccatggggctcctgagggtggatggatgtgggagtggacaggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaaccatgccagcagttcccccatctgctttatcagccctggtatgtacatcagattggctaagggtgcaaaactggaatgctattaaattccagaggctctggtcgcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgctggctatactgcagcccccctcaactggaatcagatgtggcccaaccatgaatactttggacaaagctcccccaagtcaggcatgccctcttgttagggaaggtggattcctgacctgagtccatctggaggtccaggcaggaattagaaccacttcagaaaagctctgcacagatttaattgcacgagtacctgcgtctcagagctgcagactgagtgtgttgtgcaattgttgggcggcttttcccttggccacagtagattcgcaattaagaaaaacaaatgcagctctcagtcagaagtgtgcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgcgctgcttgtgttgttgaattgggatttttccagccagaccagtctgctgggacaagccttctggctctgggccaaaggcctccccagctgtgatccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcactcacctatggcacatatcattggccgcaaaatctcctgggcacttatcacactgcgggttccttgaaaacaggaatcattcttgttctctgctgcatcttaggatggtgactggcacatagtaggagtccaattaagaatgttttgaataagcgaaagagtgcctaaatgagacttctattccagcttgaagaccagcccaccaccctgataagaaagttcaagtgtgggaaccgctggggatcttgatggcctgggacctctggatcagtgcttgtgcaggacagaggcagccccggagttctcatgggggctggtgagcagagtggggccccaggatgcctgatggcccggtctgaggtgtgcaggtgcccctgaggtgggcaccacccaggagatgcatgtatctgtgaaataccagataggcccttagtctaagcaaggaggcatctaagctccttaaagattccacaaggatgttacgttgtgctttgaacaacagagacgtggctctgctgagccccagccaaagctctgcacagggaccttgactctcccttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccgccagagcatcatgtcatttgggatccctgatggcaattttgagactttggttcacagtaaagattggtcctgtgtgatcttaaagtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccctgtgatccaacaatcatgctccttgatatttacccagaggagttaaaaaaacttatgtccacacaaaaacctgcacatgggtgttcatagcgactttattcacgattattcataacagctggaacttggaggcagcgaaggtgtccttcagcaggtgaatggataaattagctgtggtgcatccagacaatggaatattattccacagcactaagaagaaatgagctagcaagccatgaaaagacatgggggaactcatctgcatatgagtaggtgagagaagccaatctgaaaaggctatgcctatggaggattgcaactctatgatatcctaggaaaggcaaagcgatggagataataaacagatcagtggttcctacgggttaggagggagggagggatgagcaggcagagcacagggcatttttaaggcagtgaaactgctctgtgtgatactgtagtgggggagccatgtcattgcacagttgtcaaaacccatagaatatacagcaccagcagtgagtcctaatgtaacctacggacttgggtgataatgacgtgtgaagagacaaggcgggttcatccgttgtaacaaacagccaccctggtagtagggagggcaggaggtatgtagagaactctgtgctttccacgcgattttgctgtgaactaaacagctctaaaaaataaagttcattaattaaaaaaaaaaaaaaaaaaaagggaaatgaccacatgcaaagcactgcgtggagggccacgcatcccaagcaagtcagctagagtagaggcaggaaccaaacagctctatgaggttctggatgagaagccgcatgcaccaccccctccctgctcccgtgtgggacccagtgaagacctcctgtgcccggctgcagctgctgagtgtgggagtgtgctctccacagcaaaccagccgtgaaggctgcacaccttcctgtttctgcccagccacaccacagggcactcagcccttttcctgagcacttgaagctgcgtttcctcgagctccttcctgtttaagaacaggaggggagtggcggctcgcttgtgcaccactctccagggcagtggtgtgcgggacaccctgcagcacctttgactcctcctctgggaatgaggcgtggtttaatctgcaaccccttaccattagagtctgcaactagtcaaaaggtgaatctggctgggcgcggcggctcatgcctgtcatcccagcactttgggaagctgaggcaggaggactgcttgagcccaggagtcctgaccagcctgggcaacatagtaagacctcctctctacaaaagtaaacaaaactagcctggcgtggtgtcatgtgcctgtggtcccagctactcaggaggctgaggtaggaggatcacttgagcccaagaggttgaggctgcagtgagccaagatcgcgccactgtgctccagcctgggtgacagagtgagacccaccccccttttttttcagaccgcatcttgctctgttgcccaggctggagtgcagtggcacgatctcggctcactgcaacctccacctcccaagtttaagcaattcttttgcctcagcctgccaagtagctgcgattacaggcacctgccaccacacccagctaatttttgtatttttagtagagactgggtttcactatgttggccaggctggtctcaaactcctggcctcaagtgatctgcccacttcagcctgccaaagtgctgggattacaagtgtgagccacccagccctgagtgagaccctttctcaaaaaaaaaagaaaagaaaagaaaaaaaaggtaaatctaagaggtgaccagtaggggaatatatttgtcgagtctcctcacctcagcactgttgccatttggagaagcataattctttggtgtgtgcggggaagggggggctgtcctgtgcattgtggggtattgagcagtatccttggccctacccataagatgctggtaggcatgtcccctcaactccccagttgtaataaccaaaaatatctccagacattgccaaatgtacccgggaaaatcactcaggttgaagtcactaaattatatgtgtgtacatataattacacatgcatatacatcgcgtacacacacacacccacacacacacacaccttttgctggtggctctggattggtaagctggctccatggcaagaatcagcatcctaatacttgccccaccctttaaaataaacttcccaatcctaggcagacaaaagaacaaccccagacctcctccctcagggtggggacaaggtgagggaggtggcggcccggcaggaaggtcatttctttcttcagtcacatcagatgagctgcttcccctcactaggagtggatggggctgccagtggtgttcttgcaaaataccccttgtgggaggagaggggtggagggagagaacaccctccacacatccccgtgggatgtctggagggaagggttttgggcacccaccctggggagagaggagagcccaggttaccatctgtggtgtcccctcgctcacactcactactgccctccacaaactgccatgcttgcttggtgcacggtgctgtgctgggcactggggcaaggccccctcccccatggggctacagatgctaatctgcaaatcccagaaaagtggaatctcggtggcagagtggatgaaggggaggtgctcagtgctatgaaagccagcagctgggagtttcaggggcttccctagggagggaccctgagctggggtctgaaggaagagcagttcactggggagttagggagtgttctaggcagagtaaacagtgcagtggcagccggggctggcacttttaaagaaagcctcaagacttctctttctgattgtgaagtgagctgagcagactgaaatcaaagatgtgaaaataaagatagaggcgacaggctgggtgcggtggctcatgcctgtaatcccaacgctttgggaggccgaggtgggtggatcacaaggtcaagagatggagaccatcctggccaacatggtgaaaccccgtctctactaaaaatacaaaaattagctgggcatggtggcacacgcctgtaatcccagctacttgggaggttgaggcaggagaatcacttgaacccgggaggtgaaggttgcagtgagccagcctggcgatagagcaagactccgtctcaaaaaaaaaaaaaaagatagaggtgacaggaagaccccaccatgagtggcctccactgagtgcgcatgtgagtgagcagctgtgcggtggtccttgccatcttcccatcagcccctcccagcccctgggcctggagaggctgagaatctgacctaaggctgcccagtggcgtgaggctggcctgccgagcttacgtccctgggggactccaggaccccagtgcttcctactggtggcttcagctcccggtcacttgtcgggaatgcagggctgaacccctggaggttgtgtgggacagggcccaggaatctgcattctagcaagcacctgctccaggcttgcttccctggcagggaggcttggtgatccaagttccttgggtgcagacacttgctgcttctctcggaggccgggctgggctgtgattttttcatccaatgtgctgggctgatttcacttgcggatgcagaatgagaagctgtagaggagatcacggcaagctgtctgcatggacgatggcagaatccggtgtctgcttggccgcgtggtgtcactaataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttacggctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcttgcctgggccaccatgttgatcctctgggtccattgctcaagagcccaccatggctccctgttgccaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaagacccccccccaggttacaggtaagccctcccaagtggcccagggccctgggagggggtgaggttgtgtgagatggcagtgtgggagagtctcaaatttttggcatctttaatctgcccactgggtgagattgaggactcaggtgggtgtcaggggctttgaatgccaaaccacaaaggtctgcaggctgggggagctgcaggaggttgtcatcagtggcaggggccttggagcttggtggaggagaccacgcttcagatggccagctggagcaccccccaccagccccgctgcctggaccccttccacctctccatggacccacctcaggccctacccaccctctgcaccgccttgcacggcattgcttaatttcactgcaatggctcactggggctgctttcctccctctcttattgctctctgggtgagagttggtctctggcctccacatgaggcagggacagtgcccagggagtggccagtgggagaagcggggcttgcaggccaggtgggcccaagtgtgattcctggtgcagtgctggtggctgtgtcgcccggggcaagtggctcagagcctgtttctcatctgcagatggggggatggtctgtacctgtccagcacccatgaggagcaggtggaacaggatgtggcagtcaagggctcctgaggggacccgtaagtgccacattcagccttctgtgttaaggaccatgagtccaaagagtagtcgcgtgtgaatccacctccttgtgccagcctcacggcctcctcaggaagggcatggaggagcagtgggatgcccacggtaccgtggaggaagcagtcctggaggaagggtgactggccgagggccatgcggtgacgcactggggactggctctagctgctgtggggcacgtccacgtggagaagcgcttggtgtattcccccaccctctcacccccacagcgttcctggtgctctgggtgcctgctgtttctgagccatctaggtgggcacagggacaacctcaccagggacagtgtggccccatgctggtaagcaggcgatactgaccctggttccaaactgcattcctgttggtcctttgtcttgctcttccggtatcattacgaacacaactttagaaagtttaacagtggtactcagagaggcttgtggccccaactcatgtgacagtgaccaacaggtgaaaggtgacttgtggtctgaacacctgcaagggacacttattccgatgcctgaatctttgcatctctgcccagcagatgacagcacctggagtgttagctggtcatacctggacctgcgagtgtaggtaagacccttcttctcagggcctgtttgctcaactgcacgatggaagggttgggcaagatggatctttcctttcttttcttttcttttctcctttgcagttgaacatttttcttgccactgaaatcacaggtggaggtctgtgtgttcggcaggtgaatggccatgcaggggtggagggaggcctggatgctttttcttccctgcactcgcaggccccccatgggaccctcagcccccagaggacaattggaggcttctggactagggttctaaggtctcctgagaaggtcagaggctcgttgtccggccaagacagacagcagacagttggcgtgtctcagggtaggaggctccccaaatagaaagtactggattgggagcggatttattgttccctgcctccccggggccgtcggcatttcccctgtggctgcctcactgttctgatgttggcaaaggtttgttttatcttcctccttccagaacaggaggtgcctcagtgcctcagatgctgcctgagaaggtcagtggcatctgggagccatggtgagggtggcagtgactgggctcgggaggttccagaattctgttagtgagcagtgagctgttttattttccttcctgcctatggaaggtcctgagtgaacaaacaagtttcagtctcaagacaacacatcgtgtttcgaggtgacctgtccccaccccacccctgtcactgggagaagactgcaggtctcacggtctcccgtctgtctctgctgcccccaggtccagggactcctgcgatttctctccctggtgcctggtatttttgtagcactctctggttttcaaagttttcctacaacaattgtgcttaaaatgaaatataaactccatccccagcccccaagtcccactccctgccgacctcgtctcttactgggaaggcccatctttgtcaccagcagcagctgtgagtgcctcgtcagtgtttaagagtccaggtcgctgcagcatcttggtgtgtactgtggacccattgtgtgtgtgcccccaaattcctgtgctgagaccctcactccgagtaggatgttattaggaggcggggcctttgggaggtaatttggtcattagtgcccttataggaagaggatgcgagccagacctgcctctgctgtctaccaggcaagtatataatgagaaggtgacgtaggaggcgggactcgactccagaggcaggactcagacaccagaccaaattgaggactagctacaacagggccagggtagaaacagctttccctaagacgtgcccaccagtgtgcatgtcagtttaccactgccatggtaatacccggaagttacggctcctttccgtggcaatcatctgacgacctggaaattaccacccttttcctagaaatttctgcataatccaccccctaatttgcatgtaattaaaagtgggaataaatctgattgcagtgccgcctctgagctgctgctctgggcacactgcctgtggggtagccctgccccgcaaggaacagtccctctgctgccgctgggcacagctgcttcagtaaaattgctaataccaccggctcacccttgaattctttcctgagtgaagccaagaaccctcctgggctaagtcccagtttgggggctcacctgccctgcaagatcaggagccatctgtacaccaggaagacagccctccccagaactcaactgtgctggcaccttgatcttggacttccagcccccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcagctctgagtgttcctgcacatgctttgtcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcaggtgttgggtggtctttccagaccttcacctgtgtgaagcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggaggccacagtggaattagtcatttgaaaaccagtcacctccaaaatagtcataatccaaaaccatccatctttgacttcagactccattataattttttctccctaagggactttgctttgtaattatgttggatttcctaatatattaaaataatttgtcatctcttgagcacacatctgcctgctatgagcaagcaggagaggccacttccggttttctgcaggtcccagtgagcatgtgaagcctgcgcctgggcaagaggttggatactgggaggaagaagcttttccagtaccctttcccaaagaccagccagtgagggaaatgggcaccgaatgcaccccaccccccggcctgggactgggccaagaaggaggaactgaccccagaaatggccccggaaccataacctgcttacactgtgacctgcagtgcccatggtggcagcctgggctgtttctggagttgagcggagagttcctccagtctaaactccttagagaacatgaatattcctgagggcctggggtccggcaccaccttcagtggactggatcaccttcttgaaggcagagagatcttaagagcttatgtctgactgcctacccgatgcccagcactaatctgcatgcaccccactgggccatgggcttctcaaaggtggggacgctgtccctgtacctaacacacatggtgggcactcggcctaggtttgcagggcctgctggggagttctccaaggcagttttatagctcagctccagcaccttcctgggggcccagtcctggatttgaggctgccaggggggtttgcagtcagctaagttggtacccatccatcccttcccctctgtaaggggtgacaagcactaagacctgttatgtcccctggaagctctacactctgtccccttgctcttgtgactctgctctttgctctcctgtccactggcatataggagtaggaggatattgacttagattcctttttattatttttgtttaaatcagctttgtggaaatgtaattcacataccctaccatttacccatttaaagtatacaatgtaaagtatacaattcagtgatttttagcatattcacttgtatgtgcaattatcaccatggtcaattttagagtgctttcatcactccaaaaggaaacccgtaccctttacctgctagcccctctttccccatccgctcttctgccagccccaagaaactacgaatctactttctgtctctgttctggacattttatatagatggaatcataccacatttgtccttttgtgtctggcatctttcattatatttttggggtcttgttgctgtttttgtgacagagtctcgctctgttgcccaggctggagtgcagtggcacgatctcagcttactgcaacctctgcccctccaggtttaagcagttctctgcctcagcctccggagtagctgggattacaggcgcgtgccaccacacccggctaatgttttgtatttttagtagagacgggatttcaccatcttgtccaggctggtcttgaactcctgacctcgtgatccacccaccttggcctcccaaattgctgggattacaggcatgagccactatgccaggctgttgttgttttttaagacgtggtctcgatctatccctcgggcgggagtgcagtggcatgaccatagctcactgcagccttgaactcctgggctcaagtgatccttctgcctcagcctcctgagtagctgggactacccccatgcaccaccatgcctagcttgtttatttatttagtagcgatgaggtctcactatgttgcccaggctggtctcgcagtgctgggctcaagcgatcctcccaccttggcctcccttagggctgggattacaggtgcgagccaccacacctggccaagaattggtattccttaaatatttgtagaattcagtagtgaagctatttggccagggcttttctttgtggatagtgttttgattactaattcaatctcttcacgtgttataagtctttcaaattgtctctttcttgagacagttctggtagtttgtgtctttctacttggcttagattttgcaggcctcccctgctctttcagtcatagttgacatttattgagttctttctatgtaccaagcatttgttgtgcattagctcatttaatctttacaaaaacttgatgagctaggtagtactattgtcatctccattttacaaatgcgggagtggaagcagggagaggtgagataacaggtcaaggtcacactgttaggaaataggaaacagtccagctgggctttgattccagacagtccagccatgcagcccctggccttgccacctccctctgccattctccagagactcggagaggggcctaaggcctgacatgaacgaagggctgggggaggtggggtcggaagggccccaggaaaagcgtgtgtgtgaagggctcagactcccagttggggagttcggatgtccccttctggggctttcatcttctaacctcctctcccaagcgctcagccaaagggcagcacagagcaccctaccctaaggtgtgacgccccagctggcaggactttggagcagtagatctgtgcccagcaggtctgtatgaatcacccaggcctctgcattttgcttttctagaggaagaggcatggcaatttgtaagacaatcgccagacagaaatcgggagcaaccagacataactcaacataattatttctgcataatgacttctgctacttgattctgtctcgagcaatgactgtaatctctatctgtcactgggaagctggtggccagggagcccctgtggcttagagatagagccaggaggaaatttgcaattcgagttaatggagtgttcccaagcagcctgagcgccaattccttcaaggtctccggaacagcagacccccttcctgctaggaagcctggtgtcagagctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagaggaaagatgcctctgtggagctggtcactgagagtgctggccaggcagggctgcccccaggaagctggagacagtggggcctttgcaaccagatagcgagggacctcaatgtggagatagggtgtgcttgctgagcgtgccagcaggcttgtgctcacctgctccagctgggggcatgcagaggcccctcctaccccaggaggatgcttattcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtgacagagcgagatcctgtctcctgaaaaacaaacaaacaaaaaaaaaaccttgtaactaaccagagcagctgaaaagaacagagcatgggtttggggatttgtgttttgggcgccccacaccccatttagccgagtgtcacctgagctggtgtcccggagtctctttccttctccataaacagttgagaatgagctctctgccaggccggtaggaaggggatgatgaaatgaggacctggtacattctgctgctggttccattgctgggtttctcctcgtggagagcccttgaccctgtccaggtcttgatttctcggagtgtcaaagcagtgcgcacggagctgtgagataaattggctgagatcatcgatttgaaaacgccgtgagaaaatatggggcaaggcagagagcacagaggggctttagggcagcgagcccgcgctatgtgatgctgtaatggtgggtgcgcatcggtacacgtttgtcaaagcccacggagtggcccacgccaagagggaaccctaacgtgagctgcggacctggggggtgatgatggtcagtgcaggtccctcagttgtaacaaatggcctgctctggcaggggatgtggatcgtggggaaggctgtggccgggagtggtgtaaggggtgtgtgggaactttctgctcaattttgttgggaagacctaaaaaataaaatcttttattttattttatttttttgagacaacatttcactgtcacccaggctggagtgcagtggtgtgatctcggctcactgcaacctcagccttctgggcccaggtgatcttcccacctcagcctcccaggtagctgggactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacactgctatcttaaaagcatagggaccttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggtggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagtaattagggagtgtgcggtagatgcggaagagaaacgggccgtcaggtgaagtgactgtcaggattccatcctggctcggccccttggaagacacatgatcttgcaggtaattagctcctgtaagcctccatttttccccgtctgtcaaatggggatgatgattgtgcctgcctcccagggctgctgtgtggattacgttggataatgagtacaaatgcatagacagcctttagcaaggagcctggttgtatagagctgtcggcctcaacactgttaatacacatatgtaccagaggctgcaggttcacggaggaggagtcaccaatccatgcccggggagcaggcagagaagagggaggcgggcccgtcccgagttcacgccacgtgaaaggtgcttggaacgcttgtgccagagctggcagtgagggttgagggtgggagtggccgagcacctagacacccgcaatgcaaattttccttctcagtctctggatggttttctgagctgagctgcgggctgaatgtcaggtgatgcgtcctgacctcttcctgagcacctagtgtgtgccctgtgctgggcccaggaggcatgctgggggcaatgtgggcctcaaggaggaggtcgggtgatgaggggccaacccaggtatgccagtcaagaaaccgtggaggctggagagaccctgaagggagcagggcacagtcgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttctcgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctcagcctccgcctggtctctggtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaaatcgcgtgaccttcggtgcttctgtttggcgatttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctgtctgaatccgccaccctgcagccccccaggcccctgcctgctctgggtgcgaggaaggcttgagggagggcaaagtgcttacagcttgaatgcaccaccctggcctggccactggtcgcctctcccccagtgttagcctggcttaggggctttttccatccggaatccttcctggccctgcctgagctaactccgtgagctcgggagggctcctcatgaccctggtcatcctgccagctcccgagacaggaaggcctggccatgtcccggggctgccctcgggtctggagagcctgccagccatgctgtggggctgcccttccagcgttgagggtttggttttgtttgtaagcaaggaaccaggtatgcgatgctggagagtgtgtaattctggctgtgcctcttcacagccccttccaatctcgtgcatattaaggttgataaaaacaccctcttcagggtcaatgcgagatcagacctggagtgaagtgtccctgtggtatctggaccagcaggacctggctgccccacagctcctcctctctctccctcctccctctcatggtctcatgactattatggtgactcttgtcactcaccaccctgccccacctgctcctgcatactgtgagcatcagttggggccatggatgtagcaagggtcagctgtcataggctcccggggggacacctgggggagggacatttggggacagagccccatctggccatgcccagcccctgagagccctcatcaccgacttgcatctggtgagtttggcagggtcctgtataaggattaaagtcctccaagtcctcatacaaagtcgctttccaaaagtctggaattttcttggccctagacacgggagatgctctttataattttcatcttcccactcagaaggaaccacctttgaatactcagccaggctaaaatttggacccaaaacctgttaaagcatcactgtcttaatttcagtgttcatgatggggttctgggctgtgtgaggggtggagggcagataccagtggcaggtttcatctgtggccctggtagatgtgagtcccgcagccggtcagcccagggcccagggcagaccccgggcgtggctgctttcccgctgggcaccaacgcacgcacgtggtgtttccagggcaaagtgagctccccaccctctgcccgtcccctgccccgcccttagatctgcatcccgtgggtggggtgggttttcctgccttcctcttcctgagggaggcgatttctccttccgctttctccttgccacagtagctgctgggttgggaggagacatccaggctggggcctcagcctcagggtgccagttagcgtgtggttagctgagaaaaaagtatttttctcagcagaaaatagacacaactgcatgtgaaggggccacttccactccttcattctccatccaccagccttactggagctagagagtgggggaacatctgggtccgtgttacctggatgtcacctgcatacaaatgtcctggcccgaggccactgtcagcacgggtgcacaggggaggcgcctggcccggcaggtcgtgctgaggctgatacccgtgtcaagaagctggagcaggcgaagagatcagaagagggtagaggaggtggtccgaggtgtccattcccatccccagacccctggggcatttcagtgcacgcacagcaaataatatcactgcaccaccaccaccaccaccaccaccaccaccatcaccaccaccaccaccaccatcaccaccaccaccaccatcaccaccaccaccaccatcaccaccaccaccaccaccaccaccatcaccaccaccaccaccaccaccaccatcaccaccactaccatcatcaccaccaccaccaccaccaccaccatcaccaccaccaccaccaccaccaccatcaccaccaccaccaccatcaccatcaccaccaccaccaccatcaccatcatcaccaccatcaccgccaccatcaccatcaccaccaccgccgccaccaccgccactgccaccgccaccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcactggaagggccttccgcttctctctgcccctggcccttggtcatgtacagcaggccgctccccgggcagtggagaagcagcacctgcatactaaggctcgagtcccagcctcccctaccagcctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcccaggcgggcatctcagagagccatctgagcggcctttctggaagtgccctcctaggcagacgctggtcatgaggcagggcagcggggaagggacaatcctcctgtgttgtacattgagggttatatttagggtgacttgggatgacttggcagtatcacttcctgtggtcgtcccctccagccctcagccacggagggcagatcctgtctgacaagcattgtgggcagacacgtgcctgcacacacgtacacacccacatgcacacatacacacacgcacacacatacacacattgtgggcaggcacaacttggcattctcatctgccctggaattggtggagggctggggacattgtcctggcccttctgcaggaccgccaggtgcctggcgggggaatcctagccgtcagcatctccggagcatctgctccatgtcgggctctgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaaggacactcccctgaccttgctgcctgctggccccgggtctccaggccaggtccgagccagccaggctcctccccacccatgtcaccggcctctctaggtggagtccacagtgatctttgctccccttccccaggcatccagcaccacaccaggcacagggcctggtatttctgggacagcccagattacacgttttctctcagttaccccctagaatattcttggacttctcagaccccatgtgcaaatttttagcttagaagtaatcactgggatcatagacgatgtttagcaaatatctgttcttttgggtgttcctaggcccccagagggtctccgggaaactggctcttttgctgaggctagagactatctgggctagaatgtgtctgatggggctctcggagggtgcacagacagtgccgcggtggccgaagatccactattccaaggccggatctgcagaggatttggaagttgtctgtaaggagcgcctagatcacccggaccttctctctccctccttgacttccttcctgcctctcgtcaaacaattactgtgtgcttcctgtgttctaggcgctgtgctaataattggttatgggattattcctagccacaccctgggtaaatggaacccagctctctgtccttgggaaaagggtcaggagagaactggggcccagctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgccacaactctccctgcagaatctgtggcctctggtgctgtgatttaaagactaaagatggcaaagagtggcttttatgagctgccccactcctgattataaacacactctctatgagtcagaggcctgggtgatcatggataagtcacttgccaacagttaactccagactgtagctgctggggccaccgagggcggctggaacatcaccattctgtgcctagcgtttcagccgggctgaggccattttattaataatgatttattgtttttattgcttcccagagatattaaacatgaatcaaataatgcatgtgatgattcactggaggttcccttccaaatttaaaaaagaattaaagaaaaagtttttgacgggtgtgctggtgtggacaccaggcaggcacctgagagccctcccaccttgagctcagccgtgggcagcacagcacagggtggaccttgccctgcagacagagccatgcagcctgcgcaaaaccccagggaggacgcgcgtctcacaaacacctcttcagtctaacatttacaatggtatttcttacaaatggtttccacccgagatatattacaatgtggccaaaccccattcatttgggacacataaattcaaaatttggaaatagttcctttggggctcatgaactgatcaagtttagtcatttctcaagcagggacctggcagaaatgttgctttttaccatctactaagacaagagctaggcagctggttctgctgaacaaggtcccggggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttcttttgtgtgtgtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacaggtgtgagccaccgagtccggccaacaaagagttcttatccgttcattacaaacgcccactctttccagtccttacctgatcaagaattcagaggcaatttttcaggtatttttttgactcggactttacaaatttgaactaccattcaagtaattggtctgaattcctaagtttcgatggtatttttctcttccttcttctggctgcctctcctccccataccctgcatttgttaatgtacccatttgttccatattctgtttgttctttattgctctatacactgctccataatgttctctatcatttgtccattcattacccatgaaggtacatgcagaggtcaccagcccagaggtttgtagcagggacaagttacttgctggtggtggtctccccaaaagtttgggcctgcgagtcattgacacctacacactttgaaaacaccccaggatgaagtctgggactggaaggagctcccaccttagccagactctggcctcctccccagctgtgtccccgccagcccttctccagccatgcccttttgcctcccagcacactgaggattcctcctggaatgcccctcaccccgtctttgctgggtgagtgtttccccagccccgctgagctcaggtatcagccccagcgctctgggtaagtctgggaccatctcctacattgtctgcaaaatcctgcagaaagcctggcctgtgctggtcagcaggatgctgcgtttccttttaaacagacccaaagcagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattccatttccctttatcctcacaactgctcagtagaacctgcaggcagggacccttattcccattttacagtcaaggaaaataaggcccagagaagttgagacagccaggaccatatggctggagacggggcaggctgggcagagcccccagcagggcccctgggtctgcgggctgctcccagcagcacccctcatatacacaccctcatcctgactgcaggcccctgaagctggcattctggttcaattttacagaggagcaaacaggctgggtctggagcgttgacactggcaactctagcccagccttgcctgactccagggcatggctccaagaccctggaagagctgcctgtccctccatggcccctccagggcgtgctgggtgctggcagggcaggctgaggcactcgacagcagagttggccccgtagtctcagttttgctcccgctagggtgaaacacggttccctggggaagggctgttgctcacctcttggcctggaacatcagggtggaatttgcagacggaattctgccatctgacgcgtagatcttccccccaggcatgggtcagtgcttgagtcattctgcagctggcacaaagagccaggaagaatgcgctccaagatgcctgggagctggcatgccaaatcaccaggcgtcatcagcacagccaagccagggtgggggcctcgggcaggagcagcgccctgccagctctggctgactgcacgaggggccacatctagagggactgatgaaggggcgtctaaagcctcagtatctccagcctgctgtgccctcttacattttctcccaaagagcagtcagcttgcagtatgcgccaagtccccgcaaatgggacgttgggtgattcacatggttgtttcagcttttgagtttttgttgtgtgattgaatagtaatagaattattcttggtgttctatggagcattaccgggtagtggggaggtgggcacactgagcctctactgtttctccccttcacccctccttgctgtcatcaacatgcgttctcctacagtcatgctccgcgctaattcctttagtcattccttccagcattactgaaactggaagagtcttttgtggcatgtggggattcctcgtcgtgcagggcttgagtgccacaggacccagtgctcgctgtccccatgccctggcacacactgttccctttgtcccagctggagaactcctggaacctttaagccctggctcagccctcagctctgtcccatcccagctgacctctgtgctctgcgcccgagctcctgagcccacgtaagtctcttcatgcccatcactgctgtttcatgggcgtgtgtggggggtcacttcaaggagccccaggaagggtctgtgtcttgtccatccacgtgtgactacacccagcatggaacaggactcgggaaccactgaggtgtgggtgaaggaaccagtccagagactccactctcacttcagcctgatgtttctggggtctgtcactgaaaaccccaacttcgccttcaaagcgagatcctgggtgggggcagaggaagtcccaggctctgtggccaggactccacacccagatttccaccgggctcgctctagcctggccctggcacgggtgctgcgtggctctgctccccgcctggcatccggcacccttcacctctgtagaaacacggaactgtcacagggacagacgtacatgggtcgggggttgctttcagaaagtctatggtctcattttggtcctgcctttgagcttccttttcctgctgggttagggttccggacggaaggggagcattctcttgggcgtttcccttttcctgtctccctgttctctccccagaggctcatgtatgtccgtttcactcacctccctttctctgcttgggaggcagctcaaagagctcctctccaaagactcaagctggagtgatgttcgctctatgatgacgccgcactggtccagggaatgatctcactggagagtagcaggaagtcccccatcctgtcccccaccccactggctgaggaccatatagctgggatgtgttcacctgggaaggagattggcaccagtttgataaatggacacccccaagtctggcatggccccaaaactctactctgctgcagctgtttccatgccagaaaacagagatttccagaataccgagtctgaatgtgccttcttggagcagcttcaaatctgagcaggagagcacttgaccatcctaacccctgaccttcctccagcaattcctaaaactggaagagtcacagaatgttagaataagagggatcctagaaaaagaaccactcactcattgctttgttcatttgctcaggcactgtgctaggcgcttggaatacacaaccattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaagaaagagaaagtattaatgagatattttatgttgttttttttcatatgaagtcgtcaaaatccggcgtgtattttacactaagggcacatatatgagttcagactggcgacggtttatgtgctcagtagccacgtgtggctggttgtgaccatagtggacaaagcagccctagcttataggtggagacacggaggcacctgagaggggcggggtctcagctcaggccctgggagcctgttcaacagctccctctagcgtcggcccagccacacttcagcctggatggtcccagatgcatcggctcctccctgcacctgggtcctggcagccggcacagcctccccgcaatcacccaggggcaaaacgggcccctccttggagaactaccgggaagctaaggctgcaggcagcttgactgtcacttgcttatttggaggaaagaaggacacaggcccgagttgttttgaaaaatgcaatcagccctaggagaggggcttagctgcaggggccgtgtgggtccagcggtcaccgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttctttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaagacttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgcttaatgaatgacagaggggtcacagcagcatgcagcattccccccgccccccgtttcttgtgaggcagcctgcgtcgggcccgacagcctccaggagagagctaaaatgaggtccttcagattacatatttcatctgggcccttgttaataagcaaatgctggctgtcccagtgagtgactgggagtgtgtgtgtggccgtcaccttcatttggcattcatgggctccatttaccagtttcataaaagttccagtggggaggccatcttgcaaagctgtcctggcgagcacaagcagagtgctggacaccagccaggagcaccctgggtggcctccacggctgcttatggtcttggcatggaaagggcccagaggaggttacaggacaatgggaaggaggtgggctctccactcagacctcctgggtccacagcccaccaccccaccgaagcctcggtcccttgtccctaaggtggagctgacattgcctcctctcggcctagccaggagtgaccccactttcccagctcctagaatcttcactgtgtcctcccctggatgtggcctacagggactgggcctcctgcagcctttgaaatcctccttgtcattcagttgtgattccaaatgccgttgtcctaggcaagccgccgagtgccccgggaatgagcgactcccctggaccccactttattcactttttatgccccttcctgggcatgcctacaccataactcaagccccccagggagctggtgactggggaccggcatcccagtgctcagcctgggattcggcactcagagggcccgacagcctggaatacactgagcaccccgctggcaccaggccccaaggacaggctgatgtttccacttccctggagaaagatcctccagtcccctgctcggaggctgatcccggctggctgcccgcttgctcagggcaaggaggtaggctggagagggcagacttccctcaactcacccatcttctgtgggttcctcaccagccttcctctgggcctgttgttctcctgtccagtgtctttccagagaagattcctcccccaagctttggagatggggctggggtgggggtggttacctgaccgctgagtcgcagtacagggttccatgttggtcaggggtggctaattgctgtaagaagcaagtgccaacctttgcttggcccagtgaagtggtgtttcctgatgtgttgcagtgggatgtcaccgcaggagacgaaggctctattccacgcagtcacgcaaggacttaagtttcttctttttagaaggtctttcgtctcacagcctttctcagccggggttccaggagggaatcaaggactcacagcaaaggcatcatggtgtgcagggaacgactttcctcctgcatacctggaatgaaaccagttacacaccatccttaggtacatgactggttggggaaatgggcacaccagtcattgactgcaggctgtggttcagatgagaaagcctggttgagaaatgctttagggtctatgccctctggggcctccaagtcctcccctggatagtctgcttccaggtgcccagcaagaaagggcaggaaagggcgtgtgcagcaagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctccttcctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttgaaagagaacagatgcagaaacagatcagagggttgctgctctggtctgtgctgggcctggaggcccagagtccttcctcctcccctgcccatcctgtggacccccaaagccttaggaaggtccctggggctcctgggacacagctcagaggctcctggctggtgtcactcctctctgtgaggcttgaattctctcccttgcattccgaaagtgggtcacactggaataccagctttgtccaaacctccctgcctctggagttagccaaaccttaaagcaggttcttgtgcatgtgtgtatacacagcaactgcaaccacagcaagagtgtccattcacccaacacagacacccaccttgtgccaggcccagctgggtcacctgggagagggtgaagggtaggaagcccttccagaggaggtgctgagtgaggcaggaggccgcaggcgcacacgtctgccctctggcacacgcaggaaggtgctgggaatgcagggagcttctccccagcagaccatgatgcactccgcctgttaccttctagcggtgtgctcactgggtttggcactgcccctaatctggtacctccctttctatacgcatctgtgatttcaggcagataagtgttatgagtttggcattccaatgggatcggtaagaacataaatcaccgatccatcctgggataaatttctcccttcgttctgagaggtgatttggttttcactgaggtgagtggattcttaaggcagtgatcctcaactcccagggcctagaacttcacagaaggtggctcattttgataatgaaaaatgcaggggtgcaaatcaggcagaaagggcctgccactagccaacaatgtgtccatcaccatgtcgcccttgcctgggccagcctcccctctgctgcccatgcaaggcctggggaggaggccagaccgcctgggtccaagccctggctttgcctctcagaggttccggggctctcccagggttggtttacttgtggtgaagcgtgactaataggtaaagtatctgacaaaatgggccccacaggccatggttgctgcttctggctgtccctgctgagagcaggtgtaacgtacctggcatcactcctgccccagagacaccgataacacatgtttgtcagctgtaggtcagttccccaagggtggctgctgtgctactgtaacacgggactgcagactgggcacttaaactacagaactctgttttctcacggtctggaggccagaagtccaaggtgttggcagggttgggtgttggcagggttgggtgttggcagggttgtttcctccagaggcccctctcctagaattgcagatggctgtcattttgctgtgccttcacacggtttcccctgtgtgtctgtgtcctcatctcctcttcttataaggacaccagtcatattggattagggcccaccctggtgacctcattttaacctaatgacctctttaaagactgtgtttccaagtacagtcccattctgagggacctggggttaggactttaacatgggaatttgggggaagcacagttgaggccatagcagcagctgtctcattctgctcacagctggttctctctggccacgtgccagagaggagtacgatgccatccccttaaaccacacacggacatgctgccaggaggaacgtcatcacctttcagctgaaaggagtgaggaatgaggacaagcaggtgcagaacacagccttctcacgtactggtccattctgcacgtgcgctgctgctgttacagcggcagacgggaggctgaactagagacacctaagacaaaccctgctttcccctccagatgctggctgcaagaacgccacagtttgagaggagtgtggacaatagaaagccttgagagcagctgagctgacgaagggatgggaaaatgggcccttttgaagcctaggaatgaccaagtggagatgtgcagggtttgggggtgccccagcttgagtctcagtgctctgagggacatagcgcagagtgggacagcccggtgggtcaacccctgcctggttctgcagacttggagaggtgggacttctgccccaggccgcatggagggccggccctgggctgggtgtgcctcacgctgcctgggagcctcaggcaacctgctgcagctgcttgttttgccactcactggcctgactgcgggagctggaggggctgggaggtcattccctactccacagcttagctcaacctcccaggtgccccgcacccccatccctcccttcccataaaaccagttattcctcatcctcataagcgctcctaggacacttgccatgttctatcagtttgggggttctctggggcagccatccacagatccatgccccgcctatgagccatctcccctctccttctcacccccgtgctccccgtgtggtgtcggcccccgaggcaaggaccgtatgggttttgttcactgcccacactccctctgacacacaggaagttctggaaaagcttccgcatggtgaaggagccacatgcggtttggtcgggtgccccaggcctcctcttgatcatcacgaccaccctgccatccctgttattcggggggagtccagagctccaggaagttgaccacctccccaaggtcccccgagcaggggtgggtggaactggctctgagcccacactcaatgcctttcccctgtgccccggagcctggcttggtgccacccaggacttgtttgtggaagtgacatgtgaacacctagcgagctccatgggctctgcgtgtgtacgtctttgctgactcagtggccccacacagcaacccgagggccagggcagaaagcacaggaggagccaccacgggtgctgcagggcctcaggctgggcatccatcctctacctgtccttctgccgtccatctgtgggttctccctcaggtgccacgcaaggctggtccttcacaatggcccaggccctcaaactcagtggtcaggagggttcccaccacctcagggcttagcggcagtcaaggtaacctcaggtcctcaggctacctttgcaaataggtccttgcaaagaccctaattcacattcacagatactgggagttaggacttcaacatcttttaggcgggccatgattcaacccatgcatctgggcctaggaagtggaactgccccagtgagcgatgccctgggcactgtgcagttctgggggacacagccctgacagccggaggggggctttctgggcacagagctgtctgggatccgccaaggcaacacaggaaggagtccagagctcacctgggtgagacccgagagctgtcagtgacagcagaatccagagggagcccacatctccaagccaggtccagagctcttccaacaggatagcagtcttgtcaggcactctgggaggccaaagtgggaggatcactttggggccaggagttcgagcaacctgggcaacatagcaagatccctatctctacaaacaaaccaaaaacctcagtagcatctttgttgttttttctcttctgtcaggtattttggtagtagtgatcttctgattttacattccctttttttttttttccatgtagaaatctctatggccatttcctcttgtgaattaattgagtttctaaagtgaactagctgcatgttagaaccaggacttttttgagccctttagagcatgctggcaggcgtcatccccaagccccagggtgggtcatatttctggatgatggaggcagggggtgcaggggtcccctatctgcacattgttctgagtctgatgtgattcctcaactcctccatgaaacaggggccatgcttgtcctcgtctggggcaaactgcagttggagaggctggcctcctgtggctgcatatccagagctgggcttaactggccaggaggagagaagaatcctctctcttaataaaaagtccccaggggctgggcacagtggctcacacctgtaatcccagcacattgggaggctgaggcaggtggatcacctgaagtcaggagttcgagaccaggttggccaacatggtgaaaccccatctctactaaaaatacaaaaattagctgggcatggtggtgcatacctgtaattccagctacttgggaggctgaggcacaagaatcgcttgaacccaggaggcggaggttgcagtgagctgagatcgctccattgcactccaacctgggtgacaagagcgaaactccctctcaaaaaaaaacaaaaaaaaaagtccccagggcccatgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccacctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggagactgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaaaaaaaaaaaaaaaaacaaccctgggatagaggcagagaagaaaggaagtggtgggcagtgtgggtggtctgtcttacctttcataatggagagctggtgcctactgtttagaattcacaaacacagagttcaaagtggttgccactgtggctagggtaggagacatctttttatttctcattcttccatgtacttcaaaaattatcacgccctgtatatcagttaactgttaatgtaagaaaataacatgaggtggtgcagtggcagccgtgtgaatgccggttgatcagtcttgcattcaggacttgtggagaaccgccctgggggatggttttgagcagagcagttcctcgttcccacaggtgcctcatttttccctggttccattcagaacatcatttactgcctagagctaattccagatcctcctcccacccggggcagtttatcaaaggcaaaataaagagggtgggccggggacagtggctcacacctgtaatcccagcaccttgggaggccgaggcaggtggatcacctgaggtctggagttcgagaccagcctggccaacatggtgaaaccctgtctctactaaaaatacaaaaaattagctgggcgcggtggtgcatgcctgtaatcccagctactcaggaggctgaggcaggagaattgcttgaacctgggaggcggaggttacagtgagctgtgatcctgctactgcactgcagcctgggcgacaagagcaaaactccatctcaaaagaaacaaacaaataaacaaataaagaaggtgggtgggggtgactccctgaaagtttctagacgcctcttctaaagataaaaacataatgtgatgcctgaaagagggaagaactgccccaaagagtctgggatgtggctgaggtggccactttgccaggagctgatgagggggatgaaagtaagaactgattttaatcttcgcctctcgtacaacccctggtgggcaccggatgatgccctgttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttggaaagtgagcagttgtcacctgattgggcagacccttgcaaagggcaatggtaaaagccaatgtttattgatcacttgctatacatcagggccgggtggagcactttgatccgttttcatcttcataacccaacaacgtgggtcattctctgcattttacaaagtctgagactcaaatagatgaatttctaaaaattatattttatatatatttggagatggagtctcactttgtcgcccaggctggagtgcagtggcatgatctcggctcactgcaacctccacctcctgggttcaagagattctcctgtctcagcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaagagtagcagggcatagtggcatgcacctgtagtcccagctacttgggaggctgagatgggaggattgcttgagcccaggagttcaaggtgacagtgagctgtgattgcactgctgcattccagcctgggtgacagagtgagaccctgcctccaaaaagaccaaaagcaaaataagaaaaaaatggaactcttcagaaggggtggtcccatggtagggaacttcaggggtgggcctccagtagcgggtatcaaatccgtgaacttctgcagcagcagtggcccgcctcaggaatgagcgacccatttcccacgtagatggttttcacactgtcagagtaaattaacatgggctcggggaactctggtactgtcgtcactttctggctcttagcttcatgcagtggcggaagtaagaattctattccccaggaatcacccgtcctgtcctgtgtgttaacccttaccctttgcaaataggtgtgcctgtcactggccgtgcagaggcttggtcagaacatcaaggcactggtagaactgttccaagcagtgaggagcagccacttctgtccaaacgggacagcccccaaaccaagtccccaaaccctgaaagccttcccccgacgccatcgatggctccctggccggctgggtggtgtttctcatgggacacttggttgctacctctttctcacaatgagaaaatggtctgttgtcaggaatgagaatatcaagccaccttcacgtggagtgctcagaaaatcccacagcagtgccaccactccccacgcatgtcactctgctcagtggccactcaccagtcccatcaccgtctcctctgtacacccaccagcagcacagagtcacatgccccaggctgggccactcaggcagagacacgcagagagaccagtggctagactgagccctcggctgacagtgccctaaacaggccatggagaccccagtgctgctgcttcctgtcctgtcggggctggtgatggggcttgccctgtgagtttcagggactcagtctcttttaaactgaggggtaacagccatggagtaaaatgcacacagctcagcaggcagtgtggggaatttcacacatctgtgaccaccactctccctcagcattcccagcccccgacagggacacttaggcaccttcctggcactacccacccccaggcagagataccagcaccctcaccaccctcccagtagaacccttctgccagctctgctcttgaacttcacatagacacccgtgaggttcactagggaacattctccccactggggaagggtcccgaaggccaccgggagcccctgacctctccgagccttgttgtgggctgggcggaagcccacccttgctgcacccgcccaagcccccgggcctctgagcacagtgtcattgcccccatccgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctg

SEQ ID NO: 37733 - DNA, 164286 bp, Homo sapiens; identical to SEQ ID NO: 37731

SEQ ID NO: 37734 - DNA, 80271 bp, Homo sapiens
ggaagcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggaggtgagtagtcgagtgagggtcctggcgttctcagaggcgaaccgcgaagggtttgtgttttctgcggtctgaggcctggtgctccgtcgcagcctcggggcgatacctcttcagtgtcttgggccgagcccagctctggggcctggtgcgtgtctgagcgaggaacccgcagcaacaatggccgcccggccccccgcacgggccctggcgttcgttgtggccgcggctgggccagtgggagcgacgttttaaggcaggattgcccttcggtgttgagcttgcgttcctcctggagtagataaggggaattgtgagaggctggtaactaacgcgttttcagcgttgggtccctgcagctccgcacactctgtggcaagagccagagctcgagttccgttcctagtcgggtttccgtgaaattgtgctcagttcgttttcctcaagagctctctgtctttaattgttcctttcggaaacgctctcttcctacacgaatgtggctgaacagataagcatgttttggcttgtttttatagataatagaatctgtccctccagctggccctgaggcatctgagtcaacaacggatgaaaatgaagacgacattcagtttgtcagtgtaagtagcaatgatgattggggttttcccagagtaaaagactatggtgggccattatgtaatgttacctcacctggtcatttaatgttcatgagtgtctaatacatactagacactggagcatggcgcaggattgggaaatttaccaaaagagctatctgagccacccccgtagccatcacaaagagcacgtcctaaagaacgtgctgtacacttaatctcgccccctgcctttcatttaaacttaagataaaaacgctggtgtctaaaacgctgttttgaaatggagcaagagtaacttctaaaggcgacacggaggaaggagctgctaatgatgagcaaggacgtagaaaacaggaagggttgtgagagcccagaatcttagcgttatggtgcttctaacatgaaggcaaatagcttgaagatttctctaacctctgagatcatcatgttacggcatagtacagttgatgctcataatgaagaatcctacatcactgggaacatgctctatttttctgagtttgttccctttgagacagtagttttcaagccttagtaagtataaacaggcagattcctgggccccactgcagacctaccgaatcagaatttccaggcgggggcctaggaatcttcattttcagacaagtgcagggacataaggatttctgagcacactttgtacagcatgggtttccaaagcagaagagagtgttttatgatgtattttggggtgattttcttccataattattggagttttagaaaggctttgcgtaaagtggtatctcagctcgccaggcagaaaacggttctgtccccaactcgtcttttggaatgccgtagttagttgcagtttggtattcaagctgtagaatttttcgttgagtgtcagatgtgcatttatggtggatgctgggaaaccttgtaaaattggttattaaacagtttctttcccagcattagggccattttggtaattcatttttgtatggtattttaatagatttgtttaggagtccttcacaagattgttttattgaatttctttccctttaccagtgtatgttgtactctctccttttcattttgatcttctacggatttggagtagaggatgggggtgaattgtatcctgtcctttccttcaccatgcgctgaagtatgtttaataacaggtttccatggctcttgaggacagatatttcaggttcttcctgaatcttggtatatttgtgaagagaatttttttcttatggtgtttagtagaaataatactaggaatgacatacttctttatgaactatggccctttttgagaaacacgagtagcatctcttaatatttgaaaaatgttttgtgtaatgaattacagtgtagcttgtgactagttaatgtaggcttgagttcacctttggtttaaaggagtctttaaattttatgttgaatgtagaggatcacttccgtctttgcatcaagagtaaagaatgtacaatcattgaatatctgacatgatacaacttcttactcttgttcccaaataaaggttcagaggtttgacagttccacatggagaagtgaattatatgttgtaagtgtaattacaatactagaagaagcctattaaaaattttccctttacatttaagtggcaccacttacatgacaataatagcttaattatatttcaaaatatattcagagacagaatctttacttttctctggaatccaatcctatatgtggctcctccagtcagtaatgcttattcagtaaagatgaaaaagtttgattttttcagataaaaaatgagtattgtgatgttacttcttcgtttttacggtttggatttcatagctcttactaacctaattttcccacttttagtccacttggtggcccaggagttattctgtgatttgtagaatacagaatctgaaactaaacacagcatgctgaaggaaaggagtgatatagatatggaggggggtgcaaaaatgggccctctcatttaaattttattgaaatatacataaaagtgcacaattcataagtatacttgttggataaagttttgcaaagcctcatacatctatgtaaacagcgcctaaatcaagaaacagaatgctgccataacaaaaacttcttatttaggtctgttgttcttatttctgtttagtaatatgatcctttattcaactactgtttttatatctttctttgaaattgcagattttttatgtgatttacttctaaaaaactaatagctgatgatgtgatagttcacagtgctgttctagatatgaaggtatacaaactgctgagggaacctatcgtaattttgctaacaaaacaatacaagagattcaggtttcagccaagattattgatatagtgtagcatcattggaagtcagtgaaatcaggatataatttcctaaatagcttcagtaccacatagatcaagtattaatactttagctgcagaagggagtcaggcagaaaatagtattatttggctgggtgtcttggggctgtgattggtttaataaataaaaagtgttgaagctcataatatgcaaagccgtgagttaagttccttagagctacaaggattaatttgaaatacatcctacccttaagggtcagtattttagtgtgaatgatgagataggaggtgagaagtatgtaaatagtccttagaggtagtagaaagttctcttacagaaagtacatagtgctgttaaaaaaggacataagacttgcagtttatcatagtagtagttagtagtagtaataagtagtagttaggatttatatgtgtttaaaagggcattttgagtagaagaaacaaggaaaggcatcagaatgggaaagcagagaggattatgtgtagtcgtgaaagattttttgttgttttttaaggtgggaggaggcggcatgggccaggtagtatagatcttgaatgttggattaaatttgaactataaaacaggcacaattggaaactatttgaaatgttgcctgtcaggactgcacaagtaacctgtgtccctgacttctctatatggggggaaaaatgaattatttagggtttcagatttatgctcaaatccatattctttgttttagagaaaactttggttgtagtaaactacctttttagtagaccatattttggtgtattgatatctctttccaattagtaggaaattggtgttttggcttagagaatcagttttctcataacaggaatgaaagctttttatttcatgaaacatattttaaaacttagaatattggtttaactgttttcctaaactgttttgccatgcttctacatgtgcttctgcccctaaattgtgtggtattgggaatagaattctttaatttttaaattttatttttatttaattttttatttctatttcagagacagggtctcactcttgcccaggctggagtgcagtggtatgatcatagcttactgcagttttaaacttgtgggttcaagcaaccctccctccccagccttccgagtagctgggactacaggtgcactccaccatgccctgcttagaatcctttattttttgttagtggtgcaatagggcatgagaatgatggtttactagttgatggatagaacaaatgcaaataaaaataccttgtaattacaggaccatacgcagttatagttgttaaagatataagtagtaattataaatattataccaaattattttttcttgatatttttattataaacataacttcttttgagaaattggtaatttatttttggtcagtgttacaaagtattcacagatggggtaatagaggtagtccattttctcttaaggaagaaaaaatgtgttatttcaggaactcaggtaataaacattgatttaaaaatagtatttatgttttgaactacctcacaattatagtgcctgtacagccagttgtgtttagagaaccaagtataccccactcagttttcccatctgttaaatgggataatactgataattcaatatctcaccttgtaaagtaatttgggggattaagtgaaatgtacattaaaagctttgcacaaggcatggtacagggctcaataaatgttattgattcttagtcaaataaatggagtactaaatgttttacttccgtaagctcattatcatggaagtttttccatattcactgaaaattagctagtgtacactatttgtgtataagtaatcttttcctttggggtacatgtctgtccttatttttccactcaatctctttgccattttagtgattttcaacatgattccccttctcattctactctgtcacttaaagctcagtaattatttgttgaatgtataaatattctaaatgacttctgttttttctcaattttggattttctgtgatactttttttttttttttttttttttaaagagatagggtctcagtcttgcttaggctggagtgcagtggcgtaatcatagctcactgcagccttgaactcctaggctcaagcaattctgctgcctcagcctcccaaatagctgggactacaggcacgcactactgtacccagctaatttattttatttttgtagagatgaggtctcactgttctgtccaggatggtgtcaaactcctggactcaagtgatcctccgtcatcggcctcccaaagtgctgggattataggcgtgatctaccacgctcgtctggattttctatccatattttcctttttttcttttctcttagtgtgaatcatataaaattattgttcttcagtagttgaaaaatgtttgcatattggtttaatggttcactgcaagaataaatttctgataaccttatttgtccttactccttccctttaaatattactgcagctttttttttttgttgttgttgttgttgttgttgttgagacaagagtccctctctgttgcccaggctggagtgcactggcgtgatctcagctctctgcaacttctgcctcctgggctaaagcgattcttgttcttcggcctcctgagtagctgggattacagatgtacaccaccacgcccagctaatttttgtatttttaatagagacagagttttgccatgttggcccagatggtctcgaactcatggcctcatgtggtccacctgccttggcctcccaaagtgctgagattacaggcatgagccatcctgcctgcagctatttttaaattatgtttttgatcattttctttcttcctttctttctttctgtttttttttttttttttttttttttgagatggagtttcgctcttgtcacccaggctggagtgcagtgggacagtcttggctcactgcaacctctgcctcccgggttcaagcaattctcctgcctcagtctcctgagtagctggaattagaggcgcccaccaccatgcctggctaattttttgtatttttagtggagacagggttttaccatgttggccaggctggtctcaaattcctgacctcaggcaattcgcccaccttggtctcccaaagtgctgggattacaggcatgagccaccgtgcccagcctgtttatcttatttttttccagcccattttactttttaccttgcatcctgtcatctttcatcttcttctttactttctgtgcatgggaactctgcctctgtgtatttctggttaccggggcgggggggtaggggggcgcttttgtgttctgctatttctgtggacctataatgaaggttcctaatgcatatttcttgtagagagcaaagtaagatgattatatcaatgggaaaagctatcattttaatttttcttcttggatcgaacatacaattttcagtcttttttttttttttttttttttttttgtgacagagtcttgctctgttgcccaggctggagtgcagtggcaccatctcagctcactgcagcctctgcctcctgggttcaagcaattcatctgcctcagcctcctgggtagctgggactacaggtgcccgccactacaccctattcctatttttagtggagacagggtttcaccatgttggccaggctggtcttgaactcctgacctcaagtcatctacccacctctgcctcccaaggtgctggaattacaggtgtgagccaccgtgcatggcctacattcttcataccagatgtagattttaaagtaggtgattcagctctgtttaccatatattggagagtattgcttcctctgtttctttaatttttacttccgtgtttatagtttgagcaaaaatctcaattcctttgctacagatccctgcccagttttgccctcttgttttatcttggtatctgaattagtacccaaaagatggcagtttcttggttgagcagaagtcatagcctaggggagaaagaagctatctttgagactggatgcctattctagggaagatcattacctagatctcagcttctgtctccagcagtcaactttctacatcctacaaaatcctttcctcagctattatttcttctgtgttcctttcttttgtttccaacatactggatttctcaaaagaatatggccttttctactgcattctctagtgttttagagcctggcttctgtgctcactactttcttgaaagttgctctctcaaagacatttaaaaatgtctggttgccacattcagtggcattttattgttgccgtgtttctggccacatttaacactgacagctttttattgaggcaatatgatagttcagtttagttctagagtttaatagtcttctaggggagcaactctcaagtctttatttccaggtatgttcatacttcccagattacaggcctgcatttccagctgtctgctagatacaccctgtgtaccactgttacttcagcccataggaatgtcagctttctgtttctgctttccaaagttatactattggcattactattcttatagtcacctgaggttaaaaacttagagatcactgactccttgttttgttttttaaataatcttttaaatttatttttatttatatatttattattattattattattattattgggatagtcttgctctgttgcccgggctggagtgcagtggcgtgatcttggctcactgcaactgctgcctcccaggttcaagcaattctccagcctcagcctcctgagtagctgggactacaggcacgcaccaccatgcctggctaatttgtacatttttagtagagatggagttttaccatgttggtcaggctggtctcgaactccagcctggccaacatggtaaaaccccatctgtactaaaagtacacaaattagccaggcatggttctaacctcaggtgatcccccaccttggcctcccaaagtggtgggattacagacatgagccaccacacctggcctaataatcaatctcttttagttttccattttacttgtattctcttgtatatccactaccatactcttcttgccatcaccaccattagttctgcattgtcatgtgcctatactgattatcttgctttccctgctctccatactcctctatgtgattgatcttgaagcacagttctcatgttattgtcttattattattttttattttcttttgcctattgaataaaatctaggcttttaagcctgacattcaaggcctggttgatgaagaaattggcatggatggaaagaaagaatggaaaagaattcaggtttgatgcttgactctgcagtggtggatgatgaagctgagctataagtcaattcatttttgaacttggatatattaacagacttttgataccaattctaggtgtaaagcactggattataatatttgtgtctttgtagcactgttcttatattaattttcctttcccaagtaattgacatggccctaatattctacaggggtgtaggtgcttccttttaggtcttgtcatcattttacatttatatattttgaatattttcctctgctgcttttgttctggttattttctgctacccacaaagctccctcttcagagtaattcttgccagtcccaaccaaaaaaaacactgtaggtttaaatgctaatttggtttgaataactgttaatgacttctaaatttgcttgattgtttataggaaggaccattacgacctgttcttgaatacattgatctggtcagcagtgatgatgaagagcctagcacctcttatactgatgtaagtacattatatttgatttgtgtttcttcacttgtgtcttttaagaggtattctctaaagagagttaccaaatcagggaaggctgtgtttagaaatagccagttctattagaatgggctaaaataggtagtccaaggagtcctttgcccagatctcctacttccagtttttttcctctactttgaatgagattatgaaaaaaatgataatatgactctgggaaattcagagccttagaggtgatatctgataaaatggaaatggaataaaaactgcaagcttattgattcctctttcccttctcttttcctttactctcctcaggtgccctatacaacaggattcttttgttccagaaccacatgaccacagaaaatttgttttctcttagaaaaaaggatatgtagagatccttttaggaatggaaagtgggggaagggtttataggggatatattacttcagtcatcatccctttaaccttgtctgtgccccacatatttggagttatttatcttacctgtgatgtactggttgtaggtttgacccttggaccaatacttcccttgctctgagaattgaactagttgagccctttgtaacagtcttgcctttcatttgtccttgctttagcccaaacttctgttaatgagctgttttcatcttggattagaaaactcttagttattgttcagagtggccacaaacttcttgctctgtgatataggggattgagacttggacttggaatcagaatacctgggtttgagtcccagctttactctttacaaattctgtgactttggataaattaagtaaccttttagcctccgttttttaatcaaataatacctacctcacagggttgttgtgaggatgaaatgaggtaacaaattataacttcttataactacaaaccataaagtaggactatacaactgggaagttttgttattcgtggacagtgaatgacagaattttcagaggtgcctaaaatgactctaatgggggagttttagattttttttcttctcagtggaactttccttaagttctctttgccatcattagcttcttgcatatcttgagtagaacttaacatatcttgaatgggatatttttttcttttattcttatgagtggtctcacacaggaccaaacagcaggccagcatagcaccacgtgatctgagcttgtttttactctctcctttttcataaacagagtcccagattaatgccagtagttgattttgggtctttggggtagtgaagcttgtggatttgacttctctgattccttttgctgaccttgagtggattgtatctttcactgttaattataataatttaaaaattgagttctacttactggacatgaatctctgcacttgaaagttaacatattaaaagcatattttttttcttccttggttttcttgttcatgtggataacccagagaatgcctgaatctaaggtgccatcctctgagaatcatcgcccagaaatgtgctctagctgcaatgttcctcttcccattggagatagcagctccttctctgggagttgttccagcagtccagaaaggatagtttctcaaacttcctctgttgagaacccattggagaaccagaaaaatgatcaaaataattcagatactaagatctctgagacagagacccttaaatcatcacagaattttcagactctgccttcatctccacttctggtcccccaagaatctttggcctcttctgaggtcaaagagaatttacgtatagattcttcttcagcttcacagcatggacgggatgccatcctctatctccagacacaagtagctgaaatgtcccgagtgatacgtgatctgcagtccaggagctgttttagatttcatcattctaggccaagtgagaactcctcagttccttgggacatctccacctctaaagaggaaaatttatccacagttgaagaagaaactgattacaaatcaccatcagctgatgacaaagggcagccatctgaccccagccaatctagtttcacaggtcttttgaagagaatggaacaaagaggtgttataaaaagggtgacattacaatctgaagcggagtcatgtgaagggaaacctgattgtgtgacttctaaaaaacgtttggttcctccattgcatcctcttctgagaattgccaccactgaggtttttaaagaccctgctgattgccatccttcttccttcatgggacacagggtatatcctgtggccaaggacacctctcctttccaaccaaacccaccagctgaaggccccattgtagaagcattagaacacagcaaaagaggaaacacaacatcccctctagattctacctcaaaagaaatggaggtcatgggttgtaggttttaccacgctgcctccattgcagcccgagctgctagctacatggcctatatgactcaatatcagcgtaaactctgggaagacatggaagatctggttcatgacccagaatttgatcgtggaaaagcaagatgcataatatctgatggtatggatgcaggcctttggcaactttgtactactagggacataatggactctgtagtcagagttatggccatggccatagactatagacggcaggcctggcttcgacttacatctctcactaagaaaacccaggagaagatctcccacttgccctttgatggtacttccctttttggacaagatgtgaaagctgttgttgcagaagacaacaatataaaagaaaatgactataaagatcacaaatactataatcagcatcgatacttttatagtcatgatcagaaagcacattatcacaatagaggatactccaaaggggattggtacaaacctcgaaaccacccctatagatatagaaagaagggagactctccagaacgccatgggtacaagaattaataacctgtttaatgttcagcagagtagtcattcaagatcctaactattttacttgttcctccttgtacaaataggatctacaggtaggagatcatctcaaaaactggatgcatgtctggaatgatcacagctgacatttgaattctagacttttgaaatgaagtatataataaagaaactcatgacttattggccaagtgagcagtggagactttcttgaaagggttggacaaatgtttatcctttatttctggtccaaaaataagtgtggaggaggaccactcaggaatctgaatcctcttgtgattaaagaaaaatataaagatgtgttcctcaggaaaatcttatttgtaaactgaggactagcagattttgaatctagaaataatactagatgtctgtttactaagaccagaggtaaatccttaacttttaggttatcagtgcttccttgttcaggcttcagtttgacagatcttcacaaaatgacacatctgttaaaatgtctttatgtcaagatggtcaactcaccaagagtccgtactactatcaagctctgtgagacttcagaatcagccatgaagctttgtgtcaactggaattcaaatcaaattttgccaaatccagtttgcttccccttggaatggctagatgtcgcaggtctattatggacaccaactggaaaaagacttctacctgtaacatctctgtagaaattgcacagtaactatcttcatcaagactttgatggccaccataccatcactactcataaagctacatgtgagagaattgtttgttgttatcaatcctaatagtctttgacctatcaagctctcgtatcaagctgtaagactgagtcatggtagtctctcactgtaagctgggcctttcaccaagatggccttcttaaacaacctaccttctaaacatttaattcttttgagcttgatagtgcatcacactctaaatacaaaaaagatacgcacatcagtgccctggaaataaaggatgttacacgatccaggcatgcaaatctgaactcctaagaccaagaattccaaacatgcctgacaatcttgtccccttattgtaataaagagggataccatcagtctagattttattgagaatccttaagatttaaagcatagctgtggatgtggtgaagagaacaagccacacagctctgtttctggatatctaagtgatgatatccattaatgatttgaaaggctgaaatcaagatttaagtgatacgctcttggttaattggttacttaatttagtcagattcttagtgtaagagacagcttatctttttgctcccaattggtcccattaatagtttttcaccatactggaactggcagcagatacctcaattatatgtcccacagtatcttctctttagactcaaggtagtggatgtatggtatatcagcccttagatccatgtcttcacagcatgacatcaggaatggagaatatgtcaaatttgaggggtctgaatacatcacctagtattatttgcttggcagccaaaaacagttgtttttattgacagacttaattctgtaacttctgcgttttttcatctgcttgatcaaggcattttggatgtactgctaatggaatatggcactgttttacggtttatgtggcttctgttcttgccacagttgttgcacagtggtaattgatgttttctctggtgccacactttttaataatctattggaagctcattcctcctcccccatcataaccatattcagcacccatttttaaatctacttttcttccttatttgtgctacagaggttgatggcgtaaattttcctacttggaagaaattactttatcagttaatttcagggtactgtattgatcttgtttgtcctatttgtagattaaacttgaactagtcttaataaaggggatattgttttgcaaatttagcccagtcatatcaagagttaatatttatcttatttttctgtattttactcaaaattttatttccacttctgtagaaataggtccatgccagtgttctctacaaagtgtctttcaaactaaactctagaagaatatcgattacctgaacagaaacaaaggcctaagaaatcatacatttttgtagcttatgtgtattgcaccaatcaagcaatcccatgtgctcttgatattggcactgtagttttatcttagaggacttgccactggagaactcagtggtgagagaccttggaaatgttttatgtggctgcacataagtgtttctgactagctaaggctacttcagacttttcactttccatttgtccccttttccttccctgaattagatgctatgtcataaacttggtggtttttgaaatactcttatttcaaaccttaaactaaaccgaaataagttatgcctgagaatgcgtttgtctgaaacgattttggcacttccctttaatatgcttccccttccctttgccttttaaattgtggttaaaaaaaaagaaaaaaaaaggcacataaagctgagcaccttaaccattttttaagcgtatggtagtgttgactatatttgcattgttgcgcagctcctccattcttaaatatttgtaagatgatgttgctgttctcttttcctcctgtgatatttatgttgcccagtaataagtaaaagtatcctttcttagttactctaactgatatgcccaagtgtctccagatactctgttttcctggaagtgtaaaggtattgggaaattatcaaattggtgaccaagtagttctgaaaggatttgaccgtttaatagggatggggacagaatgcagatcaggaagagtttttagtaatagattagtttcttgattgcaaaagaaatatctttaatgtgttaattttttattattttaaaatctctggcatacttgaatgataatgttataaaacttaaagtgaggatttggtctagggagattaccccaatagaatcagaaactcttagtcagataataaatcctcatattatgcctgccatgttcagaacctgcaacaaaattccctactaggccaacctctaacgtttaaatacctctaggttttctaggaggccttggaatagttgcaagtttaatgatctggtattctcaaaaaggatgtatctaatgatcttgattcttcaaaatgttatttcttgattagatatacaatgtatatagagacaatatggtttcttgtagttactgtgtatagagaagtactgtttccatttttatatgaagtgcctttttaattctacacttttctttaaaacttaaactttgatgtcttgcatatattgctggtggtatttatgtgaattttgtacagtgatttaatcttgtagtttatcatttgtacaattgcactatctaaatgtactcccttctgaatgttaatttgttttctttatagcactgttgattcatttcagaaggttgtagagtatacctccctcccccttatttaactaactagacagtagttcctttttgttattagtgagtggctaattttggggggccttaaggcagctttgttttctatagatatgctctaggttttctgattgtctcgtatctaaccttgttcttagccatgataacacaacttatatttgataagtggatgtgtttacttggttagaataagcaaggacatttttaaaaagcagtaaatttgctgacacttttatctttttttaaaagaatgaatgacagcttccttatcagtataattacatttaaacttttttttttaaaccgtgtggcagcttctttatcaatcagtataattccatttatttacttagccctcaaaatgacattttgaagggagcataaactctttcaggctacttggacagtatttagtattctatattagtactacactaataatttactgagtgctacctaagtgacctgattgataatgtccttaaggacctgatacatccaggataacctctcaggtactgtaaacaaggaggttgaaaaagacacattccggaatccctttgtctggtaaaattggatactgatgtggatggacatgacattcattattcttgaagatataactagttgactgggattctgatgaaggtttgaaattatggattagatctttgtagaagtagtttaaagattgcaataagtgaaatcttttttttttttttttttttgagacagtttcgctcttgttgcccaggctggagtgcaatggcacgatcttggctgactgcaaccgccacctcccgggttcaagcaattctgtctcagcctcccgagtagctgggattacaggcatgtgtcaccatgacctgctaattttgtatttttagtagagacggggtctctccatgttggtcaggctggtctcaaactcctgacctcaagtgatccgcccgccttggcctcccaaagtgctgggattataggcgtgagccaccgcgcctggctgtgaaattttttttttttttttttttatgtgaggcatattttgccacagtctcgcactgtttaggttctcttgtcttttggaatctatcattctgtatttaatgttagtggctagtccaataattgattgtctcatctgtatgcatcttatgcatgtgattcaatagactagatcgattctgtgtggtttatcatagtagatacacaaaccagtctttattttttacttaagaaaatatataagtggaagttatcagtaaactggtgattattgtattgaatgcaaatctttttattatttttccagatatattgagttttataaaccattaaaatattattttatgaaatttcccttcctggatgaacagaatattgttttattaaatcttctcttattagtggaatattttttacttctttgtcttttcatttacttgttttttgttataatgaaaactttactagtgtttggtaccattgagataacttattactggaaattttgtttgcttcctgtgggatatatctggaagtggtcatagtccaaccatgtccttttgatgttgttagcatatcagttattctatgtattgatcttttcttctcctgtattcaacacctctttctgaaaggatgtctgatcttcccataatcgctttgatgtagatgatatttttattctatcagtgtatactagacaggattttgatgtggctttgtatttgtatatttaaataccatgtctttaaagcattattagaagagatattctagtttcttctaatgtcccttttaaaaaaaatatagccagtccaatatctcaaactactttgatttttgaacttaaatcaacttttagtgctaccttgtttaatggtagtagtattttctcatttctacatgttcacacaagtttattatatatagtttatggtcatatgtatcttataaaaattttgaagcccatccccatggatttattataatacagctctgatatatcttaaagttaacccgttttccgtagatgttaagggctttactggttgaggtaacctatttcaaatggtctgttgggttttgtggtaccttgtcaagaattcaataagaattctcaggctgtctgtattttcttttaggactttggagatctctcaagttgtactgttttctagtattcctgagtatattcctttggtaacgtgaaagtaaatagtttatatttgatgattttttttttttttttttgagacggagtcttgctctgtcacccaggctggagtacagtggtgagatcacggctcactgcaagctctgcctcccgggttcacgccattctcctgcctaagcctcctgagtagctgggactacaggcgcccgccaccacacccggcgaattttttgtatttttagtagagatggggtttcaccgtgttagtccaggtggtctcaatctcctgaaccttgtgatccacctaccttggcctcccaaagtgctgggattacaggcgtgagccacagtgcccggcctgtatttggtgatattttaaaaaattctactttgaccttaagtgcttcaagaattgtgttcagttagtagtccttttgtaagactaactttcatatgctatctttgctccatgagctatcatagtactgttttctttcattacccgtaagagtggctctatcacagcatttactgttaagggctacagttagacctcttgttaactctacttttatttgtgatggctgtgtttcacactaccttgatttataaatgtagtaatgtgttaaataactatatgttgtggtcccttaatacctcttttgattggtgaggtaacagtgatgtggatgatgaaataaaaacgtttccccaagtcactaaacacagttttcaattcatttttttttacatatttaatttacatctaactactgttaggtatgcagcccgttcctttttgccttcagtagaatatagttatataagtagtctcatttagattcttgggacagaacggcctgtgtattgatctttctttaatggcttggaacagcttctatatattctgacaggtcttggaagcatgttaatatccgtgtgtttaattgtcatcttcctgcctgggaaggcagtagaagaaagaatctacatttgtatagtctgtagtacaggctctgtgctgattgcaaggcactcttgagagaaattcattcttattttgcagaagaagaactgaaacttcattaagtcattaagcaacttgctcaggtggtggaactgagctttaaatatggactttttccagtctcaattcagcattatactaggctgcctccatgtgtttttcaaagccccattcaagttttacttctatggtaaactaattttacatacacaaatcttttcattttctgaacttcctttatggctttactgtcaccccactagtatttgatgtcttagctattaactaattcctgattatttcacttgtcacatcaggaaccctatcctcttagttctcccattgagatttcactgctggactaagattattcttgattcgtagtcattggtttctgtttccattcattttcagcactgattatgttaatcgtattgcttgagttttttctttgttcaatgttgtttattacattcattttgtttcatatacacacattttttttttttaactggcattttgaggatattggtttaatggaaggaaaaaggaatggtgcaaagcacatggtatttgaattccaaagaccttgaccctcagcattagcaagtcacttgttttctgagcctcagttttcttactctcaaatgaggtaatatccgaaagtactttgacaacacactaaagcctgatgcagatttcctttttgaagtaattgtgctgtttctattcatattggatatggtattctatggtattggctatagatacatacattttaaaatgttatttaacagcatgtaaatgttcatttcatgccatgtgatcatgttcccctttatgattttttaaggctgtcttacaagcctaacagtgtactaagtcattaaaagatatatttaaagtaaaatagtctcttttctcaagtacaagctaagaaatgctcataataataaaataagagaatgtagaatgaggagttagagtgtatatgtatgtgtatacaatttttgatagatggtattttgttatttcatatctgtgttgaaaacagtcttttagtttgtcagacatctttttcagtacctgctatgtgcaggcaggtattgagaaaggtctgagaatactgagggttaataagagatggtatattctccagagaaataaataccactaaagtataagagcagatgtcctttttggaagaatgcctgtggtgatggaataagaaaagccatatagaggggtgaggaaaagcttttcttaccaagtgtgtgagctgagttttggaggatgattaggcaagagttagttggcctggtggagaaacaggagccagacattcagctggaggaacaggagtgtggaacagtgtgggtaacacaatggggtgtgtctggtttcagaattataagaaatagtctttagggggaacagaaatgaaggagactaaatagatgatgataaattatctgtgaatatgtactggttcctacatattcaaagtgtgctaagtttgtacagccattacttgtaaggttctaggagttgtctctctaggggttggtttgtaccatagtccattatgtacatctagaacaattctttctttcccggaactgagcccaaggtgggctttctacagtgcacctctggctctggggcagctcaagcaatcagaaagaactgaggcactggtagaaaacaactctgaggatgaacaggataatgttcctgaagtggaatgtggtatcccttcatggttaaatggttgcatacttcagggtcacctatggaaaggtgtcctcagggtagctaaaagtggttaatttccttgtgttttgacttacagatcatttctaggtggacttggggaaaataaagttacttataaaaatattgcttcattggcatttggaggtgttgtattgaaggaggaagtgggttcctatcaccagaaccctctctaggtgtttcagataggaaactgggttgtagaccttgtcccagtaatatctccagcagctccaacacattttgtcaacttcgtattcgttttttaagtttttttccttgctgttggccacctttaccttcttttttttttttttccttctttttcccttattttttgagacagtctcactctggcgcccaagctggagtacagtggggtcatatcggctaactgcaacctccacctcccaggttcaagcgattctcctgcctcagcctcccaagtagctaggattacaggcgcatgccaccattcctggctaattttttgtatttttagtagagatggggttttgccatgttggccaggctggtctcgaactcctgacctcaagtgatctgcccactttggcctcccgaagtgctgggattgcaggcgtgagccaccgtaccaggccccattcccacttttacttttattttctctacagttcatccttttttttttttttccttctgtgccagaggtggaacagtggcactcagggttaaaaaactcccttttgctttgtcacacttcatattcagagttactgtggggtttttttgtttttttttttttgttttttgtttcttgagacggagtctcactctgtcgctgaggctagagtgcagtggtgcgatcttggctcactgcaacctctgcctcccgggttcaagcgattctcttgcctcagcctcccgagtagctggaatcgcaggcacctgccaccatgctcaactaatttttgtatttttagtagatacaagatttcaccatgttggctaggttggtcttgaactcctgacctcaggtgatccacctgcctcggcctcccaaagtgctgggattgtggttgtgagccaccacgcctggccgtatattttaaaaatctcttaaggtccagttactgttatattttggtcctgtactgaaggaggatgtaagtcattttcctaaaatgatttttatagagatagatgttggcagtttactcaaaagagaatataggaaaatcttttttaacaggtttggtgggactagccttattcactgaataaagtactttacagaatggagtatatctatatgtgtgttttaagatttgttcatacaaagcagatgttctgtgtactttgtatttgtaaacaactaattgggggtgggaaggagattgctttgtaaaaagagggtttccttgttctaaagctttgctgctggagatggtaagatggtaaataaatattgtactgttatgctgcgtttatctcttctgctttatctgtatttgcatataaaattcttgagaaaaaccattgcttttcaaagtgttatttgggatacgggtttgagttatataagttgagtagaaggggcttctggtaaacagaactttggggggtggtgcaaacttcagaccaaactatgaattgaagctttaggatgggcaataataagcggactttgaaattgggtttttatgaagtaatccatttgttgcaggaattctgttcaaaccaaatgcgctagtcagataccgtgatgatgtgcaaagttaattcttttgcagttggttgttcctttgagctttctttgaacttggagtcccttacatataagatagaggtgatgaaagaaatagtctccagttggtactcctctggatcatcagtgccagctgatgttcagggagatattatgactgtaaataaacctgccttggattgttttgtgtatatcccctcaccttattctttaccttcttccctcctacaaattgcatctttttctattactggctttttcagtaggcagaaagtgcctatgatgagtgagataggaaactgggttgttgtgatcacttctctgggtagtaactgttcttgcagagtgctttcttcctaggttatatcaccgtgtgtggtatatggagcaaaattgttccatttcacagagaggtctagtgacttcatgttcataatatattcatatttctattaaagtaattttgtagaaaatataaaatggaagctttttggttcatcaagaactaaagtgctttctgaaattagtaataatgatttacaaatataagtcatttctttatcattaaaaagccacaaagtagtacaatgctatgagctattataaaataatttcttctatgaagcccagctttttgttcctttttctttttttaaagcctttattttaggttcaggggtacatttacaggtttgttttataggtaaacttgtatcacgggggtttggggtacagattattttgtcacccaggtactaagcgtggtaaccgattgttatttttctggtgctctccctcctccctcattcaggcccaatgtctgctgttcccctatttgtgcccattggttctcattatttagctcccacttataagtgagaacatgcagtatttggttttctgttcctgtgttagttcactaagccctccagctccatccatgttcctgcagaggacatgatgtcattctttttttttttttggccgtatagtagtccgtcgtgtatatgtactacattttctttacctagtcctgctttttaatattgttttctagaaattgctttgcaaaagtaaaatcactccattaattccgcattccctttgagttaatatttgcaaacatttaaagtaactgatttagctagttatcacaataagttactcagaggttcaacttttcgatgagtgatgtatgaagaataaagtgaaagatctgcctgaatttaatatttgtaaaaaatatactcatgggtcttctgagaaaaaaaaatttttttttttttttttttgagatggagtctcgctctgtcacccaggctggagtgcagtggtgcaatctcggctcactgcaagctccacctcccgggttcacgccattctcctgccacagcctcccgagtagctgggactacaggcacccatcaccacacccggctgattttttgtatttttagtagagatggggtttcaccatgttagccaggatgctctcgatctcctgacctcgtgatctgcccacctcggcctcccaaagtgctgggattacaggcgtgatcacgccaccgcgcccagccgaaaaattttttataaaacagtttagagccagttctgtctggcatttagcttcctaaaccatactacattttcaggatcgagagtgaattgttcaagaaataggcatttgtagatgaattttaacagaaagttcatgtatgaagtcatatacattcatctgaagttacttaagtagaaatttagcttctactaaaaatttattttggtttttaattagcttccttttgagcacatttgttaaacttacctaagagaacttatctttgtgattggaaaaactaagaatcctgctttctatatttacattccaaagaagaatagagaaaggtcaggtctaagtgagctgaataagcatatatttttaagtttcaacttttaatttgactaagtgtactttcatcagtattttaaatacactttaaaatacaaaatcagacatgcttttaggaaaaccatatatgtaaaaaaatatatacaaatttgtgttttagctaaatgttttttgctttaagtgataacggtgtttggcttgaaatttgtgtaaaaatattttcccaatagccattaagcttgttgacctgaaagtgactttccttaattcttgattaatatgtttctgttgagtttggaaaataatgtaacccaatcattatacatatagggacaaaaatctgagaaaagttacatacaatttactaatagattatgttccttctagatgcagcatttctgtctatatttttgtaggatatatattaaacatatttttataaggcaaaattagtgatttaaaccaagtccattatgttcccaaacaaaagactgagatccttaacatttttgtctttgtatagtcttcttcattaataattaaaattagttaacaattttattacatatgctgattgtagaaaaattagaaaataaatgtaaaaaagaaaaaaccctccagacagaaataaccactatttaacattttgatttatatagctttctagattttattcatatatatatttacaggatcattttcacttaaaaactgcaagtgttgcttggcacagtggctcatgcctgtaatcctagcactttgggaggcctagatgggaggattgcttgaggccaggagttcaagtccagcttgggcaatactgcaagactctgtcttcacaaaaataagaaaaacttgctgggagtgttggtacatgcctgtaggcccagctactcaggaggccgaagtgagaggattgcttaaaagtgagctcaggaggttgaggcttcagtgagctgtggtcacaccattgcactctagcctgggtaacaaagtgagatcctgtcagaaaaaaaaagtatctaattgattgatctattagtactaatagggaagagatgttgaaatgtaagtttaacattatcatttcgttgattatgggattttgtgtcaggttgtcatttctagacttggactttttgctgtaactctaccaggatacattaaaagataaacgttgtttagaagtgttgctttacctgtgtatgcttaactttcatggagatgtttcgtcaggtgtaaccagtatcctcaatatggctatcatttctaggatacaaccgaaatttgctctgtgcatgttttacctaaaattttagataaaaatgtaaagaagtatatttgagaatgtaagaatttcatagtgactgaaccagaatctgcctttaggcttcttctggctttacatcctccttaattctatgcaattctgggtatggaagaaaactaatgcagaaattgatctgaagtattggcaaacagaagacctccaattttcccaatatttttcctaaggctttcctgtgcttctccccaacactgattggctagcattgatagcttattcactgtcggtatggaccctttaatattatgtgttttatttaaagacattagtccagggtgaccataggaaatacttcaaggaggataaccctgaagatcctatagctgctaatactcaaaatgaaacttaaaaaaaataatgatttttgccatggatcagagccaattcaattctagcttgagaagtgaattcaggtcatatctgaaagccttacctttgttagaaattaggtccaaagacctaagtgataattcaagttatgggctttgtgggagatggcaaatccagcctaaggaaaggagttctggaattttacaatttcacattaaattacacgtcagtatgtggcattaggggaatggtagaaattctcagtgctaagaattgagtggcccctttaaccagctaccttgacccccaaagccaagatttgtaatggaaaaatattgtatgggcagggtgctgtggcttacgccacagcactttggaaggctgaggctggcggatcactcgaggtcaggagtttgagaccagcctggccaacatggcgaaaccccatctctactaaaaatacaaaaattagccgggatggtgacacacacttgtagccccagctactcgggagactgaggcaggagaatcgcttgaatccaggaggcaaaggttgcagtgagccgagatcacaccactgtactccagcctgggtgacagagcaagactctgtctagaaaaaaagaaaaagaaaaatatcatatgactaatagtctgcctcatatacctaatcttttcccagtttaaaacatctttctttaatatacccgttttctcagttttaaagtttctcagttcaaaattggcaaagatttcagagttgaagcccttgctttctctactaccattccttttcctctactcctagcagatttctcccaaatctgttttcagtattggtagccagagttcctttttttcttcctttttaagaagaaaatagaaccaggcatggttgcatgtacctataggcccagctactctgtaggatgaggtgggaggattgcttgagccccggagtttgagtccagccagaggaccttatctctaaaggaaaacaaaacaaaaaaaaaaaaaatgaagaaactttctcctcacagggaagaagtaagcccaaagtcaattctaagatgccttttgttttcagcattagggcttgtgggtcttttcagcccttcagtgttgtgaaagagaataaacagatcagcagaattagtagagaataacagaggcaatttattgagacataaccatatacaagttgagtgtcctttatctgaaatgcttggaatcagaagtgtttgggttttagatatttttggattttggaatatttgtgttacagctgttggttgagcatccctgatgtgaaaatctgaaatctgaaatgctccaaggaatgtttcctttgagcttcatacgggcactcaaaaagttttggattttagagcattttttttttttccagatttttggattagggaagctcaacttgtagttaaataaaatatgtaggctactaatagctaaatataagaaaaacaattgtagtaaataatgacaatcccaacaggttttaaggcctccaagatggtaggctagtgattaattttagagtgaagttgaagagatctaaattaatgtttaaatggctaaacaacttatcttcctagtgtcgtgagtatgttttgatagcacgtgagtataatttgaagggagtgaagttttaagaatatacttatgtgactagtgaattactgaaattttttcctactgaatatataattgctgtgtttctgaatttaattttcattgacctttgcatcaagagtatatgcaaaggtcagtgaaaagtattgcatcagattcatttagtatgctttaaagtaaacattaagaagaataaatattatgtaaagctttcctgaatgactataacttcaaaagtaacttaaaatggttttattatggcctagaacaaagtaaaatgatagtggaaacatcaattcaaggatagttcttcccgagttaggattacctaaatttatccaaaacatggccttcttcctgtccctagaatattcacattgttgttgtgacacaggaatttcggagagatgaaaaaaatcccttgatttcctatccttacacccacatggctgcataagtgacttaatgtttgattaggaaatattttgtttggtgtaagggtagcaacttgaaatatcttgataaattttctgcagcttctagtctccagacaaatttaggcataagatatactttctgtttaggaatgtcagtccttctctcaacctttaggagaattgtcattactgtctttttttttttggtaggtaaacagtaatttataccttgtccactttgcctgtatgttaatgtgaccttggtttaccaggactttcaagcatgacttttgttaaagtttaaaacctagaaagtattatctctgttgagaaagttaacacactctatacctgtgtttaaattttaccagcatctttaaattaaagtttatatttgtgatctatgctaaatttccttctcgaggtagtatctacattttgtagtttttgcaaggaataaatttaatttgacctttctccccctttttttagaagagagtcttgctttgttgtcccccaggctggatcatagctctttggagcctcgatctcctgggctcaagcaatcctcctgcctcagcctcctgagtagctaagactataggcacatgccaccacacccagctaaatttttaatttttttgtagagacgaggccttgcactgttagctgggctggtctccaactcctgggctcaagtgaacctcctgcctcagctcccaaagtgctgggattacaagtgtaagctactacgctcgaccactaatttgcttttaaggcagatttgcctgtactaagggatcaaagtttagaaaaataacttcctgtgactgccatttctgaggacctgcattgccctgtaacttgtaaaaggatattttgaagttagtagaatgtcacctactacctgggtgcaaggctgtatgctgtccaagtagtcagaaagtgagctggggttacttctatctaaagtggtcctataaacagtccctactgcaaaggtgtagcctcatactgaaaataccaatttggcctttttatatatgcttacttcagtataacttctttctacctctagaaagaagtcatacctgctgtttgacttggccagtgcaccactatcccactttagataaaaattgggttgtacatatgtgactgatttgcccaaagagtgatattttatttgtaaccaatcattctggtagaaaaagccagggaaggccggggcgtggtggtgcacgcctgtaatcccagcactttgggaggccaaggcgggcagatcaccttaggtcaggagttcgagaccagcctggccaacatggagaaaccccatctttactaaaaatacaaaaattaggtgggtggtggcacgcgcctgcaatctcagctactcgggggctgaggcaggagaatcatttgaacctgggaggcagaggttgcagtgagccgagatcgcgccactgcactccagcctgggtgacagagcaagactccgtctcaaaagaaaaaagaagccagggaagatctattatttttcttttcttaaaatagactttttaaaaagagcagttttaggtacaccataaaattgagcagaaagtacagtcagacagtgtccacttacctcctcccctcccacccctccatgcaaaacctccactatcctcattggaaactacagggtacatttgtttcaatctgtgaacctccattaacatattttgtgcttctagtctctagaaaaatgtaggcataagatatactttctatttctttctatttaggaatgtcagcccttctttcaaccttgtagcaggagaattgtcattactttttttttttttggtaggtaaacagtgatttataagttgtccactttgcctgtatgttaatgtgagcttggtttacattagggttcatagtttacattagggttcacacttggtgttatacattctctaggctttgacaaatgtgtaatgacatgtatctgtcattgtagtattactgaaaatagtttgactgccctaaaaatcttgtgtgccctgccagtttatccctcctccttgactatcctgtcagtcactgatcttactacagttaccgtagttttgccttttccagaatgtgatatgtggccatacagtatgcagccttttcagattggcttctttcacttagtaatcaggtgcttttaaggttcctccatgtcttttcacagcttgatagctcaattctttttagcattgaataatgttctattgtctgaatataccaaagtttatccattcaccgattgaaggacatcttggttgcttccaagttttggcacttatgatacagttgctgtaaacagctgtgtgcaggttcttgtgtggacataagttttcaattcatttgagtaacaaccaagaagtccaatatgtttagttttgtaagaaactgccaaactgtttttcaaagtggctataccattttgcattccaaccagcaatgaaatgagagttggctcttgctgcacatccttgctaacatttgatgttgtcagtgttttagatgtggccgttctaatagatgtatattggtatctcgttgttttaacatatacttccctaatggcatatgctgatcttttcatatgcttaatttgtaatctgtatatcttctttggtgaggtgtctgtttagctatttccccatttttaaggcaggctgttcattttcttattgttcagtgttgagttctttgtacatattggattacagtcctttatcagatgtgtcttttgcacatattctcccagtctgtggcttgtgttcttatttgtttgacattgtcttttgcagagaagttttaagtttaatgaagtgcagcttataaattatttttttcaaggaccgtgctttgctcctgtatctaaaaagtcattgtcatgcacaaggtcatttagattttctcctatgttatcttttaggagttttatagttttgtatcttgtattttgttctgtgattcattttatgttaatttttgtgaagggtgtaaggtcagggtctagattcattgttttttgcgtgtggatgtctacttgttcaaacaccatttgttggaaagactgtcttttctccattgtattgtttttgctcctctgtcatagatcagttgactttatttatgtgggtctatttctggactctgttgtttcattgatctgtttgtcccttcttttgacagtaccacacagtcttgattactgtagttttatagtaagttttgaagtcagttagtgtcagtcctatgactttgttctccttcagtactgagttggctaatagtttttttgcctctccatatacacttcaaattgaggttgttgttatacaaaaaataatgttaggattttgattgtgattgcattgaatatatagatcaagttaggagaactgacatcttgacaatagtgagtcttctatctgtgaacatgaaatacctctccacttcttgagaggttctttgatacaaaattaactacaaaagtcagtatcatctctatataccaataacagttaagctgaaaaccaaatgtagaatacaaccccatttacaatagccacacaaaaaaattgaatacctaggaatacacctaaccaaggtgtgaaagatctctacgaggaaaactataaaacactgctgaaagaaatcataaatgacaagcaaatggaaaaacattccatgctcatggatgggaagactcaatatcattaaaatggccattctgcccaaagcattctatagatttaacactgttcttatcaaactaccaatgtcatttttcacagaagtagaaaaaactattctaaaatgtatatgtaaccaaaaagcctgaatagtcaaggcattcttaagcaaaaagaacaaagccagagacatcacattacctaatgtcgaattatactacaaggctacagtaaccaaaccagtatggtactgttataaaaatagacacgcagaccaatggaataagttagggaacccaggaataaagcagcacaggcacaaccaactcaccaactcatgttcaacaaagtcgacaaaaataaacaatcgagaaaggatactctattcaataaatgatgctgggaaaactggctgaccatattcagaagtgtaaaattagacctctcaccatatataaaaattaactcaatggattaaagacttaaatgtaagacctgaaactataaaaattctagaggcaaacctaggaaatactcttctagacattgacttaggcaaagaatttatgatgaagaccctaaaagcaaatagaacaaaatcaaaaatagaaaaatgggacttaattaaacgaaagagcttctgcacagcaaaataaactatcaacagagctaacagacaacccacagaatgggagaaaatatttgcaaagtatgcacctgacaaaggactaatatccagaatttataaggacttaaatgaatcaacaaggaaaaaaaccaattccattgaaaagtgggcaaaggccatgaacagacacttctcaaaagacaacatacaagcagccaataaacatgaaaaaatgctcaacatcactaatcgtcagagagatgcaaatcaaaatcacaatcagataccatctcacagcagtcaaaatggttatttctaaaaagtcaaaaagtaacagatattggcaaggttctagagaaaagggaacatttatacactgttggtggaaatgcaaattagttcatctcctgtggaaagcagttcagagatttctcaaaaaactaaaaatagaaccgtgattctacccagcaatcccattactgggtatattatccaaaggaaaatgctggacatagtggctcacacctgtaatcccagcattttgggaggctgaggcgggaggatcacttgatcctaggagtttgagaccagcttgagcaacacagcaagcctccatctctacaagtaagttacccaggtgtggtggtgtgcacctgtagtcccagctactcaggaggctgagacaggaggattgcttgagcctggcaggtcagggctgcggtgagtcatgattgtgtcacagcactccaggctgagtggtgaaatgagaccctgtttcaaaaataaataataaatcatttcaccaaaaagacacatgtatgttcatagcagcactattcagaacagcaaagacatggaatctacctatgtgcccatcatcagtggattggataaagaaaatgtggtatatgtacactgtggaatactacacagccataataaagaatgaaatcattatgcaaaggtgcagcaacatggatgcagctggaagctgctaccctaagcaaactaatgcagaaacagaaaaacgagtaccatatgttctcatttataagtgggagctaaatcttgggttcacatggagaataagttgggaacaataaacactggggactccaaaaggagagagagagagggtagggggacaagggctgaaaaacttcctattggatactatgttcactctctgggtgatgggatcagtagaaggccaaacttcggcaccatgcagtatacccttgtaacaaaccctcacatgtacccttgaatgtgaaataaaaatgaaaaaaaaaaagttttatgtgttatttcattatagttttgtagttttcttcataaagatgtacacattttgttatatttatacctaagtatttcatctggagggagtactaatgtacatagtgattttttaacttcaaattccacttgttcattgctgatatatatgaaatcagttgacttgtgtattaaccttgtatcctgcaaccttgctataattgcttattagttccaggaatgattttgttaattattttggattttctatgtggatgcaaacaaagagttttatttcttccttcgcaatctgtgtatcttttatttctttttctcatcttacttcattagctaggacttctagtacaatgttgtgagtggcaagaggggatatccttgccttgttccttatcttagtgtgaagactttctgtttctcatcattaaatgtgttgttagctgtaggttttttgtagatgatctttataaagtgaagaaagttcccttctattcttactttgctgagagtttttatcatgagtgggtgctggattttgttaaatgctttttctgcatctattaatataggatcatgtgtgagggcccctctatggctggctccccctggagtttttaactctcaggctcgtccacgctaagcatccattagagtttagtttcctatggaggttcctgctagaaggtttctgctttagtaagtcgatgttctttatttacctctctctctctctccaattttaggggtcggcgctttgcctgatgaccctacctctctgacagatctgagaagagtttactcttcagcttttaagtgaataaagatgataaatgtcctagcagctcatttgtctaacttcttgaaaaccaaagatgctggtggataattgacagacctacaaaataccacataaaacctacaatacacaaaataggttcttataactcaagtaaatggttctttagtatagtagctgttttatgaatggatgtatattatccaaatgctaattttgttaaaaggaatgaaaatttttttcatgttataggagaatattaaacgtaaagaccatattgattatcagaaggataaagttgctttaactctggctcgtctagcccgccatgttgaagtggagaaacagcagaaagaagagaagaatagagcattcagagtatgtgctattttaattggtattttatataattaaaaaattatttataataaagttggtaaaaagcctttaatcaaaaaaagatatgatttaatcaaagctcagtatgtaccctagatagctcatgaatttagtagtaattcataatagctttttacatctatttttagtttgttggattcttatctgtatataggaaaagaaaaaataaaattaactgagtggacttcatttttgagaattaaaaatcatggatttctcaaaacagatgagcaattaacaagtttctggttattttatcatacgagtgaaaagagtttatcagggcttttatagatataagctgttgaaagattattttctactggatagaaccagattgctttctcaaattttagcttatccttccaaattaaatccattactaaaaggaagaaatttgaagcaggtttgtagatgagctgctgtgtggaaatgaagcccatttttagaatcttgcatgatataatttttttccttgacttgctttagaaggccccaaatgaaattacttaaagaattccctcaatagtgacaaatgtcctttaggagcagaatgttgatatattgggtaaaaaactccatactaaagtacaaaaatggaaatttaaatcatgcctctggccagcagctgtttagatttcagtagatcactagttttatagactttgggtttcattctgtgaatggacaatttagagattctcccaggtcagaataagctccatgattttgtaattttaacgtgcatgtttttgactccttattccattggttattataaagtaatttgtgtatttctgtagcatcctaatctgttataaaatggtctttaaatttagaaataagctagtttgggggcttttactttatgatgtaatatcaattaaattagactatggtattctaattgtatgttttaaatgcttattgcatatatacacacacacatacacatatgcaaacacagacaatattatttttatcctggcagaaacactattcaattttaaggaagttccccacccccctagaactataagtatgttgtttgatttttttatgtgtcaaatctctttgacagagggatcatttgcaaactgtcttactttccctcagatttcctaagtgatgctagcttcttttcccaggcagtcttaatggctacatagataataaagtttttgtgatgagcccagaatcttgtatagttactgtgacaactaagttttttctcaagggtagtttcagcctccacccatgtaaatggtcattcattttattaaatactttacattgaagattttttttgaaattttgaaatttttaattttttgtttaaccagttggaaagaataaatttgtctagatttcattcttctttaaggaagaaaatgactcacatagcaagctcattgcttgctatccagccataattttgtttttcttactttgattccctttatggattacttattttttaaaagtagatgacaaaacaacaacaacaacaaaaaaccacccagaaaggaagatattgaaactgaaatagaaataatttttgaagaattctagtgaatgataattctggttaaaaatagacactatagaaaatgtctttcaactattgtaggcctttgtgaattgttggtgtcttcactattaaagtaagttatcttacttttgtgctggagaggtttcaaagaaaaaaaaaggaatattcattaaaatcttcactggagccagacctggtggctcatgcctgtaatcccagcactttgggaggacaaggtggacagatcacctgaggtcagtggtttgagacaagcttggccaacatggtgaaaccccgtctgtactaaaaagtttttgaaagttgctttgtgatagagaaaaagggtggctaattttaggatgatttcaataagtgttttttgagcattgactatgcatgttcatagagttcaaattctattataagaaatgccagagaacttgaaaaaaagatgtttaattttaattattggaaattgttaaaataagtatgctagtagttggtatgtagtaatatttaatctcaattatattactttaattgaagggtttttattgtaattgattcttgcaaggaactttgataaatggtctaatttaatatataagatgtcttaggatatatctatcaagggctattgctttctttggataggctaactttgattttactattgtttgtttcttattgcatgttattcagtatagtgatcctgtaggatacactttgaaaaagtatttggtgatttatgaagttgggatactgcatactctatgtatgaaaaataggggtgcacattagcactttagggctttagtagtcctacatgaaagtaacgttttaaattttgtgttaaaaccagtgtttctatacttaatttgattacagagaattttaaaaaatgtatataatgcatattaacattcatgagaagtagtattctatggctgtaatttgaacaatgttatgtagattttcttcagattaaaatcttgatccactttttcgcctcatttatccttcctgatagaaaaccctgttacattgataactaggccatacattattatggtttatatcttacaaatccagtgtttctgactctgatcccttttgaagtacatgtaaatctttttgagaggcagtatgattatactcgttagggcatgaattctagaatcagattgccagagtttgaattctgacattattatatatccttgggcaatttatttgacctctgtgtacctcaggtttttcatcataaaaggggaacaataatacctaaaatctaaagtctttttaaaactgcctcacacatggttagtggccaaaaagtattaattttaatacacatgattggaaaatacacaaatagttttatggataatataactagaaagatttaggcttttagcaatacagagcatctagttcagcattgtcattggcctgctgcctgctataaacaaagatttattggaacactgctacactcacttgtttacatattgtctgtggctgctctcctgctacaatggcacagttgagtagtggcagtaaagagtctatggcctgcaaagccataatgaaatattaactagcctttgtggaaaagtttgttaccccttggtctagatggcaacaaatgctttacactggcacatattaagtgctaatgagttatgttattaatattactcagtgaacaaatacttactaggctccttctgtatgtttcagattaaatatggaaaatttgaaacaatacataaaactttaaaaatgaaaataatcctttacatagaaattcctagaggtagccttaataacttttaatacatctattttcaggcttttttttcctctgcagatacagttgcacatggatttgaaattattctttgtttatattttgcctcatttgtttaatacagtttggcgacctacttgatatccaaagtatatttccacacctttgaaaaatttggttaatgtttttaatgacgtccatcaaatgtacataccataatttacttaaaccataccctgttgttaggggtgtaggttgtagtaaattttgtgcaataacactggtatacacatcttagagcgtgcatttttattttgatgtatttctttgtcatacatttctagatgtggagttctggggataaaaagtaatcagtattttctgatcactaatgtgtcaaaatccttttctcaaggaaaacagggtagtaatcttaattgagttttttcttaatgtcttcaggaaaaaattgattttcagcatgctcatgggttacaagaattggaatttattcgaggacattctgatacagaagcagcaagactgtgtgtggaccagtggctaaaaatgccaggtattctttagaaattacactaaggttacctagcttccccaaagccttaaggcagaaagtacgtctgttttatgctattgctaataagcatataagatattaaattttgtttcagtgatactaatatcacctcataatggcctactttataatggcctgctttgcccattgtctttcttctttggcacaagtatatttgagtataagcaatataggtcgtacctgagctcattagatattactcatttattcatttatatatttaatagttattgcatgaagtagcacatatgtccatgggaggtgtgtaacagattatttgaggtcagaaaaagcttctctaaggaaatggaatttaaactgagatctagaggattcatgtttatttatttattcatcagtgcagcctatgtagatatttaataaggaagcatcctcatagacttgtcaaaacattgggtagcttcttcgttactaactctttgcagatctgagattccttgaagagttgctgtggaacatgtcttactccaccggataatttggtggaatttttaagagccagtaggagagtcccaccatgacaactttcctgtcttgtcttgaagaatatctactgagcctttaaagagttaggatatccacagaaactgtagctgtggatttaatccaacaaagtttaattacaaaagttcatggaaatatctatgcatgcaatgcttaactttgttgaacctaggtatcttggattctaaagttagttttcaagggctttgctttgaatggaatcaaattgccacttataaaagaattctaataatttacatgtattggtatttagcagttcattccatttgatacctgacataatcgatgttttagacacttggcaccccctgaaactatattttctccttatcaacctgcctgtgcctcgcaaactcccctcctgcccccaaaaaccttttttctttgttttcttcttacttgcctgtggggtttatacgtggccaacaaataatacagtattagggattgctgagtgaatatggttattgtatatcatgtccaattatgtgagaagcttatctagatttattctatataagtttggttgctcagccatctgtgatctcaatactttattcatttcactaatacagtatttattatgttcgattgatccgtttatatgtctgtctcttccacccagctatgtgcttcttgggcacaaagaccaaatcttactaatactttttagcgtcagttccttaaaagaatgctcaacatagagatactcaataaatgttggttgaatttttatagaggtaggctataaatatttgcataatgaacacagaaaggaagcctagaacttgggctccaaatctgactgttattaaacaaaaaaattatatggcactccagatctactttggcaaaagacacatagaaaatatggtaaatggttttgcctcttggggtgttttttgaaagcttttagttttaaaaatccctcttcatgtacattcttctcagtggaagaagttaatgactagctcagtggtgtcatctttgctgcgtcagaatattctgggaccttttaaacagatgcctacaccttattatctccagagattcttctagggcatctgtacttttgggaaagatccctaggtggataggaaaatggactagaactagaagactttatcatctctagatctcttctaaaaattatctcatgagtctgacactttcaagtcctatacagaatggtagtcgggccagtaatatgcccttcaagcttaatatctggcctccaggttgtcagaatattataatgcattgtaaaatgaatcttgagcatctgtttatgtatttccctgagcaggtcaagtgggatcaaatgagttatttagctgtgtctttatggtactttcaagattagtgttttctctgcctttcagtactggctttttgatggctgataagcttaagcctggagttaaggtctgtagttatgatcttttttgtgtgatgggctcagctttttgcttggtctctgaggcaatgtaaaaataaagtttggaatctattgcttgaacagctgtgtagtattgggctatatttggtatggtgctattccataaatgggctttagagagtgctgagatcctttaagagcatatagctggggaatagagaggaatcacagttctctttaattatagagagtgagattctacttctcagtagcattaaaggactcattcaatctatttcaaaatacagtactcagctgttataattcagttctttcattagaagtattttaagtaccttatttataattattctaatgttggacaatccattctttatgggtttttagagttggccagtttgcataaatttgaatacttagtattataatttttaaaaatgctgtctgtattatttaagacaaaagctgtttaaatctctgtattttgcctttccatggggaagcctccccacccctccacccagaaattggcttctccaactttatttttatccagagccactatttatagctaaataaaggtcctaataggaaacatctggaatgtgggtggacaattataacagttttcataattcttactacattaagaatgttaaagtatattgccattttaatgccttgttaagactaaaatatgattaattccatgctgtccattatttgttgtcagaacatatttataaacattttgacagtttgatagaggtattcccccaataaagactaaaagagaggaaaagcaattaaaaccttaatcatatataaccattttgggatttaaaaatcatattgtcttaagggaataattctatttaaatgcttaggggctttgtagaaaattcaataaagataaatatttagctttttgttgtatgaaatattcaaagcatttgagtgaaattagtccacaagagatagtaataaaacagagagtaatcaaactgtctgtgaatcagaatacttgtggttgttttgcaattgttttttatacaacttaactgtttaaatttttcttcatatatcatgcgttgggagttgccccgaggacatttggctgggggattcatctacaagttgtgtgaccttaagatcaaaattataaagaaagaaagggatgaagaatggaccaggataaaggaggattaattaagagaaaaaaattgtggacaaactgtttcctaattggctttttaaagggaaaaagagaagggacaaaataggataagtagaaaggggagaggtatcaacaataagtaaatctctgctttgtgttctataaatgtgttatcccttacacttgtattacttgatgtgtctagactggaactgattgatcagtggcttgattcctcagaaaataacacacttatcctccttgcttccctgctttcttcattccatcctctctaccccagttacattgtgtaatataattttcatagagctcagaccctctataatatagctaaatttataacacagttgaaatagttaaaagagaaaataagaattagaggaaaagatctggctgggcacagtgtctcatgcctgtaatcccagcactttgggaggccaaggtgggaggatcacttcaggccaggagtttgagaccagcctgggcaacattgagagaccctgtctctacaaaaaataaaaatattagctgggcatggtggcatgtgcctataggcccacctgctcaaaatgaagggagtaggggcgtaaccttctaatgcatttggtctttaacattttttagctgttgagcttaaagaaaaggattttttttccctaaagggaaaaaagctacttggagctgggcatggtggcgtgctcctgtagtttgagcgacagcaggagaattgattgagcctgggaaatacagcaagatgcccatctcaaaaaaaaaagagaatgctacttggtgatattaagggcttttttttggtcataacttatttacttttaggttattatatcttttataagagaggttttaaacaattataattagcatcatccagttgatgctatgtcataattttcattgttttgtcctaattttgatcactagcccaaaggataagtatctgaaataataacctaagaattcatattctgatgatgcaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggtaagtaggatattcataatagtgaatgctgaagatctagtgagctaccaagtgatttcataaaatgaaagcgtaatgctcctttgccattatgattatatagctttatattccaaactcaaattattttgtgccattatgatataattttttcataattgatgaagtcagatttttctagtgggtgtagctttcagctttatgggtatagcttttaaatatttatttttccctgatacagcttataaagttctaaacagactttctccatcaaaatccagataggttagttttagagaaatccagcccataaatgtaaatttcaagagacaaggagcgtgtacagacatttggtctagcctgaagaaaggtaataggcattacaaaataaatgttaaaagcaaactgatgtaagcaaaattaataataaaaattctatttattgaaacccattttatcaatttactgagtttggtggtttttgtttgtttgtttgtttgtttgtttttttgagacaggatctcactctgtcgcccaggatggagtgcagtgcagcttccacctcctgggctcaagggatcctcccatcctcccatctcagcctcctgagtgtctgggactacaggttgtgcgccaccacacccagctaatttttgtattttttgcagagacgtggctctgccatgttgcccaagctggtcttgaactcctgagctcaagcattctgcccacctcagcctaccaaagtgctgggattacaggcgtgagccaccgcgctcggccagtttactgaatttttgaatagtggagcttgagaaaggtatcaagggaaggttgtattaaacattcgactccccatagcctccctttctaatagctgaagaatgggaaattgagagtttggggctctaagccattgtcttttccatatgtctcaccctacttatgccttaccttatcaagagaagcttctagagggagttgtagcattctataaaaaaccaggtaaagtcaaagctggacctggggtcggggagggaacaaaatttgatagcatactataccttagctaaagtgctccaggcagtttaaaataatgcagatttattaaatggtaaaaatgaacattaaaagccattatgggaaacaagtgtactagaaatcttagcatgagattattattgcagtgatgtatttaaagttagttgtgagtcttatggtaaccaaggcaagaagtaaaagatgctggacttacaattttcaaacgagaagtttaccagtttggtaagaaatgtctaaatctattttaccggatatttagtacatatgaaatcttgcactaactgttggtcactatctgagggaattgctgagcatatgggaaccacttgatatttactgtatatgaagaacattacttaatatttcagtagaaaagtgcaaagttctgaatgtgtgtgtatgtgtttagcttcacaaatgaagcgacatagttgtttccctagaatgtagatttatctaatattacctcttacctcttttgctgagtaggttcgatcactctccatgtgatccaacaattacactacatggacctttcttcagctcctttgcttgtgtagtatgttataaaaaatttgttactcaacaacaatatagagatcacctttttgataaggtaagagcatgtcctaaattaaaagtattatttttctagatagccatggagttaagtggaggttttttcctgctgttcttaagcttgcaattaccagtgatacacataagtatcaaaactgtaattgtcaattgaaaataaaatgatttgggccatttagttattataggcaggtaaacttgataccttacagtcagcagtcctagagattatcatcaaaatcctttcatggagttgctctatgaaattaaattaccttgttcaagatgctctgagtgagtcacttgatgagaaccagaaccctgttcttaagtccactgtcttacactgcttgttgaaatgttggcgccatatagtaaatgacaagttattaatgctagtttttgaggaatataactagtatttaaaaagctatgtcatataattctaagtaagtgttaaatcttaagagacatgagttgattcatggatatgcacatccatgtaatacagaactctaatgggtttttaccatatttgatagtagataactttaatgacttactaacattgcagaagtaatgtatgttcattatgaaaaatttttaaaatattaacaaaaagacaagaagtcatccttaatctcacagagataaggactgggattaagattttgatatatgtgtttttagtattactccatatatagataaatgtttttacataagataagatatctaaattgttctgtgatttaaagcagtgtgttgcaaacataaaagcttaaatattcatcgaatcaatgcatacatttctacattttaaatcattgaattgttttcttctgtatgaatatagtattaatttaataaatttcccattggatgtattgtttgttttctattattaaaaactatgccatattaaatattctgttaactaaaaacctttgagaatatccatatttggatatttgagtaaatatcaaattggatttaccgaataaatattagattttgaaatagtaaaacatttatttagttaatgttttcagaatttgcttctatctagagctatacctggaaagtaacatggagaatagcttggattctgtgtaggttcacagcagagaattaaagcttgcattctaagtatatctaattgaattctgcagtcctccccatctctgtcctggcactagagaacattcccagaacagatgtgcatcttgaagcagattttattttacactgactcattagtttttggagagcctgcgtcttgttcaacattgactaggcactgtagtagggtagtcttggggattcctaacaaaaataaatagtaacatgatcataaagacacaggattttaagcttgatattggcaagaagaaactattatagaacagtgacatgatgaaaataacacattattcttttaaagttagaaggacttctaattctatagcccaattccttccttttttttagagaccctgaagagactgagtggcattagaatggcagtattgttcagaatggattcaaagatgtggacaaagagaccagtttagatgacttttacagtaatttagctctgagatgagagaattgtttgacttaggtaatggcattcagaatgaagaccttaaagtgaaaccaaaagacatattgaagaaagaaatgatagggttatccatttccatgacaaatggaagatttggggaaggaagggaaaaagggtgaaagagaactgcattccgtactttagggtttgcagtaggttactgatgttctgcattttccagaattagagttctttcaggacatgtttccctattcatatactgagtgttttctctactataatgagtatatatgtctgttttctttagtaaatttgagtaggtagtttaaaatgaattttttcacttatttttttccccaaatttcattaatttgttttttcttttttctcggaatcacacattccatgctgttttgcactcctttttgccgtctctctaggaagtagatttatgaccttcagcgttctgaaaagcagtatggtaacatagaaagggcaaaggctttggtatcagacagacctgggttccactgttactattatttgcttcatattcttaacaggttactgaatctgtgagtttagtttcttcatccctaaaatggtatcgttatgcttatgtacgagattgttaagagaaaatgtaatactctatttcaggcctgacctgtaaccttcaatgattgcttattccttgacatttgtgtcaccacaaggactctaaagaaaactagtatgcatggggggttgtaattgcctcttttaaatcaacaagaagaggtcactagaagattgtataagcctcgctgttttttataggtatgaattctgttttgtaaagaggcagtccccaatggaaaaaagtcaaattattcacaatttgcattgttttccttgctcccctcccccattttctttcatcttcaatttcttcactctagactaggccttctcaaacttaaatgtacacacatatcacttggaaattttgttaaaatgcagattctgactcaagatgtctcaggtggagccttagattcatatttctaacaagcttttaggtgatgccattgctgtcgttccttgagtcatactttgagtagcaagtttctagtggcttttgacacctaaacccatccaatggctattacatcaccagatagcaccctgcttttctccctgttgtgtgatagtggtggtcgatatactgtgagctcctttgtacctcagtgtcatttgtgagtctgttgaagctaccactggttattctgtttctagggctactgtatcatctaaggtgacttttctccttgcctaacccatcttcctcatccctaggcaaccactaagctactttgtgtctccatggatttatctattgtggatattttatataaaaggaatcacacaatatacagcctttgtgactagattgtttcacttcccataatgtgtttcaaggcttattcatatggtagcatgtatcagtacttcatttcttttcattgccaaataatatttcattgtaaggacatatgccgcattgtatttaacagttcatcagttgatggacatttgggttgtttctactttttggctgttacgaacaatgcttctataaaccaacatctaagttttgtgtaaaaatacgttttaattcctctaacgagttaaattgctaggtcatatggtacctttttaatttttttgaagaagtgccaaactgctgtctagtgcactgcaccattttactttcccgccagcaatgtttgtgggtttcagtttttagccagtctagtgggtgtgaaatggtattttggttctgccttttttttttttttaagacggagcctcgctgtcttgtgcaggctggagtgcagtggtgcagtttcggctcactgcaacctctgcctcccgggttcaaacgattcttctgcctcagcctcctgggtagctgggattacaggcgcctgccaccacacccggctaattttttgtatttttagtagagacggcgtttcaccacgttggccaggctggtctcgagctcctgaccttgtgatctgtccgcttcagcctcccaaagtgctgggattacaggcatgagccatcatgcccagccctactttttttattgtacaaatttgtatggtgtcttttaatgtaaccagaaatatggtaaaaaggaattgagcactttaacttatcagatatcttatttcccattccttttcccagtttgtagaatgtatttgcagctatgccatatatatatatatatatatatatatatatatatatatgtgtgtgtgtgtgtgtgtgtgtgtgtgtgtgtgtatatatatatataaaattttttttttttttttgagagagaggtggtctcaaattcctgggcaaagcagtcctcccacctcagcctccttaagtgctgggattacaggtgtgagccactgctcctggccaagtatgccatatttttgtaataagtatattctaataaaattttatgtagaatcacattttggttctgttgagcaaatcatttaaacaactttatgtgagttcatttataactcacaattaaactaaaaatgatttaatgagtttagggttcttcaagtaggagaaatatgtataaattggtggttactaaatgcctttattgctcttatcatttagaatcttcaaattggaatgaaaatgtcctcctcggtgttatttcttctgtgtggcactcatcaaattaaaacaggaggggagtgtggtggggagggagtagtgaaagcagcatataattcataaccaagattggaaagctgggtttaaatggaagtttgtcttttctatggaggggtacaacttgggaggaggggtaagttggttgacttatcagaacttcaattttctcatttctaaacaatgaaaatggtacctcatgggattattatgaggattaagtaggtaaacatatttagaacctcagtgtggttcctgacatgtgctcggtataaataaaaattttttatctctcttctggttgcatctcataagcactacacaaactatactgatggttctagtgttaatgatagtaaatatgaggcacaatacaatgtttgaggctattactctaaagaccattaacaagaagttaaattatatttataacaagcacacacaaatatacatacacttataaatacacactttttaaaatttcctattttaaggtagaggaggctcttaacaaggtttagaaacttagatgctagaaaagacatacttatttgactgtgtcaaatttaaaaagtgaccataggccgagcacagtggcttatgcctgtaatctcagcactttgggaggccaaggcaagagaattgctagagtccaggagttagagacgagcttgggcaacatggaaagaccttgcctttacaaaaaataaaaaaattagccgggtgtattggtgtatgcctgtggtcccagctacttgggaggctgggataggaggattgcttgagcccaggatgtcaagggtactagtgggccagcctgggtgacagagtgagctcgtgtctcaaaaataaataaagaagactataaacaaaatagatatttgaaaaaatattgcaaaatggaaaatgaggcagagaattaatttcagtaacaaaggactgatacaaactgaccagaaggagaaaaaacaaaacaattgagaaataaagctaaataatatgaataaaaaattcacataagaacacatctgggtagccaaaaaatgtatgaataaatgctcaaactcacttatagataggaaatgcaaattaaagtagcaatgaaggccaggcacggtggctcatgcctgtaatcctagcactttggaaggccaaggcgggtggatcacttgaacccagaagttcgagaccagcctgggcaacgtggggaaaccctgtctctaccaaaaatacaaaaatttgcctgacaaaaatgaaaaaaatctgtaatatatattactgccaggctcattcagtactaggggatatgtgaattggtagagcctttttgaaaaccagtcatacagtgtcttttaatattcaaatatatatacccattagccctgtagggccactcttgagaataagaaaaaagcacctaccagtaaggatatatattcaaggatgtttacaagatcattatttctagtgggaaaaaaaaacccaaaacttaaaaaaagaaaaaaactgaaaataaatgttgactgagttgaatagattgacaccatggcgtagtttgcaaccattaagaagcattaattagagatataccagctgatttttagggatttcctttaggtactatggaatgagaaaactaataggcagaagagcctataaaataatatttgataaaacaatgacattcccccttatttctatgtgtctttgtaactgagtaagcatggataaatttgtggaagaataataatgcagggtagagtgaataaagcaaaacattaggaaaagtgtatgtggtgtgatcacatttatgcatttatatattacatgtgaatgtgtatgtaaaaatgaaaactatatagaaagcaaatgttcttctatatttgttactacaacagatggccataatttggttttgaggaaaaaaaactaaaaatttgacatttgggacctcggttatgataaaagttccataattcacactcagggaagaacatctttcatgttaaaaattgatacaggatattgcgaataaacaacaaataggaaattttgaaagtttttttcaagaacttgagtgtttattttagttttccataatacagctttgtcttatattttaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtggtatgttaatactctcttctgctgaaaattaaactacttgaatctttgctgatttatcatacttctcagatcattcttgagattacatatcctcatcttagttttagaactatgaaagtaaaagattatctcaattcctacttaaaaacaaagattcttaatatttatttgtacgtatgagtaaggcttactaactttgaagactgaagaaatcctgggaagcaaatatttattcaggataatgttatgttatatcatgatatcttggaagttttctgtttctcggcatttaagactcaaattttaatttgagtataagtaaggcattctttgtatttaaggctagaaagtggcttcccttagatttttattgccaaaataactgtcttcttttacttactccaactaatgttgagaagggctgaggggaggaaggttgggttactctgtactcaaataactttgcaaattatagtttattttgtctttcagataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcaggtttgtattggtctggagctgtaaaggaatacggatgagtgtttgccagtgagaagattcaacaaatacattttctttccatgtttctctccttttaaaatgagaatatacagttgcctggaaattagccaaatttaacatagtgagagaagttagagttgtggaaaacgtggatatattgatattctgcaagtgtaaagcaagctaacagttctaagttttgtgtatgttcttctgtgtgtgttctgtaagtatgagtaggagaggaaagggttaaagtagaaccttggctttaagtcaaccagaatggaaagtatcatatacatttgaaagattaaatctcaatgaaaggccaaatttatcaagtaaccaagaaagagtccagtatgatttgtgattgccatagtatctgtgagatttatctatattgtttagtacattgttccttcttattggtaagtagtattgtgtgaatatagcacaatttgttgatccattcccttgttgatagatagttgggttgtttacaatttatagcttttatgaataaagctgctttgaatactttgcacaggtcttttcatggtcatatgttttcatttctcttggatggacattgaaaagtggaattgttggttcagaagtaggtttatatttaactttatgagaacctactaaatatccaaagttggtcgtattagtttcattcctacaggtaaggtatgaaagttctagttactcttcacccttgctaacatttgatattgccactctttttcattttagctattcttgtgtctcattttagtttattatgtgcattttcttgataaacaatgatgttgggcactttcttgtgtttatgggctatttgtttatctttgtgaaatctctgttcaagtcttttgccagtcttcaaaattggattgtttgccttcttaatagtgagttggggttctttatatattctagatacaaatcttttgtcagattcgtatctagaatacaggaatttctagaatatacaaatatttatgagtatattttcctgtgattttgcatattcatatttttaattataccttttgatgaacagaagcttttctttgcattaggtgtataatttgttgattattttcttcttttatggttatgctttctgtgtcctgagaaacccttgcctcttcttgcttaaagaatgtattttatttccctaaattcagctttgatatttttaaatatttatgtttatttctataatctatttcaaatttttgttgatttttacaacaaccattgtctggtttccctggcaattctctgttgtttgcccattttctagttcattgatttctgctctttaaactttgagtttaatttgcttatctttgtctagctcttaaaggtagaagtttagattgactttggatctttgttttcaatataaacatttaaaaatataaatttcccactaagcactgctttacctgcatgccacagatgttgataagttgtgttttcatttttattcagttaaaaatacgtatctcttttttcctcatttaaccatagagttaccatatgatccagcaatttctgcttgttgacagccaagagcaaagtgaacttgctcttgttcacaaatacttgtatgtttgtttatagcagcattattcataatagtaaaaaaatgggaacatcccaaatgtctatcagctgacaaatggatttttttaactggacatatccatacaagggaatattatttggccatgaaaaggattgaaatcctgattacatgttacaacctcaatgaactttgaaaacattatgctaaatgaaataagctagtcacaaaaagtccatttatatgattccattcacatgaaattccagaatagggaaatctgtagacacagaaagtagttgcttagggttcagtggttgcttggagttggggagcatggcgaaaagggaggtggggaggtgatagctaaagggcatgggttttctttttgacataacacaatgttctaaaattaactattgatggttgcacatatctttatgtgaaaaatagttgaaattatataccctaaatggatgaattatatggtatatgaattatgaattatatcctttttttttttttttttttttttaaagatagggtctctgtctgtcacctaggctggagtgcaatggtgcaatctcggctcactgcaacctccacctcccaagttcaagtgattctcgtgcctcagcctcccaagtacctgggactataggtgtgtgccaccatacctggctgagttttgtattttttgtagagacggggtttcaccatgttggccaggatggtcttgaactcctgacctcaagtgatctgtccgcctcagcctcccaaagtgctgggattacaggcatgtgccaccgcgcctagccgtgaattatatctcaataaagctgtttaaaaatgttttggaaaaatgttatctttgcccttttgatttattgtttgacctataggtttattagaaatgtgttgcttggctgggcgtggtggctcacacctgtaatcctaacactttgggaggcttaggcaggtggattgcctgagctcaggagttcgagaccagcctggctaacatggcgaaaccccatctctactaaaaatacaaaaaattaaccgggtgtggtggtgagcgcctgtaatcccagctacttggtggctgaggcaagagaatcgcttgaacctgggaggcagaggttgcagtgatccaagattgtgccactgcactccagcctgggtgacagaaggattttctgtctccaaacacacaaaaaagatatgtgtggcttaacttctaaaggtttatagatgttacatttaggtatttaatttataaacatttagggatttgtattattttttgtttccaatttaattccacaataattagagaacatattttgtacagtttttttcttttgaaatatattaaatgtataaaatggtagcaggtctgttctctctggagtttagtagtgaagacacagttgttctatttttttattttcctagggaagttgatttattttgagttaatttgtggaatagtatgtggttttattgagcctagttcttcagtgcaaaagcaactaggggcatgacatttgtctgacataaaattaatcagttctttatttttatttcttatagattcagggggtacgagtgcagttttgttacatgggtatattgtgaagctcagatatctgggcttttaatgtcactatcatccaaatagtgaacattgtacccaataggttattttccaaccctcacccatttcccaacctcccaccttttggagttttcaatatctgtttattattccactctatatgtccacgtgtacccattgtttaactcccacttagaaatgaaaatttgcagtatttgacattctgagttatttcacttaggataatggcctccagttccatacatgttgcttcaaaaggcatgatttcattcttttttatgactcagtagtattccatggtatatataccatattttctttattcaataatccattgatggacacttaggttgattccattcattatcgctattgtcaatagtgctgcggtaaatgtacaagtgtaggtgtctttttgatataatgcttactttttcttaaggtagataccagtagtgggactgctggatcaaagggcggttctatttttagttttttaagaaagctccatattgttttccatagaggttgtactaatttacatttccatcaacagtgtataagtgttcccttttctctgtatccttgccaacatcagttgttttttgactttttaataacagccattttgactggtgtaagatggtatcgcattgttttaatttgaagttctctgatgattagtaatgttgagtatttatgggccagttgtatgtcttcttttgaaaaatgtctgttcatgtcctttgcccacttcttaatgggattatttgtggatttttttcttgttaagttcctagtagattctgaatattagtcctttgtcagatgcatagtttgcagatattttctcccattctgtaagttgtctgtttattctcttgattatttcttttgctatgcttaagcttttaagtcccatttgtctattttagggctttgttgcatttgcttttgaggacttagtcataaattttttgcctaggccattgtccggaaggggttttcctaggttttcttctagaatttttatagtttcaggtcttagcctttaatccatcttgagttattttttgtatatgatgaaagatatgggttcagttttattcttctgcatatggctgtcaagttttatcagcaccatttattaaatagggtgtcctttccccagtgtctatttttgtcaatttcatcaaagatcagtagtttgtaggtatgtggctttattgctgggttctctattctgttccattgatctgtgtgtctgtttttataccagtacatgttgttttggttaccatagccttatagtatcaacattaatcagttattaaagaataggaactgggttgtctagaatcttaaccatagtgttcttacatacagtttaattaccatggagagtctaataatttgcctgttcaataaggtcctctgtcagtgcttttgatacagattttagttttctaaaatttgcctgaatttaaaaaattttgaatctagttttagccttttgtattttaactagaaatagataaagtgcagataatactcaagtattttgagatgatagaacatcattatgtcatttgcatctttattgaaaagtatcttttagtgcttatttatacgttggttattttataattcctgcaataaaatgcagcaatggtatatttagaaaatacttctgaaagactttctatttctttttatctaatttagagttcattgtcgaaatgctggacctgtagctgtagctgagaagagcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatataggtatggctttatagctctatgcaaatttcatatactgatattgaaacttacaatgtacccacctcgattcaattttgaagcaagaaacagggtaacttcttgatggtatgttaattattatggtatatacattttaggggtttgtattcctactactacatttatccactttctaaacttacgaggacagagtatatgttggctttaaataatatatattttagatatcattttattttacaaaaggtgtggagattttgaagatgaaggaagttgatagtttttctgaaagttagatttcaaagttatcctagtattaatatcatttagatttttcttgtaatatttgggttaactaaaaagataaatcacgtgaattctttttgtttctatttggccatattctttagtgtgagacattttaaaggtcatttcagcatttgtatatttttgttatgattaacttggaagaaaagctttaacatacaattaaaatagcaattagaagtagagttaaagtggtagcaggaaaccagggggaaaattgaaatatgaattccttgtttgtacttactccagactttctttcttccatatgataggattaagtaagtctaggcaggtgttatgtttttattttgtttagaagtataatttgttttgtttagaagtataatttgtttttgtttagagtataattttaagtgtatcttcttttatttgtaaaatttttttgagatgggattttactatgttgcccaggctggttttgaactcctggccttaagcaatcctcctgttttagcctccccaagtgttgggattacaggtgtgagccaccacacctgacttaagtctatattcttttaaataaatactaattcttggtgagttatacaatgtagcatatttgggtacagtgagaatatgtgaaaattttggccagtaatgtatttttatgaactattgaatttttagagtcttgctctataccatatgtagatttcaacatcacctttagtcatggcatgttttcagtggtaaagaattaaatcatgagctacctagtcaactctaaacagtgaaacactggttacaccattttatgttaggcctttcttttgcgcttctgtttactttttttttggaatttgtgttagtctgtgtttgatagaaaatgcaatacctaaatctagaattaccgagaagttagagaaaagacgtaaggtggcttggaaatggaagggaatggcagtagtatatttgaaggaactattagaatagaaactattcattttttaaataatataacattttaaagtttgcattgttaccacaggaaactttaaggccttgtcaaagtggaaaagtatgaaacaagataaaggggagggagaatgagagttggggcatgggggaaggtgaaagaagaatctgagagaaccaagaagatgtgtttatagggggaggtgtctctgtaccactggcacatatttctagcactgctttatggcagcaggattctaggttatcttatttctgctctctagggtgtttaatcctagaactagagggctactaataaatcagtccagactgggaaaagaaccaaattctggtggtgaaaatgttcttaataggtaaccttggaattttatatgggtggtattagtttttgcttatttaaccttaaaacttggttttctagttcttctagtacattaattttttaaaaaaattccttgtataagtgactttttaacaagctttagagttgttggaagaaaatgtttgcaagaaggatatataaccaaaattggtgaaatgttcagattatttttatctgatttaagtgtaaatggtgtcatgtacagatttggatttcacaaaaaggtttagatagaaatgagtaacattcaaggttagtatttttgcatattaggcttctaatactttttggacttgaaatcagaatgattttagcaaattcttactgaactcatgttgatatttctctcttctcagaggaagaaattgttgagcttccagatttggattacctgcgaaccatgactcatatagtctttgtagattttgataactggtcaaacttttttggtcatctaccagggcatctaaaccaaggaacatttatttggggctttcaaggtacggttaataagaaaaacaaaagaaaactttttcccacctcttagaatatagttcagtttaaaaggctcctcttaaaccttcctggatagaacataggaacataattggaatattgttcttttgtattatagttactctgctagaatcgttttctttacatgcctctgtggtaaatgttagctctatctggtgactcaaagtttatggatcttttggccgggcgcggtggctcacgtctgtaatcccagaactttggaaggctgaggcggacggatcacgaggtcagaagatcgagaccatcctggctaacatggtgaaaccccgtctctactaaaaagaaaaaaaaaatacaaaaaattagctgggcgtggtggcgggcccctgtagtcccagctccttgggaggctgaggcaggagaatggtgtgaacccaggaggcgaagcttgcagtgagctgagatcgcaccactgctctccagcctgggcaacagagtgagactctgtcttaaaaaaaaaaaaaaaaaaaaaaaaaagtttatggatcttttgatacagattgaaaaagcctttattcaacacctaaaatgtgtcaggtgctttggctttgtactaacatggttactgattattatggttttatcccttttaaaatacaaagaagcagatgttttgtttttgtttttgttttttttccctcaaagttttaaaactaataaatagcagaattatttggcctctcagctataggactaatgttattttcaacatgccataactgcctcttcggttcatccttgctgttcttaagtgttcagcttcatctaaacctctttacaaattgttgaccaaacttgggggagaggcttctttggtttacagagaatctgctattgtttgtgtttgataggaaatagcatgtaaagagaaagattgggattaaagatagaaacatactgacctggataagttagccagtataattgctttagtaagttgagctttggtgattgcccatcatttctgcattgaacggtggtgacatctgtaaaaaccacttatgcttacacttatagaataatgccattcaaagaatttttacacacattgcttttgattttgcctaatatccatgtgagttttaagatgagttgacagattcagggaagttggtccactttctcaagactttaaagcaacaagatgttgatgcttatgctaggatggagttcttccacattctgatctagtactttgcctctagaaaaatttttttctagtatgtgttttttcttgataaaatttttggcctttcctctcctgtttgattatcatttttgccttttctaaaattaataggaggaaacaccaattggaagcctccgctcaactgtaagatttataactacctgaacaggattggatgcttcttccttcatcctcgctgtagtaaaagaaaagatgctgctgattttgccatatgtatgcatgtgagtcattgttttattcaaaatctaatgtgaatctcagacccacttgcatttttttccccacttgaattgtaatgagacttatagatcattcttcagtacttcaggttctacctatgactattatgaaggcaggaccccatagcatatttttattgctttatcctcaacttctagcaaaccttcagctatccatagtagaccctcaactatttgtgggataaatgatcaagagctgatactgttttttgggtttgtttttgagacagtctcgctctgtcacccaggctggagtgcagtggcgcagtctcggctcactgcaacctcagccccctgggctgaaatggttcttgtgcctcagcctcccaagtagctgggactacaggagcataccaccatgcccagctaatacttgtatttttagtagagacggggtttctccatgttagccaggctggtctcaaactcctggcctcaagtgatctgcccgcctaggcctcccaaagtgctgggattacaggtgtgagccactgcgccctgctgatgatactgtatttgatatatattaagacactttcatattttaatatctctaaaattaagaggtaccttaacaatcactgttggcctagacagaatttgcatttgcttctgtctctgctgggtacctagagaaactgccaaactgagacccactttaaattttctgcttggggacttacatgtcacactgataatgtgaatttactctgcaaacttgttgactgcagcttatggtttaaacaacaaaagatttctttttcagtctatctaatgccaagattgaatcatgcaaattgccttgcttaccttttctctatggcagatttatttcttatttacccttatattgagcgtatagccctttggcatttcaaccttatgtgaggtctgttggacttccattttggctttttcttttcatggcacattaaatagcttatataatttaatggcatcttatatttgattaaatgtggggtatttcatttatgaacgagttctttctttctctctttttttttttttcctttttgagacggagtgtcactctgtcgcccaggctggagtgcagtggcgcgatcttggctgcaacttctgcctcccgagttcaagtgattctccagcctcagcctggagaatcccgagtagttgggattacaagcgcatgccaccacacccagctaatttttgcattttttaatagagaccgcgtttcaccatgttggccgggctggtctcgaactcctgacctcaagcgatccacctgctttagcctcccaaagtgttgggattacaggcgtgagccactgcacccagctgaaggagatctttatgtcatactttggtagggactagggaacaagcttaatataccttcctaggcatgtgttcattctgaaatagatgtaacttgttttgaaactcatgctgattttttatcaacctgtgccatttgttctaacttaggctggccgtctagatgaacaactacccaagcaaattcctttcaccatcctctcaggagatcaaggttttctggagctagagaatcaatttaagaagactcagaggccagctcatatactaaaccctcaccacttagagggagatatgatgtgtgccttgttaaatagcatatctgataccaccaaaggtacgcagctgcagtcacagtgcaaaccacccaagaggaggagacttcactgctgagagaaaccaataaactgctgtccgctagtgaactgttgcctgcttgctaaaccatcatgttctcttacttctatcttacttatcttttttaaaaaaatctcactttcattctttagtgttttagaaggaggatgaattcataataattttctggagctttttttgatctagtagataaaatctatattgatgtatataaaacatatattcatgtgttacagtatgttactacaattttaaaagctcagaattcagatcttcactttgtttctgaaattccaagttgaccttcagttttttagaaagcagtgcgcttagaggtgaaaaccagaaagcaataacaaaggtgatcatttaagaggttgacagtgacaaaataaaacgctgataggcttttaggtccttagagaagtgggtacatcctatcttattgctgggacttgcactttcttctgtacctttgtgagattgttcaatgaaaggagtgctgatacccaatttcacttcctagtatataagaaaagatgtaattctaaggattcagaagttttgtttttcgtttttcataatttctgcagtcaaatgctctaccactgagttataaccccctttttcataatctctgaagtaaagaaatatggatagaataattaatgtttaaatatcctaataatttaaattcatgaataaggtttgaagatattaatgaattaccttaatgaaaaatagtggctttttggcatttttattgtgtgcctttaaagctttcaagtctgcttgcctcctagattttttttttctttcaatatatttggaagcacattttgattgaaaactcattctggagaattttgctgtaatcactgattacagtggatcaattcacttctgcaaagttaggaatcagtaatctgtgctctttatactctttaaagtggagtaatgatggaagattataaaagaaaatgaactcttgtgtctttatgtcatgccttagttctgagtattatcttcctattctgtaatttttgttttcacttgtttttctatctgtggctttcttttttcttaaaacaaaaaacaaaaaaacaaaaaaaacaggctgggtgcagtggctcacacctgtaatcccagcactttgggaggctgaggtgggtggatcacctgaggtcagaagttcaagaccagcctggtcaacatggtgaaaacccatctctactaaatatacaaaaattagctgggcatggtggcggttgcctgtaatcccagctactcgggaggctgaggcaggagaatcgcttgaacccaggaggcggaggttgcagtgagctgagattgcaccattgcgctccagcctgggcaataagaccaaaaacttcgtctcaaacaaaaagcaaaacacctcttctactcttttgccatcgctttcccagttctcaacatctacttaatatcctataagataaagttttacctttgccgcacaaggccaacctccctttccttctcttatgcttctgcttttgggaacatttcttttataactccaaatgtgaaacctgttatggttttgcagaggcaaaaccatattctgtttggaatgagaggtgaatacgagtagacttgcatgggtatattacagttggaggtaagatacaggttattaatatctgctgattatgcccttccaaatgactcttatgttctaggtattctttttttttttttttttttttaatcactcatactcagtactcatttgaactaactactctctggaggcacatgtgtactttattcttagtttttgtgacatacagagattgtgcactgcatgaagaaggatatgggctttggttcaaatgctaactttgctgtttcctagcagcgcgatttcaggcatgttacttaacttttttggagcctcatttttttgtatttatatggttgtaatagttagtgatgtatgtaaagtgtctagcacagtatataaagcactttagctatttaacaaataatagctattttttattattactaccataaaaagaaaatgtgattcctagccactacatttttaatgttacactgaatcatagtatgttcaggcttagttatctgatttaagaccaaattttttcttcatggaagacttaaaaccatcaaatttcctgtagtgaactttataaggaatcaaagaaaaatcattttcttggataacttttattccatttcctttcctaacaaatagctttgtgaatagttgagtaatagtttctattaaggaatggtatttaatgtataatgggactcaataaatctctcaatgtccattaataatataatttttgttactaaagaatgccagataactccttgcacatagctaaacatggtgttccttcttgttttcagatttgacagccagtcagtttcttaaggcaatgtggtttttggggtgaaggggtcactggacctttttgagaatctgatgaaaactttctataccctccatcccccaaaataaacatgtatgtactacattgcatacaatttcaagggatttgtggtctcaacgcttctagatgccaatcaacaaacaaaattgtcctttgggatgtaacctaagtttatactataagtcaacagtccccaaccattttggcaccagggactggtttcatggaagacaatttttccatggattgggggcaggaggtggggcattagattctcataaggagcgtacaacctagatcccttgtacgtgcagttcacaatagggtttgtgctcctatgagaatctaatgccgctgctgatctgacaggaggaggagcttaggtggtaatgctggctcacctgctgctcacctcctgctgtgcggcccagttcttaacaggccacagactggtactggtccatggccctggggttggggactcctgctataagtaacatacagtgataagttctttcatatttgttattatatagccaggctagtgatttttcagatttttgaatttttcaccagagcatagagaagttgatacaagtttgagtctcttattctttataagttttcagaaatttaccatcagcaggactaaaaagtggtttttattagactaaagattgctgtataaataggaaggatcttttgaatattgttatcagaatcgatcatatggtatcatactaggagaaattagtctttgctaatttctctgttaattgaaagtctttccagaggtacttatttcagtaaaaatacagatatttggagttcctggttctgtatatcggtgtccagtcatttgttcctaaggcattgttttagcatggtggggaggggaaaggttaagtagctttattactggtacatttttaggtctctgacttggttagttagggtaaaagttcttttctctacttgtaagcatcagggtttcaacatgagcattttaattacgctatgatatatgtataaattcttgtagagacatttaaaaagtctattaactttaatttctgcccccaccttggtcttcttatccttcatcatttctattttatattgtacttatcctcactttcttaacacttaagatacatggatcctttctggtaatcccaatcagagaagccaggtagactttcttagaccatttatattttattcccaaatacttcattattctaactcaagcctcatgtttcagagatgcagatataacttgtcacttaaatgttgaaagaaaaaaaaggtgaactttttaattgaaaaaagtttattgaagtttattgtagtttattgaagactactatgtgccagccaccatgttaactgctttttatgtttgtagtgtttacagatgtttaaatatgttgaaagaacttcttccatatgctttttaatcccctttgcaagctacgaagtaggtgttggattaccccattttataagtgtggaaggaagcacaggttcagaaaggttaaataatctacctgcagtcacagagcaagtgctttgcttttcattagtatcaacgactgtggttgagactttcactgacacaaatacctgattccatgatgtagagctagccacccagtgtgaattactggctttaaccatgtccttgaagaatgaagataatgggaaatattctgccacagtatagggacattgcagagtttatataaagatatcaaacaagttttttatttttaaataacattcaggaagaatgcgcttttttttttttgtcagaagaaatgatttggttgtgagttctggtgctttaaaaagtaaagtgattatatgctgaatatagccaaggaaagcaattagcattctaatttctttaggatcttttgtctcataattaaatgaataaacaccatctttacaggctcctcgagatgttggcactagaactacaagcactgcagtgagcttattggagtactgcaacatgtggtttcaaagaaattcactagaaacctgcctcccattgcttcctctacctttcacttaatcgatataaatgttccagggcacacagaagttagtattttcagtgttttcttatttgggccagtatctgctcccttgagaattacatgtaatgaaaaagatgttactacaagataatttttgttgaatctgtatgctccttagatggtcttgtttataagcctgagactgtcatatccatttagttgtggcttcattgtggatgagtgggttagaagcagtaagtagggttggcatctatgagtcataccaattacacagatttttaaatccatcttacatatagagcataaacattcacctaggtgctatggaagtgtagatgattgaagcagcatcatggcctgtggactaggcattacctaaaataattgttgaacttatttcttaaagtctgtctgcctgttgtttcctcagcctgttaatgaaaactataggttgtttctttgggcaccattataaaaatatgttgataaaattaattccatgcaaaggtactgaaaataagaaagaatatttacgattttctctgttcttctgatggggttgatggaggcaaaagaaaccttttatgatattaatatttgcaaccccatgtcaagttaatccttgacaaatcaaggatttgtcattattcaaacctgtagtgtagccttaggccttgcatgcaatgatgaattgtttggatgagttataacatgctgcttttgactgatcttgactttaaattgtaataacagaaagctgtgggtattttccttttgttcttaatgtttagagcaagcttgtctaacctgtggcccacgggccacatgtggcccagttcagctttgaatgtagcccaacacaaatttgtaaactttcttaaaacattataagagtttttttttttttttttttgcgttttcttattttgctcatgggctatcattagcgttagtgtattttatgtgtggcccaagacagtcttcttccaatgtggcccaggcgagccaaagattggacacccctggtttagaggtttaattttgttctttaatttgtaaatgtaatgttttatttacctaaaacactgcttgaaatatttgaagtattttgctggaattaatagcaaagatgacttgtaaaaacaaatttctgcagcaaaagaatatagtgaaatatagtgatttaatttttatttatagacccctaaagggctttttaatgtatattttaagtttttaagtttgcacagaaacaaatatgtctatatgatttgtatttagttaggtgctgattcaagtcactgacatatatatcatatatagatgcatatctgtttatatttgtataattatgtcttgatataaatatatattgatttaaatgtagttaaagtgataagcacaatattaggtcattgatagtacaatgtttcaaattttttaaaggtgaactttatttttcagtatggttttagatttacaaaaaagttgtgaagatagtacagagtgtttccatgtacccatacttagtttcccttattagtaacatcttatgttagagtgatacatttgtcataattcacggaacaatattaggacattattactaattccagcctttagttttccccaatgtcctttttcttttgttttctcccctcccctcccctcccctgtcttttcttttcttttctcgtctcgtctcgtctcatttcatttgagacagggtcccactcttgtcactcaggttggaatgcagtggcgtgatctcagctcactgcaacctccacctcccaggttcaagcgatcttcctacctcagcctcccaagtagctgggactataggtgcgcaccaccatacctggctaattttttgtatttttggtagagacagggttttgctgtgttgcccaggctggtctcgaactcctgagctcaggtgatccacccacttcggcctcccaaagtgctggaattacaggtgtgaacaaccacgcctggcctcaatatcctttttctaccccaggacctcttgggatcccacatgacatttagacattaatctccttaggctccatggttcaaattttaagtgagttttgcagtgccttttcagtcataccgtattataaagccttcggtctcttattatgaaagcacgtaagacatcaggtaagtaagtttgtgctatgcaagaggcattgttaatgaaaacctatggtgttatctccatagagatgaatgcatatgattttcaaaacaggagaatttaatgtcaccatttttaatattatttggcaagcactggaaaaaacctagtgtgggaaagtagtgtaacactaatgaactgtattataatgagtaagcttgggtatgagcagttattgaaaataatattgagaatacataaatttatggcacaataactgcatgtattgattcttctttacagaatgtgacagtgatgataacatgggtgccaaaaatacttcaataggagaagaatttatatccacagaaggtaacctaatagagttaatctcttttctacttgactgtatctgtattttttttttaaatttctctgtctctcacccattcacccctcttattcccttctacccccaagttaaaacattttctcagtttggatagctttgcatttttcatgtaagatgacttaggggtaatactaatttagaaagctagaatgggtcagccaattatggcccttgggtcaaatccagtccactatctttaggaacacagccatacatttaagtattgtctatgctattgcttttgtaccacaactgcaaggttgaataggtatggcacagacagtagagcccctccacccccgcccccctcaaataattattttctaaccctttaaaaagtttgctaacccctgggctaggagatgattttgatttcctaattgttacttatcttgagtagtattaagagtattaaaagacaggcagtagaactctaaaagcaagcacttatatctaaatataaatgggcttttaaaaataaattttaaaagggttttttttgtttgttttttgtttttttgagacggagtcttactctgtcacccagactggaatgcagtggtacaatctcagctcactgcaacctctgcctcctgggttcaagtgattcttgtgccccagcctccacagtagctggtattacaggcgtgtgccactaacacgcccagctaaaaattaaaattctcttttactcttcttaaaggaaaagctatttccttccataggttaaagagaactttttatgtcacttggcatcaaatcatttgctggctgtaccattatttggttgtgtcttgtaaccattctttactttggtttttctataacagactgcactttttaataacctgggggaaatgagataatgaatcttagaaaatactttgagcttcactggagaagttgaaagtgttatatcggcatctttgacattaaagaaaaacagtaggagtcttcatgtacattccagtataatgtttattgttggagattatagggtaggaatgtggaggctggaaagtagggatggaaatgtgactaaacacacacaaacagaatggcccaactggtatgttttctttgcatttccttgatctcagataatacaactagtttgactaagagcatactagaactttatgctattaggagtttgggaaatggagtctggcagtggaatcgattcatccattagattaagtagatagctgtaatctttctgccttatagccaaatttcattggttaaacaaaactggccataaatctatacctaattggaaggaagcaagtgttttgaccaacttgttttcccagcatggtctttcaaggtctagctcaacgcttagcagccacataatgatgaattaaacaaatgaaagaacttttgtgcgttttgaacaaaaactgccaattaagttgtttatcaaggccactaaaagataaacagtactgaacatctaaagagttcagattttgcaacttgtatttgacacctcgtgactcatcccatggaaaatgccaggcaaaattataacttttaaataattataagctatcacagttttgtgggctcctagctaacctaggaaatctgagatttgtgtaactggatatgtaccacatattatctatgtaatgcattttatggtttggaggtggagatgttacatttttgtgattatttggtttggaaaaataattatttttataggattcaagagaagacactttaaacctataactagttgtcatagttaaaatagaggtggggataaaatcctttaattccaagaaaaaccaaaggaatgtgtttgtgttttgtatcctgatgctttatataaaataaatgtgagaagcatatggtggttcacttaagttaaggaatatgggctcctttgcacttttctctaacacccttcttcttttcccctcctcatcaccccaaaagagctaactcgaattttatctcttaggttgaaccatatagaattgccatttttgtaggcactgttgtatggtcagtgcctttcctagattgtccatctttagacacagccaaccactctctattctgggctccctctgtaccaggccaagtggatttaaaatacttctgtctataactttcatctctgctgactgtaagctccttagggagtaggatcatgttttatttatctttacttcagcagcacctagcacagtgtttggcacaaaatggttgcttgttaaatgaataaacttttttttttttttttttttttttttttttttgagacggagtctcgctctgtcgcccaggctggagtgcagtggcgcgatctcagctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcctgcctcggcctcccaaagtgctgggattacaggcgtgagccaccgcgcccggcctaaatgaataaacttttaacaaacttaaaacatgttagagccaccaggacccatttccctataactggataagggaaattaagatagaggctattttgttatagaatattgggttattttgttgaccctgaaccacagaagcaaaataatgttctagtctagacctgataacaaaactcaaaaaaaattttaagcaacctcttaagtgtctttttattccttcctttcccagtacaactctgtaaatgcctgagaaatagtggcagaagacaggataaatctgcttatggctttttgccttagggtaattccctccttccatgatttgtgttattctttgttgttcctcatagaccaatatcaaactctgaccacgcaggccagtcataacaatcccatataatctagttccttgtacttgacagaggaaacagatgccgcataatgtggtggtgaaaagtacagtctttggattcatactgcctaagttaaaactctgctgcttacaagttgtgtaatattggacaagtcacttaacttcactgtgcttcagcttcctcctcttaaatatgggaatattagtatacctaccttactagaataacatgacatatgataaatagtatatattggttgctgctaatgttactgggattatgatgatcattatgccattatttacttatatgttcatctaaggtctactctagaggtatgtctgttaactagaggtattctgactcaaattgctggaagagacagaggacagcattatatagataattttctttgcaaaaccatctttctgtaaatgttagcaatatgccttattctgagaattccttcaattaatagcagtcaaaactgctcttaatcttaacaacttgtgagagtcagactattctcttcattttatatgaaaactgaggcttctaaacattaagtaatttggccttacatccacagttttaaaatgattgggaaccatttctatatgtcttctacctcctactactggttgtttttgttgtttgtttgccataattactgctctcaaagtaaatgaaattaaggcagaaagaatggtaaggggaacacagagctagccacagaatagaaaaacaaagacagatttttcacaattgctctttattttttcatatggcttcaagttactgtctgatgtcctttaatttcaatctgagagattctctttagcatttcttgtagggcaggtctactagtaaattctgtagcttttgtttatctgagaatttctttaggaatagttttgtcagatatagaattcttgatcgacattcttattttctggtctccatggttttttataagaaatcagctagtaattttattaaggctctcttgtatgtgatgagttgtttctctcttgttgttttcattgtctttggcttttgacagtttgactataacacgtctcagtgtgggtctctttagagttcattgagcttcttggatatgtagattcacctctttcatcaaatttgggagtttttcaaccattatttcttcaaacattctttctgatcctattgcacttcccctcttgagactcctgtaatgcatatgttagttcacttgatgatgtcccacaggtcccttggactctgtttacttttcttcatttttctttctgttcctcatactggatgattgattgattgattgattgatttagactgaactcaaaccaagacacacactggataatttaaattatactatctttaaatttgctgactcttctttgtactcaaattcattaagcccctctaaagatttttcattttagttattgtacttttcagttcctgagtttctatttgatgggcttttaataattctgcctcattattggtactcttaattttgttcatacatttttttcctggtttcctttagttctttgaacatacataagacagttggcttaaagtctttgtcacccatgctatatcatgtagcctgttgctcctagtctacaaacctgtatagcatgttattgtgctgaatactgtagacattgtaacataatggtaaatatttttgtatctaaacatagagacataaaaatacataaaaaatggtatacctgtataaggtacttaccctgaatggagcttgcaggatggggaagttgctctgggtgagtcagtgagtgagtggtgagtgaatgtgaaggtctaggatgttactgtactctactgtagattttataaacactgtacgattaggctatactactttttttttttttgagacggagtcttcctctgttgcccaggctggagtgcagttgtgtgatcttggctcactgcaacctccgcctcccaggtttaagcgattctcccacctcagcctcccaagtagctgggattataggcatgtgccaccacgcccgcctaatttttgtatttttggtagagatggggtttctccatgttggccaggctggtctcgaactactgacctcaggtgatccgcccaccttggccttccaaagtactcggattaagacatgagccactgtgcctggcctatactacatttaaaaaaatttttttttcttcagtaatcagttcaccttagcttactgtaacttgtataaactttaaaatttttaactttttgtctctattgtaataacacttaaaacacaaacactttgtacagctatagagaaatattttctttatatccttattctataagcttttccctacttttaaattgttttattacttttaaaacttttttgttaaaaactaagacacaaacacatatatattagcttagacctgcacagagtcaggatcatcaatatcacttttataagtagcagtaccctctaaaataataataaaaagtatagtaaatacataaaccagtaccagagtttattataattttcaagtgttatgtactgtacataattgtatgtgctgtacttttatacaactggcaacatagtgtatttgtttacagcagcatcaccacaaacacatgagtaatatgttgcactgcaacatgaagatggctatgacataattaggcaataggaatttttcaggtctattataatcttatgggaccactgttgtatatgtgatccactgtttaccaaaagttgatacgcagcacatgaccatacttgctttttgttttttatagtctttcagctggcaagtttaatccctataagctcactggaggtatgatatctttgtatagatgttgctgtacttaatgatggtttgatttatgatttttttactttataaggatgtgaaagcaatatgcatttagtataaaccatacttcaaattttgaattttagttcaaagatttttataactttaattgtaaaacagacgttgtgatttcgtatatatatacacacacacacacacacacacatatatacatataacctactatcatttgttaaaaagacctttccctgtcattctgcagtgctacctttgttataaatccagtgtccatatatgcatgggtctgtttctgagctgtctatgctgttcctttggtctatttattcttgcactagtagcacattattagttactgtaactttataataagtgttcatatcttagacaagtcttgtccccttgtttttctttggtaagagtgtcttggcttttctttgcatttcctcatcccttttaattcatcttaagggcaactaactgatcctagagtgtagctttaacttgatacacagttcatgctagtttattgtactttaaattagacaacataacactagtgcccccaatcagaggaacatgcggttgcatcttagggagatcactggtgcctgtagccaagtagcctctgagagactgtggaccagatgggatgagataaatctggtgtgagaagctagtgaaggccaagaaattgacaccaaatttcaccctcctggattttagcatcattcccaaggaggagatggaactcaactattgtgaacccaataacgtctgtcttgttcactattacattgctgttcctggtatataatgggcattcaataaatatttgtcaaatgagtttacatacatctgcatacagcatatattatatgcttctcagatgacatttatgtggctatgagtttcactaccttagatgctaggatgctttaagctaatttttccccagctttattgaggtataattaaaaattaaactaaatttttaatggcctgtgacattttgtcatttcatggagttgcctttctgtttaaagtcttatatgtatcacctcaagtcttttagcaaataagtgatacagatttttttttaaatgttgaaacaaatgattacctgtcagtgattttaaaagtttgttgactttctacattcctaagtggaattaacttgcaagttctaagttcatatataaaattcaattcaagatcatgtctagattttcatatttcaaaatactcaattttttagtagagaaactgccaagttatcctgtgtttttccattttgattttactttccttcttgaaaagaatacagtcgatgaaacttaaataaatacagcacatgttgagttttctgccctaagtgttaaaattctatgttttttaatgcagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattcatactttgactttaatttagacacaaggagatgtaatcgctgtgtaacatcagagaaagctatatggattatcgtcagaagtaaatgtttctaacattg

SEQ ID NO: 37735 - DNA, 6952 bp, Homo sapiens
ggagtgagaccgctctgcaaaccactgcgtgctttgcagagtgattatcagcacagttccctgccctggataaggaacagctacagtcgctgttaaatgtgcctgaaaagcaatttgcaatctttgcattaggtaagtaccgtttccttccgtagacattttaggaaagataaggtgagaaatgttgacttttgcaaggaactgaacatttatttatttgaacttgctttccagctaaggttactggttgcatttcaaaacaccggtagcattcccactgctaaaactaatgctcttaaagtaaatgctaccgctaaaagaaaaagcagggtccctttcacctttccttaaccgaacagtagacgtttaaagtctgaaacgatcgaatttgtgaaacacagagccgttaatgcctttatgcgaagaggggctagcactcggtgtgtggaccaaatgcgtgtttgtttaggcattgttggcgaccgaatcccgagtgaagcattggtttaaaacctgaatttcccgtctctgtgtattgattcctaacgcgcagaggcgttgcttgaacgttgtttgaactcctaggcattccagggggcaaaagcacctcggcaaaaacgtgcaggactgcatgttactttggttcgcggctgacacgccgactgtgcgccggcctgtcaatcaccgggagcagcaacagggagcacatggcaacgggctgcgggcgagctggccagcggcccgcccggggtcccagcccttcgaagaaagggacattcacgagcttctatctctaattctctgtcgcaggcatttcggccgtggaaccccaggctcggaggactgggtgtgagcgctgcccgggagaggctgacctgccgggaccggagtgcccggggacgctgtgcccccacttgcccaacgtgcggaatcggctaagcgcgtcggcctgcgcggggcacaagggacgacgcccgcctttctctctccgagaaggatccccaaacctcactctcttcactcctccccgctaaaaaaaaaaaaaaaaagaaaagggtaaaaaaatccccctccccctcccggccgcggcagcctctgcctggcaggcgcgtgctccgaggtttcgccggggtactgcgcggctccgtgacccacccgccgacggcggttcgggccccgacccgggcgctgcggagtctcgaacgcccgtgacgtggatttttcgctcgtcaggaagccgccatcccttccttcgttccttgcgaggagcgactagaacccgagttctctgagcacaccgtgccgtcagctggcccgtcacgcactcgactccgccactcccctacttgtttttctgagacttgggaagccttcctgaaaggatttgtaaaaactggttcttggaaaggggctgcagaagacctcccgaggtggatgttactgagccgcccggcgagcaccagccgtgacaggtccgggcccggccgcgcggagccgcgggagaactgccctccgcagccggaagggggccgcggggagcgctcctggccggtggcggcgggggcgggggaggccgcgagccgaggcgctccaactccggcgatgccgcctcgccctccccgccgcggttgatgcggcacgtgcacgccgccgcccgcaccaggacctgggccgggtcgcacggcttggcccccggccaccgcttcggcctaggtgagtgtgtgcggcggccgccctcggcccgctgggctgtaggcgcgcgggcggggctcgctcggcgcggcaggtgcggactcggcggcgctgctgcccgagccaggactccgggagaggaggggaggggagggacgacctcgctcggcgcggcccctcccgccgctccctgccccctgggggccgcggcttctgggggctcaaggttgggtggcggggtgggcgacggtctgcggctgcggaacgtaacaggacagggtctcctccatccccgattacccggagcggcggcgcggtggcccaggttgtcctctcggagagcccttcacgcccaagggggatttcaggcggctctggggatgtccccggaggccctctttggaggagtgtgcctcaagcagggggacgacaaaggctgtgtgtgtgcgtgtgtgtgtgtaggcacatccccggaattcgccgattaccccctcgatagaattaggcagccccaaagccagccgcaactttcttctggtttggagcacagtgcaaagacaggggaagggagagggcactgccactttaaaagtggggaagtcggctgggcgcggtggctcacgcctgtaatcccagcacttgggggggccgaggcgcgctgatcacctgaggtcaggagttcgagaccagcccgaccaactgatgaaaccccgtctttactaaaaatgcaaaaattagccggccgtggtgacgcgcgactgtagtcacagctactcgagagactgaggcgggagacccgcttgaacccgggaggcggaggttgcagtgagccaaggtcgcgccactgcactccagcctgggagacaaagtgagactccggctcaaaaaaaaaaagtggggaagtccgccctcctgagctcatggtaacctcagcctcctcccctcctcctaccacagagagagggagaaagaacttgttttcattcataactttttccttttccttcttccgtcaactatttattcagtgcggattgcagagggcgcagctccaccgtggtaacttgcaatgtggccgcccctgcgctggcttctttctcctcggccctcggtgaacccagcttttcctttaaagcatagacaaatccttgcttagggtcagccagaccgtgggcttgctttgggctcccgcgtggacgctgaaggctcttcatgatttctcagaaaccttggtgggccacccaaaaagtgtgttggaaatccacggtgatccttaatatggtgatgggattgtccgaaaaggtattctacttccattcgcgttttcttggggaaggcagtgtgccgagcgcgtgtgagcgtgtttggggcttgtccaagactgtcactgcttgaaaatgggcttttcttcggatcggaggtggcgaattttctttgcttttaatttttttgtctggcaactttatttcccagccagtatgaagtttgttacaactatcattggaaatgcaaattgaagttgtgcctggtgttatgggttacactattcaaatcctctgcggttttgtgaatctggcttagtacttttagctaccttttgctttgaaagcactgagttaagaagttcttgaagaagaggaataattgtgcaggagtcaggattagatgttgaggactccgagactaaatccccgcaggttatgaatgtgttactcctcatgcgcaaagaaggtagaataaagtagaaactcgagagagctgagttgtgaaaacgagggggagctccaagaagttaacatgtaagacatagtttagagacattagtttaggaaatataggaaatggacttctttctgcgttgttccttaaaccatgttttttgcctcaggttggtagtggagaatggacatttctttttcttttcattcttgaattgggtcgactctgtagactttagaaggaatttgtgtgaaaaatactctagttcaccactgaaagcagaaactttcatctttggcagtttgtgaagaacacataaattagaaataacttactattagtatggaaacacaactgcttatttttatctggatattagtgtgctgattttgttacaagaagaacgttgaatcagaattggcagtgcgtttgaaaatcaaggtctgtcatgtaaatacagatttttaaatcagaggaaatacagataattaaaactgccaggatttccctacactgcgttaaaggcctcacacttatttgtgcataaaacttactttgttttgtgagtgagcccttcagcttaaaaaaaatcctctcaggatttcaaatatgagtactgttatatatcattcactggactatacattgagtcttgtgtgtgtgtgtgtttgtagctccaaaacaccaagaatcgttgtgtacctgatacatttatttttgcatctcatagatgaataataaggtagttttaaaattctgatttatatagaaaattacctattattttgcgatttcattttaagagtctcaattttttaatgccttaatttttttcatcattaatctaatgcatataacagcacacaacaaaaaggctgtagcaccaaagccattctcaatttcttaaaaggtagacattttcctttatggaagccacctatgaactgataactgagctttctttagatgagagttattctcctgcttatactcagtattccctgcgaaggcatgctccattttaattattagattcacaaacaggaaggcattactttctcctgattctgcttcttaaaagttggaaaaacttataatgttcatggcatggggtctcttgtttatagtcttcctctatgatgtggtccccagcctctcctagaattggactctggccaggaccccagcatcattgtaatccactgatgaaggaggtcattactaggcggtttaggcaatttgtgatttgacaggattccccccccccaaaaaaaatgcttcctgtcatttattttctgtttttttcatctttgatttcgttttaggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctccttctttctccttcaaggttctttccccctcagttttgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatatcaatacttaacggaaaataaggtgacacgaagaaagtacatatgttaactataatgcagaaaatatattaattaatg

SEQ ID NO: 37736 - DNA, 126495 bp, Homo sapiens
cgctctcggctagctgcagcggcggcggcgcggaggggaaggcatccaggatgcggtgcggggcggcccggtgcccccccgccccgtcacggcagccgcggcggccgaggggaccgggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcgggtgagtgcgcgccgagcccggggcgctttcccgcgcccgctgtcgtcggggaccccagaagaaaccttccttcagccccgctttgtcccgggagccgggcgagtgtcggccgggaggaccagggcgggcgcgggcgaagggggctttggactggaggggggaaacggatgaggggctctgagccatgaggggtccaaacctacggcccgctgcgcagtggccacgtcttcggcgaccagaaagagggagggttgtgtgttctcagtttggtgtaggttgagtgacttcgtttaaaataaaggaaagcttgtcctctggcacccattagggagggaaggcgtcccacgtcctagtgaaagtaagttccacccagacttaaaaaaaaggaaaacaaaaacttggtgagtttatctggccacttcccaagaagcttgtgatactagttcctcaaaaccgttataccccagccctgggctgggccccctgagtcagattgcagctctgcgcgtctggatgggatatgaagtaataaagtgaacttgggcggcaccaagaagagtaggaactcccttagccttggaaagggcttgtatcccggggccatgccttttttgaaaagtaatttatgtcctttatgaggacagaggcgtttgtgaataaaagggtagcagcattgtagttggagaggcttggtgtgttctgatgcgtttcaagtcatatttgaaagggaaagtgatgaggggagtcaaagatggggccctgaccagatttggcactcactgcagaaggccgtgaaaattatacagtccccgtgaattttccactgcactgtcattggagtctttgaattgtaacagttttgaaaataagtttttgtctggagtttccagttagtgggtttcaagtgggtggaggtttgtcgggttgtactttaaggttgtgtcatcctgatgagggggactccttttcacttttctgtcactgtaaagtttctctttcgaaagtgattatcctgttgactaatcttactcggcttcaacgatgacaagacagttttgtttttgggcaccagaaaaagtccagtgtttctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccagtgtttcttatgaaaaaaaaattaggcggggcgcggtggcccaccacccggcggctcaggggtaatcccagcactttgggaggccgaggcgggcgggtcacctgaggtcaggagttcgagaccaatttggccaacatggtgaaacccccgtctctactaaaaatacaaaaattagccgggcgtcgtggcgcgtgcctgtaatcccagctactcaggaggctgaggtaggaggatcgctttaacccaggagggggaggttgcagtgagctgagattgcgccagtctgggtgattgcgccactacactccagtctgggtgataaagcgagactctgtctgggaaaaaagaaaaagaagaaaaaagcatgataaattcatgctttaacaaggttagaaaaaaatgagctatttcctcaatagcaggtggagaaaatatgaagcagtaatataattaatattaggctttttgtcggggtagttttatggtttctaatttactttaaaaaaattttagttttaggccgggcgcggtggctcacgcctgtaatcccagcactttgggaggctgaggcgggcggatcacgaagtcaggagatcgagaccatccgggcttacagggtgaaaccccgtctctactaaaaatacaaaaaattagccgggcgtggtggcgggcgcctgtagtcccagctactcaggaggctgaggcaggagaatggcgtgaacccgggaggcggagctcgcagtgagcccagatcgcgccactgcactccagcactctagcctgggcgacagagcgagactccgtccaaaaaaaaaaaattattttgatgagtacctaataattgttcaagtttatcttttaaggtcttcaaattcttatagtacagatgtttttcatctttttcatatgtagtaagtttgtgactttgatgtaatttttggaattcggttcagggtattggtgttggaagggacctcagaggggaaaatgaggcccaggaaggacagtggggcctgtatacactagttaattgcttggtccagtgctcttctcatgacattaaactgcatctcattggcctggctggaggtctttagaaaacactaacatgttgagaaatattaaaaacaacataattcttctcagtaaaagaaactaaggtggtggaataaacttttttttatgcgtgtttttgagtgtcaaattgtatgaacacttggtttgagaagatagaatgttttgcgaatgatagagcataagaatgaagctgggaagttaactgttagcgagagcatgagtttagggtaatattcctgctctcctattgactatctttgtgattgggagcaagttagagataaccctgtcagggtcctcatctataaaaaaagaatgtaaataaaaataatctcatcaagtagaccttcaaaaatgtttaaaaactgtctttcaacatttcattaaaaaagaaatgttactgtcttaatggatatgtgttaattatctggctttttggcaagctaaaattatatccttgtgaaagtttattgggataataaagaaagggggatgagttgtataaaatgtgtaaagaggggtattttctgtttttttaaaaatgtggttgcagtagtggaatgccgagaccacatttccgataggtggcctttgttagagtatgcagtgttggaaggattttttttccctcttcatttcatttctggtgggttggtaggggaatctgaactatccagagggaatctttttttttttttttttttgagacacagtctcactctgttgccccagctggaatgcagtgctgcaatagtggctcactgaaacctccgtctcccaggttcaagcaattctgcctcagcctcccgagtagctgggattatgagccgcgcgtgccaccacatcaggctaatttttgtatctttagtagagatggggtttcaccatgttggccaggctggtcttgaattcttgacctcaagtgatctgcccacctcggcctcccaaaatgctaggattacaggcgtgagccaccactcccagagggaatctttgaataaaacaaagcagagtacaaatagcaggttcttcctgagagtctccagggtgcattttctctcctcagcctgccttgtagctcccaaactgatgatatcatactcagtaactaactacaggaaattgtaatttgtagccaggttctccaagaaggtattaaggagtctctaagaaggtgcactccacacagttaacttacatagctcaggtagcatctacattcttaaaaagtgaacccagaataagcaaatcaaagatgctcggtgttccttcttgttttgtggagaaaggttaagattcattcctctctgtctgcaacaaataaacatggaggctgggcgcagtagctcacacctgtaatcccagtactttgggaggctgaggtgggtgaattgcttgagcccaggagtttgagaccagcctgggcagcacggcaagactcttatctctacagaaagtacaaaaaattagctgggtgtggtggcatgcacctgtggtcccagctgctcaggaagctgaggtgagaaggtcacttgagtctcagaggcagaggttgcagtgaactgagattgtgacactgcactccagcctgagcaacagagtgagaccctgtctcaaataaacaaatacaactaaaaataaaaaataaaaaaacccaaataagcatagagcttgctgtgtttaatatagactgaggtaattggattttgtaggaatctcttcctgtcacttctttccctttcttgcagactcagcatttaggcaagtaatgtagttgttttttgtgcaaggaattgaggaatgtgtgaaaattaattttgttttctggttgaggaagctctttgggctagaaggagaagaaggtaatatgtgagcaaagcacagatttagccaccttgaggatatggtgtctgcttgttggctttttgaacttgtcagttaggtaagcaaatctggaagaattgcttctgatttatgttttccattatttttggcacatcgtaagtggggaggcagatgatagtggagttcagtttctttttctacctctgatgggcgaatgtcctggtgaatcttctttttctttgtttctgatggtcaccactaggtgaccccaggagaaggttttactgtgaaatggggttcatgagtttattttccttgtctctgcttgagaattaaggttcccaaatacttgtgacgtatttcttaccttggaatctgtaagttcctctgaactgatctgcacctagcattgagatataagtatcctaggttctttcatcttgtactccaattttcccaggctctgtgcagaagctcttgccaggaattgaagagaagtggctagggataaggatagatgggaaactggccagtgtgctgtatgaacttactagaaaattgagactacactgaaatagtctctctctttttttttttttttttttttttgagatggagtcctgctcttttgcccaggctggagtgcaatggcgtgatctcagctcactgcaacctctgcctgtctggttcaagtgattctgagcctcagcctcccaagtagctgggaccacaggtgtgcactagcacacctggctaattcttgtatttttagtagagacaggatttcgccatgttggtcaggctggtcttgaactccttacctcaggtgacccacccgcattggcctcccaaagtattgggattacaggtgtgagccgcttcgcctggcctgaaatagtctcttaatgtcacctttagaagagagagggtcctggtacagtggctcacatctgtaattccagcagtctgggaggctgaggcaggatgatgcttgggtccaggagtttgagatcaccttggccactgtagcaagaccctgtttttttgttgtttgtttgtttgtttgttttgagatgggagtctcactctgtcgcccaggctggcgtgcagtggcacgatctcggctcactgcaaactccgcctcccgggttcacgccattctcctgcctcagcctccggagtagctgggactacaggcgcccaccaccacgcccggctaatttttttgtactttttttttttagtagagatggggtgtcaccgtgttagccaggatggtcttgatctcctgaccttgtgatccgcctgcgttggccttccaaagtgctgagattacaggcttgagtcaccacgcctggcctgttgtttatttttttgagatggagttttgctgttgttgcccaggctggagtgcaatggcacgacctcagctcactgcaacctctgcctcctgggctcaagcgattctcctgcctcagcctctcaagtagctgggattacaggcatgtgccaccatgcccggctaattttgtatttttagtagagatggggtttcaccatgttggtcaggctggtcttgaactcctgacctcagttgatctgcccgcctcggcctcccaaagtcctgggattacaggtgtgagccactgcgcccagcctaataccctgtttttataaaaaataaaaataattaagaaagagaaaaaggtgactgtctaggaaagctagaggactagtcaaatcatactcctccttgactgtattgagcagtgaaattcgaacttcaaaattatcgaatgttaacatgaaagcaccctttgcaattatataaccttctgattttacagatgaggaaactgaggccctgagaaagtgggagaatatttgtctcccttgccacatttcattcttttctgctacttgagtgatattttgcatgctttgcagacctttgatgagtggtggatgcggggggaacaagcaaaaaatttgtctggcagggcaggaacagacgttatggtagtttttttctagtccaggtttctgtttcatggtaagaaagaatactgtgtgtgcaatagcaagacttggaaccaactcaaatgtccatcagtaagagactggataaagaagatggcacatacacatcatggaatactatgcagccataaaaaaggatgagttcatgtcctttgcagggacatggatgaagctggaaaccgtcattctcagcaaactatcacaagaacagaaaacggaacaccacatgttctcactcataagtgggagttgaacaatgagaacacatggatgtagggaggggaacatcacacactggggcctgttgggggggtgggggactaggggagggataacattaggagaaatacctaatgtaggtgactggttgacaggtgcagcaaaccaccatgccatgccatgtgtatacctatgtaacaaaactgtatgttctgcacatgtaccccagaacttaaagtataatttaaaaaggaaaaagaaagaatactgtgtgtactgtgtgtagaccgggtacggtggctcatgcttgtaatcccagcactttgggaggttgaggtgggtggatcacttgaggtcaggagtttgagaccagcctggccaacatggtgaaaccctgtctctactaaagatacaaaaattagccgggcctggtggcacacacctataatcccagctactcgggaggctgaggcgagagaatcgcttgaatctgggaggcggaggctgcagtgagccaagatggcgtcactgcactctggcctgggcaacaaagtgagaccttgtctcaaaaaaaaaaaaagaatactgtgtgtgttggctgggcgcggtggctcacgcctgtaatcccagcactttgggaggccggggtgggcggatcacaaggtcaggagatcgagactatcctggctaacacggtgaaaccctgtctctactaaaaattcaaaaaaattagccgggtgcgatggcgggcacctgtagtcccagctactcaggaggctgaggcaggagaatggcgtgaacctgggaggcggagcttgcagtgagccgagatcgagccagtgcactccagcctgggcaacagtgtgagactccttctcaaaaaaaaaaaaaaaaagaatactgtgtgtgattatcattaaggatatcttttttttttttttttttaagagacagagtctgtctctgttgcccaggctggagtgcagtggcacaatcatgactcactgcagcctcgacctcccaggcccgtagctttattgctttatctttttttataatttcatatttaaagaagcattgagggctagacatggttgctcacgcctataatcccagcactttgggaggctgaggcaggtggatcacttgagaccagcctggccaacacgatgaaaccccgtctctactaaaaatacaaaaattagccgggcgtggtggtgggtgcctataatcccagctactcaggaggctgacacaggagaatcgcttgaaatgggaggcagaggttgcagtgagccgagatggcgccactgcactccagcctgagtgacttggtctcagaaaaaagaaaaagaagcattgacatgaatagaacaaagaactccagtatatctcttaaccagattcaccgattgttaacattttgccccatttgctttatcatttatgtgtgtgtccatatataaacaattttattgagatataattcgtataccatacagttcacttatttcagtgatttttaatttatttttacaattagttttacaatcacactacaatccattttgaaatgtattaatcactctcccctgaaaacctgtacccattagcagttactcatcattttctcccaaccctctaaccctgaaccctaggcaaccactcatctactttctatctctatagatttgcctgtttttgacatttcatataaatggagtaatatgtgtggtctcttgttactggcttctttcacttagcataatgttttcaaggttcactcatgttgtagcatgtatcagtttgtcattcctgtttatgccagaaaaatatgccatggtatgaatatacaacattttatttgtttatccattagtggaaggacattggattgttttcttcttttttttttctgagacagagtttcattcttgttgctcaggctggagtgcaatggcgcaatctcggctcactgcaacctccgcctcccaggttcaagtgattctcctgcctcagcctcctgagtagctgggattacaggcatgtaccaccacgcctagctaatttttgtatttttagtagagacggggtttcaccacgttggccaggctggtcttgaactcctgacttcatgatccacccaccttggcctcctaaagtgctgggattacaggcacaagccaccgtgcccggccttcagtttttgattgttttgaataatgctatgaacatttgtgtacacttctttttttgtgtgtaggcctatgttttcatttctctttgctgaatacttaggaatgaaattactgggtcatatagtaactgtgtttaacctttttttttttttttgagatggagtttcgccgtgttgctcacgctggggtgcaatggcgcgatcttggcttactgcaaccactgcctcccgggttcaggccattctccttcctcagcctcttgagtagctgggattacaggtacccgttaccaagcctggattttttttttttttttagacggagtctcactctgtcgcccaggctggagtgcagtggcacaatcttggctcactgcaacctctgcctcccgggttcaagcaattatcctgccttggcctcccaagtagctgggactacaggtgtgcaccactatgcccagctaatttttgtattttgtactagagacagagtttcaccatattagacaggctggtctcgaactcctgacttcatgatccacctgcctctgccttccaaagtgctgggattacaggcgagagccactgcgccagtcaatttttgtatttttagtagaaacggggttttaccatgttggccaggctggtctcgaactcctgacctcaggtcattcacctgcctcgacctcccaaagtgctgagattacaggtaagagccaccgcacctggctgcccgactaatttttaatttttttgtagagacgaggtctcaccatcttgcccaggcaggtcttaaacaacctgaaaaatgatactcccgacttggcctcccaaagtgctgggattacaggcgtgagccaccgcgcccggccgtgtttaaccttttgagagactgcctgccagtctgttttccaaaacagctgcactagtgtacatttccaatagcagtgtatgagaattccactttattcatatccttaccaatacttatctattggtttatagccatcttagtggctgtaagtggtatctcatggttttaatttgcatatcctagaagacaaagatttttatttttattattttattttattttatttattattttttgagacagagtcttgttttgtggcccaggctggagtgcagtagcacgatcttggctcactgcaacctctgcctcctgggttcaagcgattctcatgcctcagcctcccgagtagctgggattacatgcatctgccatcacgcccagctaatttttgtatttttagtagagatggggtttcaccatgttgcccaggctggtctcgaactcttgacctcatgatccaccctccttggcctcttaaagggctgggattacaggtgtgaaccaccacaccttgccgactgagacttttaaataagacttcttatttaaaagagaaaaggatatccctccccagagatgaagtagctataaaaagttttatgagccagtttcaaactgggagtcgatgtggactacacttaattttcatcttcctctactgggctggttgattctgggcagattcttgtggtcatttaaaaaggcatctttgctctgaagcccagattactagctgcagcaaaactcaaaatcttatggcttatctcagacatctgtggatgcttccagaagtcaagcctactgaagtacggaaagagttcttaagttaggttatgtgttttctttttttaggtagaacaagtaagaagtcaggagagatgagacccacacacagaaaacaattacagagtagcccaaggcagttaaaatacaagctaaatttctgtatatatacatattttgagatgtggtctggcttaaaaaagccagacccaggctagggtacagtggacaatcatacctcacttcctcggcgtttctgagcctcgaatttctgagctcaagggatcctcctaccttagcctcttgagtacttgggactacaggcaagtgccaccacacctggctttttttttttttttttttttctgagacagagtttcgctcttgttgcccaggctggaatgcaatggtgcgatcttggctcactgcaacctctgcctcccgggttcaagcgattctcctgcctcggcctcctgagtagctgggattataggcatgcgccaccatgcctggctaatttgtattcttagtagagatggggtttctccatgttggtcaggctggtcttgaactccagacctcagatgatccgcccgtctcggcctcccaaagtgctgggattacaggtgtgagccactgcgcccattgttgtttttttgagacagggtctcaccctgttgcccaggccaaagtgcagtggtgtgatcatggtttactacaaccttgacctcctgggctcaagtgatcctcccacctcagcctctaggtagctggaactacaggtgtgcatcactatacctgctaatgggcccaggctggtcttgaacctctgggctcaagtgatctgcccacctcggcctcccaaaatgctgggattattggtataagccaccgcacctggctgcccaactaattattatttttttgtagggatgggttctcaccatcttgcccaggctggccttaaacagcttgaacagtgatactcccgactcagcctcccaaagtgctgggattatagacatgaaccaccatgcctggctgagactgtatattctaaagagaacgctatttgactccatcaggcagggaggatcatactgaaattagtggattttactttaatgatattggggccctgcaattttcttcatagaaggaaatcctgagtcacagtgtttggtgcttaaaccaaattctcttagagtctgctcagcccttccttccttcctaggttaaaaataaagttttctttgcctaaagcctcctttggtaacacccctttccagtcctacatccttttataagcttgttttttggctttgttggaaggtgtacttgggcttcgctcagcttgtaaattcctgttgtggccaggtatggtagctcatgcctgtaatcccagcactttgaggggccgagtgggggaggatggctttaggccaggagtttgagacaatcctgggcaacatggcgagactcgggtctctacagaaaatagaaaaattagcctggtgtagtggtgtatgtctgtggttccagttccttgggatgctgaggttggcagatcagctgagtccagggaggtccagactgtggtgagccatgattgtgccactgcactccagcctgggcaatagggtgagaccctgactcaaaaaaaaaaaaaaatcctgttgctgtccctggctttgaattactgtcagatagtcttagaggtctcttaggaacctgggtacacatgaaggaacctatacttcatatgttgatatgttttaggttcctgctagagatggcctaatgtccagtgagaaagaggcttgcctttcagaagctggtgacttccttgtggaattcagttttttggtttttttttttgagacggagtctcactctgtcacccaggctggaatataatggtgcgatcttggctactgcagcctccgcctccaaggttcaagcaattcttctgcctcagcctcctgagtagctgggactacatgcaagcgccaccacacctggctaatttttgtatttttggtaaagacgctttcgtcatgttggccaggctggtgttgaattcctgacctcaggtgatccacccacctctgcctcctaaagtgctgggattacaggcatgagccactgcacctggccgaattcagtaattaaacacaggctattacggccagatttttatatttagttctttttttttttttttttttgagacggagtcttgctctgtcgcccaggctggagtgcagtggtgtgactgcggcactgcaacctctgcctcccgggttcaagcgattctcctgccttggcctcccgagtagctgggactacaggcgcgtgctaccatgcccagctaatttttgtgtttttagtagacatgcggtttcaccatgttagccagaatggtctccatctctggacctcgtgatccgcccgcctcggcctcccaaagtgctgagattacaggcatgagccactgcacctggccagatttagttcttttttcttttttttcgcgagacagagtctcgctctgtcgcccaggctggagtacggtggtgccatctcggctcactgcaagctccgcctcctaggttcacgccattctcctgcctcagcctcccgagtagctgagactgcaggggcctgccaccacgccagtctaattttttgtatttttagtagagacggggtttcactgtgttagccaggatggtctcgatctcctgacctcggaatccgcccgcctcggcctcccaaagtgctgggattacaggtgtgagccaccgcacccagctggatttagttcttaaaagttactaagtgaagcagttagtcaaatgccatattccaaatcttctgtggttgctgattttcatttggcgtatgtagaaccctgggctgagtcttatgagtggtagaatcctggcatggcagaaaatgagagtgtgtgccagatgtcaagttgttttcagtatgccttcaggggatcagatatgactcaggaagtaagatggcaataggtatagtttagaccgttgtgtttctcaaatattgtactgtctttgatatttgcttgttgtcgtacatggaatctcttgtagagcttcctgttaaagagaaccaggttagtaattttttattttttattgttcattatgtgatgggtaagtcaggttaaaattttgcttggccatctgtggtctactttatgtactgaactagctgggttagcctaaaatgctttcctggaatgctgagaggtctgagcagtgaaaagtctgtagaggtttctcacattgagtttcattcctctgtgaatgtgggattccttgatatctttctttctttttttttttttttttttgtttgagatggagtgtcactctcttgcccaggctggagtgcagtggcttgatctcagcgcactgtaacctctgcctcctgggttcaagcgattctcctgcctcagcctcccaagtagctggaattacaggtgcctgccaccatgcccagctaatttttgtatttttagtagagagggggtttcaccatgttggtcggggctggcctcgaactcctgaccttaggtgacccacccgcctcagcctgccaaagtgctgggattacaggcgtgagccaccgcacccggccggaagtccttgatttctaaactattccagttggccaaacaatgtatgtgcattggtttatattggtcacagaatcaaaaaatgtcagagctagaaatcagagatagttcagctatcacttttgacagatggtaatgattaatatttataaatgactttgtagttttacactgtacttttaaatgatttttaatttttttagccccgcttgaaataaaattgtttgtccattgttacccaccaagttagaaagatctgttagaatccaggtcttctgtttgctgtcttactattactgaggtttgtttgtttttttaaaattatagatgtgggaaaactgaagcagtggcataatcgttgaaatgcagagctgtagtgcgacctctttgtggttcagtctccagcccacattgcagtagaggagctgtgtcaggagaggagacaggttgcttgttttcagaattgtggttaacaacaaccattgttctttcctctttccccactctttatcagttctggaaatgtttttcttagactaggtagttactaggggtttgcttctaagaaacttttttttttttggtgacagtttcaggatgttttatgctttttgcctgggtctgtcttctttgaaggaaaaaaaagatttgcatctgctaacctcagaaatccctcagtgtagcctataatatgcatgttttgtagttgtagttcgggggctggctgtgacttctgattagccatattcttgataataaaatgatatggaaaacacctgagaaattttaaggattttttttttttttttaaattttatttttaaaggcatgaacacagaagaggaaatggtttagaaagaataattgggccaggtgcgatggctcgatcctgtaatctcaccactttgggaagctgaggtaggaggatccctggaactcaggagtttgaggctagcccgggcaacgtagtgcaacactgtctctacaaaaaaatttaaaaatgaggccgggcacggtggctcatgcctgtaatcccagcactttgggaagccgaggtgggtggatcacctgaggtcaggagttcgagaacagcctggctaacatggtgaaaccccatttctactaaaaatacacaaaaattagccaggcatggtggtgggcgcctgtaatcccagctacttgggaggctgaggcaggagaattgctcgaacctggaggcagaggttgcagtgagctgagattgcgccattgcactccagtttgggcaacaagagcgaaactctgtctcaaaaaaatacaataaaatacaataaaataaaaaaatataaaaatgagcccagtgtgatggcatgtgcctcagctccagaggacgagctgggaggatcgtttgagcctgggaggtccaggctgcaatgagctgtgattgagccactgcattccagcctgggcagcatagctagaccctgtctcaaaaagaaacaaaaaaagaaataatcacaggccacaattataagacagtaaatgaataaacctgatttataacaaattacatgctttttcgttacaacacgttagaattactttccaggagtgtcagaggacttggttctttttctttttttttttgagtcggagtctcgctctgtctcccaggctggagtgcggtggcactatctcagctcactgcaagctccacctcccgggttcacgccattctcctgcctcagcctcctgagtaactgggactacaggcgcccaccaccacgcccggctaatttttttgtatttgtagtagagacagggtttcaccacgttagccaggatggtctcgatctcctgacctcgtgatccgcccacctaagtgctgggattacaggtgtgagccaccgcgcccagccaggacttggttattttttcaggtgtatcatctctgatgcctttttcattctttctttttgtagttttagaacaatggccctctaacaatgttttagcctagttatgaagatagctactaattttgggatatattgttaatattgttgaagaaaactaaatattttattttgggtaagttagatgtgtaaaccaaaagtaaaatcctaagcccctcagccaattgaatgcccacccaaggggaccctagagaaacctgaaaaactaaattccaggtcatgactcaaagggaggttggccatccctcattatacccctctcttttgcccaggctggaatgcaggggctcaatcacagcgcagttcagcctagacctcccaggttcaagccatcctcctactcagcctctggagtagctgcgaccacagacacatgccaccacacctgtctcatttttaaattttttgtagagatagtgagtgtgtcactatgttgcccaggctggtcttgaactcctgggctcaagggatcctcctacctcagcttctctctctcttttggagaggggtataatgaggcatggccaacctccctttaagtcatgaccaccattaatgttaaaatggagatcataagactgacaaaagaaactctgacaataagatacgaaattccagctgggcgctgtggctcatgcctgaaatcccagcattttgggagactgaggaaggtggatcacttgaatccaggagttccagagcagcctaggcaacatggtgaaaccccgtctttacaaaaaagacaaaaattagccaagcgaggtgtcacccacctgtagaaccaggtactcgagaggcctgatgtggaggattgcttgagcctgggaggcagaggttgcagtgagatcaagccactgcactctagcctgggcaacagagcaagatcctgtctcaaaaacaaaacaaaacaacccaaagataaccaaattccaacctgactctatctagcatcatatgacacatagcagaccctgaaggaaataaaagtattttaccccaaaatgtatttctttgagatgttttaaaatggccctgcaaagctgtcttttgtgggggaaatttgagtctgtagagaatctccattagtacagacagggctttcccagatctagcagattatctaagagttggataccttttaaggtctgaaaagagatatttaccatctatactcttggttacctggaggcttcatccaaaatttgtaaaccaaaaccaacctgtaacatgagcatctcaggcacaagaacgtgttgagactgttccctgggccatggtcgttcatattgattcaaaataaatctctttaaatattttagagcttgtttttttttttcttcactaggtgtctctctccttgtttttcttagagtttttatttgataaaaacattttttatttttttcttgattttaaaagccataggtcagtatgaaaatggaaacattatagagctgtattataaactcctttgtctcagagttgttgtagaactaaattggagtctgcttgcccagtgcagtagaaccagttatctacactgatatttgcagtcattgaaagaaaggcttttactgcagggtgccaagcaaggaggacgaggcagctgaatgttcaaatcctggcctccccagtggcttgcaggcaagggttttttttttttttttttaagacggagtctcgctctgtcgcccaggctggagtgcagtggcacgatctcggctcactgcaagctccgcctcccgggttcacgccgttctcctgcttcagcctcccaagtagctgggactacaggcgcctgccaccatgcccagctaattttttctattttttagtagagacggggtttcaccgtgttagccagatggtctcgatctcctgacctcgtgatctgcccacctcggcctcccagagtgctgggattacaggcgtgagccaccgcgcccggccaaggcaagggtttttaaaggtatgggtaaatttcaggaaagcaggagctgcaggcaaaattgtgaatcaatacttggaggttacacattgatttaagcctaaaaggaagcgctgtcttgaagtggggtttatgggttgtaggtagatgcaaagattttctgatttgcagttggttaaggaagaaaagctttgtataaaaatttggggtcagtagcaaaatgataactagttagggggagtgactttctttaagcccttcaggaacaaaccttagaaccttagaaagttatgatggttaactttcagtgtttacttccttttttttttttttttttttgagacttagtttcactctgtggcctaggctggagtacagtggtgcaatctctgcttactgtaacctccaccccctgggttcaagtgattctcctgcctcagcctcctgagtagctgggactacaggagcgtgccaccacacctggctgattttttgtatttttagtagagatgggatttcaccatgttagccaggatggtctcaatctcctgacctcatgatcctcccgcctgggcctcccaaagtgctgggattacaggcatgagccaccccacctggccctacatccttttatctaaggtctatgtgtccggtgtggaacctcagtgggtgtctgaatttctgaaagacagctcagggacacattttaagatgttctccttagtttgtgtggggaaagcaaacatctctgtcactgacttctttggctattgttttaggctactgtcttgtttaacaggttgctcagtcacttctagggctagctagggcgctggaattttccttgaaggaactcatattttcctttatttccatgcttggggtctgcaggccctaaaaaaggggtcccggctccatctcagagtcaggtaggcaaatttcttaactttggtagaaaaacgtactttatgtagtaggtgcttaatgaatatttgttgtattaattatgaagagataggttgggcatggtggctcacgcctataatcccagcactttgtgaggctgaggcaggcggatcacctgaggtcaggagtttgagacctgcctggccaacatggtaaaaccccgtctctactaagaatacaaaaattagctgagcgtggtggtccacgcctgtagtcccagctacttgggaggctgaggcaggagaatcacttgaatttgggaggcggaggttgcagtgagccaagatcgtgccactgcactccagcctaggggacagagtgagactccctctcaacaataaataaataaaattaaattaaaaatagaggctgcctattcggacttttttcccccgagacggagtcttgctctgtagcccagggtggagtgcagtgttgcgatctcagctcactgcaacctccgccttccggattcaagcaattctcctgcctcagcctctcgagtagctgggattactggtatgcaccaccatgcccagctaatttttgtatttttagtagagatggggtttcaccatgttggccaggctggtctcggactgctgacctcaggtaatcctcctgccttgacctcccaaagtgctgggattacaggtatgagccactgcattttttgttttttttgtgtttttttttttttttggtgacagtcttgctctgtcgccaggctcaggtgcagtggcactatctcaactcactgcagcctccacctcctgggttcaagcgattctcctgcctcagcctcctgagtagctgggactataggcgcgtgccaccatgcccagctaatttttttgtatttttagtagaaacggggtttcagcatgttggccaagatggtattggtctcctgacctcgtgattcacccgccttggcctcccaaagtgctgggattacaggcatgagccaccgcacccggcctgaagcctcttttaaaagggccttggagccaagcacggtggctcacgcctgtaatcccagcactttcggaggccaaggagggtggatcgcttgagcccaggagttcgagaccagccccggcaacacggcgaaaccctgtctctatgaataaagatacaaacattagctttctgggttgcgtgtgcctgtagtcccagatcctcaggagactgaggtgggaggattgcttgagcccaggaagtggggttgcagtgagctgagatagtgacactgcactctagcctgagtgacagagccagaccttatctccaaaaataaataaataaataaaataggctgagcgtggtggctaatgcctgtaatcccagcactttgggaggccgaagcgggcggatcacccgaggtcaggagttcaagaccagcctgactgacagggagaaacccggtctctactaaaaatacaaaattagctgggcgtggtggcacatgcctgtaatcccagctacttgggagactgaggcaggagaatcacttgaacctgggaggcggaggttgcggtgagctgagatcacaccattgcactccagcttgggcaacaagagcgaaactccgtctcaaaaaaataaataaaaataaataaaataaataaattaaaaaaggccttaatcccattaacaagggagcagctctcatggcctaatcacctgttaaaggcctcacctcttcatactatcacattggcaacacctgaattttggaaaggacacatttaaaccacagcagaaatacaatagaaatttaggagtatcatctgctaaaccaacatccagttttgctgaactctgaggttctgtatgtccaaatacacttgactcttgaaccaagttgggggttaggggcactaattctctgtgtagcagaaaatccacaagtaacttttgactccctgaaaactttactaacagcctactgctgactggaaaccttaccaataacacaaatagttaattaacacatattttgtatgttaaatgtattatatactgtagtctcacaataaagtaagctagagaaaacataatcataagggaaataaaatattattttttgtgtgtgtgagatggagtctcgttctgtcgcccaggctggagtgcagtggtgtgatcttggctcactgcaacctctgcctcccaggttcaagtgattctcctgcctcagcctcccaagtagctgggaccacaggcacccaccaccacgcccggctaatttttgtatttttagtagagacagggtttcaccatattggccaggctggtgtcaaactcctgaccttgtaatccgcctaccttggcctcccaacgtgctgggattgcaggtgtgagccaccgtgcctggctgggaaataaaatatatttatccttcaggaagtggaagtggatcatttaaaaggtctttatgctcatcatcttcacactgagtaggctgaagaggaagaggaggagttggtcttactgtcttggagtggcagaggtggaagaaaatctatgtataagtgtacccacacagttgaaacccatgttgttcaagggtcaaccgtagtgtgtaatccctttctttgttaaatatttaatctaatataccccaccccattttctcacaacatctgtgtgaagtacattctttcccctgcgtattaaaagtagtacattttgaattttatctactagaagaatgtttagtgttttgtggaggattgtcagtctgcccatctagctctgttaactacttagctcagttagttatgagtgtggtgcatttaatgaggccaaagtcattgagttagtctccagaagagcagttattccaattagccttactcgcctcagtttttttttttgtttttttttttttttttgagacagagtctcgctgtgtcgcccaggctggagtgcagtggtgcaatctcagctcactgcaacttctgcctcctgggctcaagtgatcttcctgcctcaacctcccgagtagctgggattacaggtgagtgccaccacgcctggctaatttttgtatttttagtagagacagagtttcactatgttggccaggctggtctcgaactcctgacctcgttatccacccgcctcggcctccgaaagtgctgggattacaggtgtgagccaccacgcctggcctcgacccccttttatgctagcctcagctgaccatcctgctcactagtacactgtgggtcatagggggccaaaaacatgaggctggtaacattccatccctgttattcatagatgatatttaagttaatggttgtttttttattgaatacatttcaatgccaggtattagatggtattatccccatgttggagattaggaaactaaagtgcagagagtttgaataacatgcccgagactataaagcaagaattggaagcctgttctccctgtctctaaagtcttctacttttgtgttattgaaagaccaacttagtgatggggcacttgtttgcaaagatgtgtaagtgagacagtcactgtccttaaggggctcatagtcttctgaggggttaggcgtgtaagccaataatgacaatgcactgtgataaatgatataacgaaggtatgtttataattgagagtgagtgtcttgcaatcagtgattgtctagaagatctcaaagttagttttctctgttttttattccctccttcagctcttatttactgagttcccgttatttactagtcactattttaggttcttaagacacatcaatgagtgaaactgcctttgtgaagctttggttttagtggagggagacattgaaaaataaacataatgaaccagtaatttacatagtatgttaggaagtgaaaagtgctgtggaaacagtaaacagggttaatgggatcaggaatgttagggcagggtggagacagatgttgtacttttttttttttttttttttttgagacggagtttcgctcatgttgcccaggctggagcgcaatggtgcaatctctgctcaccacaacctccacctcccagattcaagcgattctcctgcctcagcctcccgaatagctaggattacaggcatgcgccaccatgcccggctaattttgtaattttagtagagatggggtttctccacatttatcaggctggtattgaacttccgacctcaggtgatccgcccgccttggcctcccaaagtgctgggattacaggcgtgagccaccgcgcccagctgatgttgtacttttaataggatggtcagggtatacctcactgagaggatgacaatttcaggagaattctaaggagtcaaaggagtgagccatatgtatatgtggagaaacgtatttcaggcagagagaagagcctgtgcgagggccataagctaggagtatacttgatgtattagaattgtttacaatgttactgaggttggaggtagtaagtgaggggacaagtggtgggaagatgagattagagaggaagggagagggagtgtgggggaaagatgtagggctttataggccagtggttctcgttgtctggtctctggaccagtagtatcagcatcacctgagaacttcttagaaatgtacattttaaccccaccctttacccgctgaatcataaactctggggatggggcctagaaacctgtatgttaacaagccactgtcctgatgcatactaaggtttgagaaccacagttttggctactgtaagagttttaatgttacgcacctacatgactgcaaattcttaggactgatgtagctttaagttcagtacccgaataactgtagagctttggctttagagtctttcagttctggtttcaaattatggcttcctcactttctagttatggggacttggatcagcttgtgaggattacatgaggggaagaatacacaaacatcacacacagacatgcacatacacagacagagttactagggaagatgagtctctgtcaagacaactattcacatgaaagaacttccaaattttggactgcttaagtttagaagttgaattattagctggttgttaacatacctcataccacatctatcagccacattttttgtttctacttgaggttttgtgatcctgtcatgggtagttgcctgtcaggaataaaatcaacacctataacccctatcagggtctatgttgagtgctagagaagagaagggcaggcacactgaaacaaggcaggaaaggatcagttcttcagttctttttttttgttttgagacagggtctcactctgttgcccaggctggagtacggtggcaccatctcagctcactgcaaactctgcctccagggctcaagtgatcctcccacctcatcgtcctgagtagctgcgactacaggcaggtgccaccaatcctgtatattttttgtcttttttctagcgatgggttttcaccacgttgcccaggctggtctctaactcctggactcaagtaatttgcctgctttggcctcccaaagtgttgggattacaggcgagtgcccctgcgcccagtcaggatcagtttttgtttgtttgtttgtttttgagacggagttttcactcttgtcgcccagggtggagtgcaatggtgcaaccttggctcactgcaacctccacctcccgggttcaagcgattctccagcctcagcctcaacgagtagctgggattacaggtgctcaccacaacgcctggttaatttttgtatttttagtagagatggggtttcaccatgttggccaggctggtctcaaactcctgaccagccttggcctcccaaaatgctgggattacagacgtgagccaccacgcccagcctaggatcagttctttaaaaggaacagatgatggtgtgttgttggggttcaagagagggaaagagtactattatctagctttgcagtttatgtcttggaaaatttactatagagggcgtagctctgggtgtgaccctgaacaaaaacataatctctatgatttattcattgattaatttaataatcacttaatatgtggaaaaatacccgagggactatacataaattatagaatctgagggttgaaagagagggacacaactagaaagtgagggaaccatgatttgaactcttgggataggaaagaaacatgaaggtcatccatataaggaatggcatttttctctctttaaaaataaaacgttggccaggcatggtagcacatgcctgtaatcccagcactttgggaggcagaggcaggaggatggcttgagcccaggatttcgagaccagcctgggcaacatagcaagacctcgtctctacaaaaaatgaaaagctgagtgtagtggtgcatgcctgtagtctcagctacttgggaggcggaggcaggaggatggcttgagcccaggatttcgagaccagcctgggcaacatagcaagaccttgtctctacaaaaaataaaaagctgagtgtagtggtgcatgcctgtagtctcagctacttgggaggctgaggcaggaggattgcttgagtctgaggggttgaggctgccgtgagtcatgatgacaccactgtactccagcctgggcaactgaacaagaccctgtctcaaaaaaaaaaaaaaaaaaagtttagccaggtgtggtggtgtgcacttgtagtcccagctacttgggaggctgaggcaggaagattgcttgagcccgtgaatttgagtccagcgtgggcaacgttgtgaggctcctgtctcttaaataaataaataaataaataaaatgttgagttttaaaatacagtttctaatagaaaacttagaaattgtagaaggatgtaggccgggcgcagtggctcacacctgtaatcccagcattttggaaggctgaggtgggcagatcacctgaggtcaggagtgcaagaccagcctggccaacatggtgaaacctggtctctactaaaaatacaaaaattagccgggtgtggtggcgtgcacctgtaatcctagctactcaggaagctgaggcaggaggatcgtctgaacccaggaggcggaaattgcaatgagccgagatcaagccactgcactccatcctgggcaacaagagtgaaaattaggtgtcaaaaaaaaaaaaaagaaaaaagaaattatagaaggatgtggaaataattcactcattatccctttatctggaattaggctttataagcatgttgatgcctttatatagttcctttcagttaaaaaatatttttgggccgggcacagtggctcacacctgtaatctcagcactttgggaggccgaggcgggcggatcacaaggtcaggagatcgagaccatcctggctaacatggtgaaaccccatctactaaaaatataaaaaattagccaggcttggtggcgggcgcctgtggtcccagctactcgggaagctgatgcaggagaatggcgtgaacccgggaagcagaggttgcagtgagccgagatggcgccactgcagcctaggtgacagagcgcgactgcatctcaaaaaaaaaaaaagtaatttaaagacagtaaagtgcacaaattctaagtatataagtatatagcttaatatatatatatacacacacacacatgcatttaatcatcacccagatcagttctttccagattttactatgtgtaggtgtatgtgtatatattttaacagagtgataatgtgtaatgtaaaattttgttttgacttttttcacttgatgttctatcatgaatatttcttgatactgtatcgtgagtatgctcctgaaattccatcgatcttagttaagagttaattataaggagcagagacccactcaaaaaacccactcaagttgaattcatatcaaattaacatgttgtatatgagataacagacaacatcttaaaagatgatcccacatcaaaacaaagatctttctggtggacccgtggagtatttaagatttttcttttttcaaatatccatgtacacttatttttacacacttgtaggggtttttctggagcattaattgctaaaactggactttggtgaatccaagaaatgtactttttttttgaaatggagcctcgctctgtcgcccaggctgaaatgcagtggtgtaatctcggctcactgcaacctctgcttcctgggttcaagcgattctactgcctaagcctccctagtagctggggctacaggtgcttgccaccacgcccggctaatttttgtattttgagtagagacggggtttcaagttggtcaggctggtctcgaactcctgatctcaggtgatctgtctgcctcggcctcccaaagtgctgggattacaggcatgtgccacactgcacctggcccaagaaatgtgcattttaaattttaatagatattgctaaattactttccttaaaaattgtgccaatttagacctctgctagtaatgtttaacattccagtttctttatacctgtaataaagtgttaccgcttttctgaaacgtttccaatctgctaggaagaacatatctttttttctggagacggagtttcactcttactgcccaggctggagtgcagtggtacaatcttgcctcactgcaacctctgcctcctgggttcaagagctattctcctgcctcagcctcccaagtagctgggattacaggcgtgtgccaccacacccctggctaattttttgtatttttagtagagacggggttttaccatgttggtcaggctggtcttgtactcctgacctcaggtgatctgcccatctcttcctcccaaagtgttgggattacaggcgtgagccaccgtgccggcccaaacatatcttgttttaatctgaatttaattattaggctgaacatcttttcatatagttcatatacatttgtttattctatgaattgtctgttcaggccttttgtccatatttctgttgtggtgtttatctttttttctgattgatttgtggaaactctttttctgttacgaatattttgttgtatgtgttctaaatatatttctgtgcattaaaaacaggttgtcaggaaatatatcaaaacttcaaacatagtcacaatgaaataatatatacatacacataatatatatttataaaattgggatcatcagagaaatacaattttgtatcctttgcctgcctgcctgtcttccttccttccttcctttttgctctcactctctcttccttttcatctttttctttttctttctttcgaggcagaggtcttgctttgttgcccaggctggtctcaaactcctgggctcaagcagtcttcttgccttagcctcccgagtagctgagattacagggttgtgcccaatgcctagcttgtgtcttccatttttaatttactatttaaaaatgctaaatatttcttttttttttctttctttttttgaggtggtgttttgctcttgtcgcccaggctggagtgcagtggtgcaattttggctcaccacaacctctgcctcctgggtttgagcaattctcctgcctcagcttcctgagtagctgggattacaggtgcccgtcaccatgcccagttaattgttgcatttttagtagagacagggtttcgccatattggccaggctgatctcgaactcctgacctcaggtgatacgcctgcctcggcctcccaaagtgctgggattataggcacgagccactgcgcccagcgaactttatttgttttttttttttttttgagacagggtctccctctgttgcccaggctggagtgcagtggtgcaaacatggctcactgcagcctcgacctcctgggctcatgtgatcctcttgcctcagcctcctgagtagctgggactactgggctaatttttaaattttttgtagagatggattctcaccttgttgcttaggctggtcttgacctcctggtctcaagcagtcctcttgtcttgtcctcccaaagtgctgagattacaggtatgagccactgcacctagcccgtttaaaaatgtgtaattcagtggtgtttagtatatttatggttttgtgtagccatcagcatcatgtagtttcagaacattttcatctcctcaaaagaaaatgctgcactcattaaacagttacttctcatttccttgtctcccaagcctgtggcaactagtagtctgctttctctctctggatttacctattctggatgtttcatgtaagtggaatcatgcaacatgtggccttttgtgtttggcttttgtgtctggctcctttcaggtagcgtgattttttttcttttttttttttttgagacagagtcttgctctgtcgcccaggctggagtgcagtggcgcgatctcagctcactgcaacctccatctcctgggttcaaacaattctcctatcttagcctcctgagtagctgggattacaggtgcccgccatcgtgcccagctaatttttgtatttttagtagagacagggttttaccacattggccagctggtcccgaacttctgacctccagtgatctgcccatcttggcctcccaaagtgctgggattacaggcgtgagccaccccgcccagcctagcaggatgtttttaaggttcatccatgttgtagcatgtgtcagcaccttattccttgttatggctgaataatattgtattattgggatatttatatggtatgaataatacgtaccatattttgttccttcatctgttgatggacactggggttgtttccactttttgcctgttgtgaatagtgctgctatgaacattcatgtacaagtttctgtctgaacacctgtttatgtatatatccaagaatggaattgatgggtcatatagtaactctgaactttatagtaactttaagaaactgccaaaatgtcttcacagcagtgcatcattttacattctcactagcaatgtttcaggtttgcggatgccagctgggtcagggagaccctaacccagcggcgctagaggagtaaaagacacacacacagaaatatagaggtatggagtgggaaatcgggagtctcacagctttcagagctgagagccttgaacagagatttacccgcgcctttattaacagcaagccagtgataagcattgtttctgtaggttatagattaactagcagtattccttatgggaaataaagggatgggccgaaataaagggatgggttcggctagttatctacagcaggagcacgtccttaaggcacagatcgctcatgctattgtttgtggtttaagaatgcctttaagcggttttctgccctgggtgggccaggtgttccttgccctcattctggtaaacccgtaacctttagcgtgggcgtcagggccatcgcgaacatgtcacagtgctgcagagattttgtttatggccagttttggggccagtttatggccagattttggggggcctgttcccaacaaggtttccactttctccatatcctcattaatacttgtttttcattttttgctgtcgtcgtgttttaatctgtatttcgttgactactactcaagtagattgaaaaaaaattactcattctttatattggtattgtgaattgtctgtatactggttataatttctctttttgctcatttttttgggggggggatcggtgggaaagattgaggtttgggcacttttgaatctctctttcttaggaaagctggtgagtttgctacagaattggggtgagtaaaggaatgtggtttggagggtatattagttgcctttttttttttttttgagacggagttttgctctgttgcccaggctgggggtgcagtggcacgatcatggctcagtgcagcctccgcctcctggattcaagccattctcctgcctcagcctcccgagtagctgggactacaggcatgtgctaccatgcccggctaatttttgtatttttagtagagacggggtttcaccatgttggccaggctggtctcgaactcctgacctcaagtgatccacccacctcggcctcccaaagtgctgggattacaggcctgagccactgcacccagcctatattagtttactgtggctgtggcaacaaattaccacaaactgggtggcttaaaacaacaataatttattttctcacagttttggaggacagaaatccaaaatcagggtgtcagcagggcacaccccctcagaggctcttggggagaataattccttgagcttctggtgactgttggcattatgctttggtttctgactacaccaccctaatcgctgcttctgtcttctcattgccttcaccttcatgtgtatcttttcctctgtgtctattattttagggatacctatcatggtattttgggtacactcaactactccaggatgatctcatctcaatatttttgactacatctgtaagatcctttttccaagtaagataacattcatagcttctggagattaggatgtggacataccttttttggggccaccattcaacccactccagagggtctaaagggtgggtcttgaatttctttttttttttttttttttgagacagagtctcgctctgtcgcccaggctagagtgcaatggcgcgatctcagctcactccaacctctgcctcctgggttcaaacaattctcctgcctcagcctcctgagtagctgggattacaggcacccaccaccatgtccagttaatttttgtatttttagtagaggcgaggtttcacgatgctggccaggctggtctcgaactcctgacctcgtgatccgcctgcctcggcttcccaaagtgttgggattataggcgtgagcccctgcgactggctgtcttgaatttcttaggatgtgagcaagaagtagtctacttcagtcactatttgccttcccactcaccacaggtaaccagtattttgacttctaacagcatagtttttcatgtctttgtactttatataaatgtaattatatatggtgaactcttgtgtttggattcttttgtacaatatatttgagaggttcattcatattgtgtatagttttaggttggtcgttctcactgctgtagagtttgccattgtgtgactttaccacaccttatctgttaattctgcagttgataggctcatgggtagtttgtagtttttgagtattacaatagtgacatgttatgaacattcctgtatgtgccttttcgtgaacatggcttttggtctgttgggtatatgctcaggagtggaattgctgggtcataggtatacgcatgttcagctttagtaggtgctgccagacagttttccatagtgattgtaccagtttacattcccacttgcagtgcacgacagtgtaggttactccctatccttaccaactcttggcattttcttttcattttagctattctggtggttatataatagtattgtattatttaaatttgaattttctggatgactaatgaagttgagcacctctcaaaagtttattaggcatttatatgtcttttttgaagtatctattcagggcttttgctgtttttctttgagtgatctttttttctttattgatttaatgcagttctttatatgttctagatatgtcttttttgttcatttcatatatatatagtgcaaatatattcttgtaatctgtgcgttttcattcttttaatggcgactttcaaggaacaaaagttttaaattgtaatgtacaatttatacgtttttctctcttaatgtttagtgcattttatatctttgttattgcaggatcatgaagatgttctgtgttttcttctaaaggctttatttttttacctttcatatttagatctacagtcctagggctaattaattttcttaaacagtctgctgttaacactactctgtactgcctgaaaaaaagcttccccatttttttttcttggccgtttttcagcattctgcaagtgaaagagaaacattaccattgctgtcacagctgggcctgaagtacaaaaaggctttgatatgaccaatacagtgcttttaatgcagatttgataaaacaaatgctagtctttgtgctttgatatagtaccagttggtaaaattttagtggttaggaaagtctgttaaaaaaaaagagagagaatttattactataaaagttcttaaaagtaaaggaaactttctcttatgttactgagggtaaactaacaggaagctcccagagtctttttttttttttttttgagacggagtttcgctcttgttgcccaggctggaatgcaatggcgcgatctcggctcactgcaacctctgcctcctgggttcaagtgattctcttgcctcagtctcctgagtagctaggattacaggcatgcgccaccactccctgcaacttttgtatttttagtagagatggagtttctctatgttggtcaggctggtctccaactcccgacctcaggtgatctgcctgcctctgcctcccaaagtgctgggattacaggcgtgagccaccgcgcccagcctggctcccagagtcttaaatctgcttatgtgctatggggaagaagaggctgctgggtggtcccttataagttgtggtttgaaatctgaatttgcggacttgtcagtgttcttagtatagccacgtttgctgctgtgggctctgccgtggtatacattctgtgaaacagatatgtgttgccactttagtgcagtagaggtttgcatgttaggaaacatttggtaacttctagcacatttatgtgtcctgttttcatggctaaagattttgagataactcttgcatgtatgacagaccttttggaaagaaaggagctaatatttgttgagtacctcttatgctcaatacaaatgtgtcccatatgctttacatatgttaactcattcattcctctcaataggctgatgaggtaggtagttttttgggttttttttgtttgtttgttttgtttttgacagagggtcttgctctgtcacccaggctagagtgcacgctaactgctcactgcagtctagacctccaggcttaagtgatcttcccatctcagcctccctagcagctgggactacaaatgtgtgccaccatgcctaatttttctatttctttgtagagaccggtctccctatgttgtctgggctagtcttgaactcctaggctcaggtgatctacccgccttggcctcccaaaattctgggattacagatgtgagccactgtgcctggcttaggtattgttctcctcatgttatagatgaagaaattgagatttatggaaaagatgcccttagtgtttctacagtaagggcagaaagatgtgatacctttcctcacccatcttaaggttcaatggctgacacttctgcaacaaaagacaaattaacaagaagaaagcataagaggctgggtgtggctcacacttgtaatcccagctctttgggaggctgtgctgggaggattgcttaagcccaggagtttgagaccagcctgggaaaaacggtgagaacctgtctgcaaaaaatttttaaaaattagcctggcgtggtggagcatacctatagtcccagctacttgggaggctaaggtgggtggatcgcttgagctcagaaggttgagattgtagtgagctctgtttgcaccactgcactttggcctgggtgaaaaagtgagacttgtctcaaaaaaaaaaaaaaaaaaaaaaaaaaaaagcattagttttacatgaaatggggccgggcgcggtggctcatgcctgtaatcccagcactttgggaggctgacacgggtggatcacgaggtcaggagatcgagaccatcctggctaacacggtgaaaccccgtctctactaaaaatacaaaaaaattagctggacgtggtggcaggcgcctgtagtcccacccagctactcgggaggctgaggcaggagaatggcgtgaacccgggaggtggagcttgcaaggagctgagatcacaccactgcactctagcctgggtgacagagcaagactgtctcaaaaaaaaaaaaaaaaaaaaaaaaagaaatgggagctttcagaaatgaagacccaaagacctagggaaaactgtttttatgcttaggctcaatgaagaatgaagaaagggagaggcctgtagaaatgttagtagacaaagggtgttatctaatggtaatagactgggtggggcagggggacccagcaaggcctgtctgttcagattcttcttggactctgtgcagcattccttcttcctgggtatagggcaggaccccgctggagctgagggtcttcaaggaaaaggggagagagtgacatttttaggtattatggcttactttgggggagaggtatatgtttgagtaggaggtaatactttttaggtattatggcttgcttttctattatctgtgacccgccttggggaaagggggattctggtttctatgacttgctttgggggagtaagaggagtgagacaggagggcaaggagagactttgcttctgaggctatttctgaggtcttccggtctcctttagttcataatactcagcatgtcaaggtgtcttacttaggggtatcattttttgagcctcaataccatgcattacacctctgacaccaaatgtgtggttttttccccacatttgtaacttggccaaggtctctgtgataaatgcatatttgggccaggcgcagtggctcatgcctgtaatctaacactatgctaaccaattctgtaactctctggttaccagctgggtgtcctgcaattcaattcaattgttattattatttttttccaattcagttcaattctgacactaactgcctaggcttagtgcacactccacaggttaagtgcttagtctcacaagactgtccccacttcagatgccagtaaagtcccagattgccgcccgtctgtactttgaccaacctgctataagtcaggggttcccatgaccccttcctaagtttgcataatttgccagaatggctcatagaactctggaaagtactttacttactattacccatttattataaaggatataactcaggaacagccaagtggaagagatggatggggcaagtttgcggcaagatgtgtgtgtggagccttcgtgctcacgctgagtgcaccattctgcaatacttaagtgtgttcatcaacccagaaggtccctgaaccctgttgtttatgttttttttttttttgagacggtgtctcactctgctgcccaggctggagtgcagtggtgcgatctcggctcactgcaacctctgcctcccgggttcaagtgattcttctgccgcatgccaccacacccggctaatttttgtatttttaatagaaatggggtttcactatgttgttcaggctggtctcgaactcctgacctcaggtgatctacctgcgttggcctcccaaagtgccaggattgcaagcatgagccaccgcacctggccttatgggttttcaaagtggagttttcattactgtgttggcacgattttgaaataattgctcactggtgattaactcacttcagcgtctctctcctctctgcaggtggtggtggggagctgaaagtttcaatcctgtaatcatccttggtctttctggtgaccagccaccatccttaagctattagcttaagctatttagtaggtattaagccactaaattagtggccctggtcaccagtcatgtcattagcatacaaacgctgtgctcatctgggagattccaaaggttttaggagctgcatgccagtaaccagggactaagaccaaatgtaagttttttttttttttttttttttgagatggagtcttgctatcgcccaggctggagtgcaatggtataatctcccctcactgcaacctccgcctcctgggttcaaatgattctcctgcttcaggctcccaagtagctgggattacaggcatgcaccaccatgcccggctaattttttgtatttttagtagagacagggtttcaccatgttggccaggttggtctcgaacccctgacctcgtgattcgccacccgcccccacggcctcccaaagtgctgggatttacaagcgtgagccacagtgcctggcctcattttttttttaatttaaattttttatttttgtagagatggtatcttgctatgttgcccaggctggtcttgaactggcgtcaggtgatcctcccatcttggcctcccatagtgttagattacaggcatgagccactgcacctggcccaaatatgcatttttcacagagaccttggacaagttacctagaagaaattaaacaaaacatggaactaatatttgagttctaaattttcctgtctttaaagtcctgtgccttccactatagtgtatgtaacacagaatatactgcactaccttcccagcttcatctggatgagatgccctttcagatttgaggggactcctttgcctagagaaggaggtacacatttactaaaatgtgctcatgcgttccaggagttactggtttttaattataaatttgtatgtttccatagcacttaacatggagttgtatagatagttggaactcaatagaaaagtgatggattagttgtttgagtgatcgtaatgtaataatgtagcaaaacggctcaatgtggggtagataaggtctttataagtcccatggtgattgagtggagaaaatatcactctgtgcttgcttgcttatttatttatttatttatttatttatttatttatttattttgagatggagtttcactcttgttgcccaggctggagtacaatggcgtgatctcaccttactgtaacctctgcctcccgggttcaagcgattctcctgcttcagcctctggagtatctgggattacaggcatgtgctaccatgcccggctaattttgtatttttagtagagacagggtttctccatgttggtcaccctggtctcgaactcctgacctcaggtgatctgcccgccttggcctcccaaagtgctgggattacaggtgtgagtcaccactctcgtccttgtgcttattttcatagcttggatttattgacagggtgtgagtatgatgtgaggttttgggtgaattgttttgagtcttgcacattcagtaatatttgtaggacatggtgatgaattatggggaaattttcaccttaaggaagtatgttaattttcacaactcttgtttagcttactttagatcggtcagtttggtttttgccactgtggtaagaagagctctgttataattagcatctctgcttcctcttacagttttatgaatttaaaaaaaaggaaaactttattgtgttaaataattcttcaagaagagtattttatgttgggtgatactctaaatgtgaaatcccaaataaccacatttgaaaaacaaaaacaaaaacaaaaaaccttgaagattgaaatagccccagaaacttttttttcccattgtcaaggtaaattatatatagattggaaaggatagaacaaatcgattaagaggagactgaaattgagatcattactcatttatacaggatcatttaattgctctgaatgagagtctcctgacccagacaaattataccgtagggttctagataattttgggatgagatcattcagtagatgtcaataacctttgaggaatcatagaattaccacaagaagacataatctcaaaactgggaagaaggtaacagcatgacatgttccagtcaaaatctagaatagcttattaatgatataatctgagggtttagaaaaagacctgattgatgataatggtgatgatgatgatgataatgatgatgatgatgatttttgagacagggtctcactctgttgcccaggctggagtgcagtggcatgagcacagctcattgcagccttgacctccctggctcaatcagtcctcccacctcagccttccaggtagctggggcctaggcacatgccaacatactcagctaatttatttgttgtagagatagggtcttgctatgttgtccaggctggtcttgacctcctgggctcaagcaatccactcaacttggcctcccaaagtgctgggattacaggcatgaaccacggcacctggccaaaactattattgttattattattacttatatatattttttgagacagagtcttgctctgttgcccaggctggagtagagtggcgtgatcttggttcactgtaacttccacctcccaggttcaagtgattcccctgcctcagccacccgagtagccagattataggtatgtgctaccatgcccggctgattttttttgtatttttagtagagacagggttttaccacgttggctaggctgttctcgaaatcctgaccacaagtgatcggctggcttcagcctcccaagcattgggattacaggcgtgagccaccgtgcccgccccaaaactattattattaagagccaacatctgcccactaagaatatgttaggttacactaaccatgtgttcattcaggtgagtacatggatagaacggggaatactgtgagctaccatttttggattcaagaatgtttcacaggaatgactaggatatagttgggaataagagagaaatttaagctatatgatgaaataaatgatgcagaagtagaggttataggaagaagatgtgagctaatatcaacactttttaaaaaatgtaacacttttagttggctgcgagtttgatttatggcaaaagcgtgatttagttgccaaaaattgtgatttttagttgcaattctagagatacattgtcaaaaaagagggagtggatagtcctgttttaaattgtgttattaagtagttagattacacatagagttagacgtcggttctagggactaggattgtgagggaactgaaaaccatgtcatatgaactacattcaaaggagcagatttgttttataaccagtaaatggctctgaccctagcactcacagaaaatttccagaagaacttggggatgggaaaatgaaaacgttgggatactgtggattttttttttttttttttttggatggagtcttgctctgttgcccaggctggagtgcagtggcgcgatcttggctcactgcaacctctgcctcccaggttcaagcgattctcttgcctcagcctcctgagtggctgggattacaggcgcgcgccaccacgcccggctgtttttgtatttttagtaaagacgggttttcaccatgtcagtcaggctggtctcgaactcctgacctcgtgatctgcctgcctcagcctcccaaagtgctgggattataggtgtgagccaccgcactgggcaccatggattttcatagcactcacttgaataaaagtagattggctaatcaggtgaagaagggtataaaggttattctaagcagagaataacatctaacaaagaatgaaagcacgaaaaagcatgccctgtttggggaactcaagtgaatcaatgtattagagggagaaagcaggtgttgggaggtgagactaggaatgttggcaggtgccttatatgcagatggagaaactggagcccaggaagataaagtgatttgcgtaaggcttgagatatgttgaatcatgctagacccccaagctttctcacttcccttcaagagttctctccttcttcccttcctttaggcatgttgttttaggcttatgttttattttactttattttttgagatggagtcttgctctgtcgcccaggctggagtgaatggcgtgatctcggctcactgcaacctctgcctcccaggttcaagcgattctcctgcctcagcctccctagtagttgggattacaggcatgcgccaccacacctggctaatttttgtatttttttagtagagacagggttttgccatgttggccaggctggtcttgaactcctgacctcaggtgatccgcccactgcggcctcccaaagtgctgggattacaggcatgagccaccacacctgaccgttctaggtttatttttaaatggtcagggcatgccctctgtttatgaaaggattctaaataacaatcacagaggactatcttttatattctttagcaagctaaataatttattggaaaagctgtaacctacaggcaataggttgaaggatattaacattcccaggtaccactgtcagatgttacgctttttttctctcttgcttgctctgttgcccagactggagtgcagtggtgtgatcatagctcaccgtagcctcagtctccctggctcgagcaatcctcccacctcagcctcccaagtagctgggacctcaggtgtggtgccatcacaccctgctaatttaatttttttaattaattaatttttttgagatggagtctcgctctgttgcccaggctggagtgcaatggtgagatcttggctcactgcaacctccacttcccaggttcaagtgtttctcttgcctcagcctcccaagtagctgcgattacaggtacctgccatcatgcctggctaatttttgtatttttagtagagatggggttttcaccatgttggccaggctggtcttaaactcctgacctccgcctgccttggcctattctgcccacctcagcctcccaaagtgctgggattacaggcgtgagaccccgcacccagccttaattttttttttcttttggtaaagatgatgtcttgctatgttgcttcggctggtcttgaactcctcagctcaagtgatcttcttgtctcagctcccaaagtgctgggattacaggcatgagccaccgcgcccagccggctattacagttttaactttcagagacaagcagcttgtattctagatcattctacaatcaagaactctttctactttaccatgctaattgcttcaaaaaggattctttctttgactagttcaaatgatagatgcagggatgatcagttacagctatagtgatttagcagttaatagctatgtctggtagaaggtaggctatagcaagagcttgtggcaactttgcttctaactgatgtagttgcagcttattgctccactgcaggcagcgttgaatttcagcatggaaagcacgttcttgaggcctctttgcttttcctcagtcaaggctgtatccagggttgatatctagcctatatgccatatgtgtatggctagtgtttgttctgattggttggtgctcacactgcccagattgttaaatattttgaaaatcgtatctggttctattcatctgcattctctgatcttatgtctggctctatttatccctattctctgatcttatgtcagacctgaagttcctctaatttttctgtggtgtatttatagggaaaaattgcctttttttcttctaatgctcttaagcaacttcatataaaaaagttcctggaaacattaaatttttcttttactattacaggccattatacagtattttaagtctacttagtgatctaaaaggtttcaaacatttatgaataaactaaagaaatttgaacactgactagatttttggcattaggatttttttggtcaaatttttctaggtataataatagtattgaggttatgttaaaaaagatactgtcttttagagagacatgctgaaatattataaataaaatgatatgtttggatttgctttaaaataatctggcatgaggatatacaagtaaagcaagattagccatgcattgataattgctaaagctaggtgatagatacatggcagttcattgtactttttatgataaaatgttagaaaaagctcatgtcctcttaaaagacccctgcatttgtaaaattataattggatattaaaaattcttgccaagcgcagtggctcacgcctgtaatcccagcactttgggaggccaaggtgggcggatcatgaggtcaggagatcaagaccatcctggccaacactgtgaaacctcatctctactaaaaatataaaaaattagccgggcgtggtggcatgcacctgtagttccagctatttgggaggctgagtcaggagaattacttgaacctgggaggcagaggttgcagtgagccaagatcgcaccactgtactccggcctgggtgacagagcaagactccatcttaaaaaaaagaaaacaacaacaacaacaacaaaattctcaattagttgaagacattattggcaattataacttctgatttccttgtaataactagaaatatacatggggttggctgggcgcggtggctcacgcctgtaatcccagcagtttgggaggccgaggcagaccgattgcctgaggtcaggagttcaagaccagcctggctaacatggtgaaaccccatctctactaaaaatacaaaaattagccaggccaggcgcagttgctcatgcctgtaatgccagcactgaatgggttgggacctattcagtgttttttttgttgctgttgtttgtttgtttgtttgagatggagtcttgctctgtcatccaggctggagtgaggtggcgctatctcggctcactacaacctctgcctcccaggttcaagagattcttctgcctcagcctcctgagtagctgagactacaggcactcgccaccatgcccggctaatttttgtatttttagtagagacagggtttcaccatgttggccaggctggtcttgaactcctgacttcaggtgatccacctgccttggcctcccaaagtgctaggattacaggcgtgagccaccgtgtccagccgattgaatgttttaatctctgattctgataccaaagttttttgttttttgggtttgtattctttttttagacagtgtcttgctctctcatccaggttggagctcaatggcgccatctcggctcacggcaacctctgcctcctgggctcaagcagtcctcccacctcagcctcccaagtagctgagtctacaggcacccgccactatgcctggctaatttatgtgtgtgtgtgtacacacacacactttttttttttgagacagagtctcgctttgtcgcccaagctggagtgcagtggtgcgatctcagcttactgcaacctctgcctcccaggttcaagcaattctcgtacctcagcctccccagtagctgggattacaggtacccaccaccatgcctggctaatttttttatttttagaagagactgggttttgccatgttagccaggctggtctggaactcctgacctcaggtaatctaaccccctcagcctcccaaagtgctgggattataggtgtgagccacctgtgcccggccggtattttcattcatatttttttccatgttgaattattattattattattattattatttttgagacagagtttcgctcttgttgcctatactggagtgcaatggcatgatcttggctcactgcaacttccacctcctgggttcaagtgattctcctgcctcagcttcccaagtagctgggattacgggcatgtgccaccacgcccggctaattttgtatttttagtagagacagggtttctccatgttggtcagactggtcttgaactcctgacctcaggtgatctgcccgcgtcggcctcccaaagtgttgggattacaggcatgagccactgtgcctggcccgaattatttttaaatatcatacattgcaagcaaactatcattttttgcaatttataagaaagttatgccacaggcgtttaagcacatctattttttttgcttttagtgttctttgtcctgctttaattttttagtatgatttttcttatataccaccttgttttttgacataggtgggacataaatcacaaattgaaaaaacaaaacaaaaccaatctctcttcagaatgttttgaggagtaaggtattaagcttcatttgaatcaaattccctgggcttctagagtgctttaactgagcccctttcctttctttctaaatgatgatatccaatcagaaaaaatgtgttaatctactgcattactccacattctttgtctctgagatttgcaacatctgaaaaatttctttttgttatagaagtctgttgtggtttgtcccttgtgcaagacctgtaatggacaccttaaagcagtggcttaaagtattttttggctcacagatcccttggaaaatatgatgcaagctgtggattcttgcctgagccccatcaatctggattatttgaggtgttggcctgccaggcctattgcactaaaatcttgggatgtcccctcaccttatcttggagttatcctctgtcactttctcgtgatggctccagtttcctccatcccatatgtaagtcgtttttttttgttaattctcgttttggcagagcatatgcttcctgagaaaggattcatagaaaatacattctttttttgagattacatgtttgaaatttctttcttttactctcttattatttggctgagtatataattctaactggaaataattttcccacagaattttgaggacattgcctcattgtctgctagattccagtgttgctattgagaaatccagtgctattcagatatctttccttggtaaatttgtttcttcctggaaacatctagaattttctcattgtccctggcattctgaaattacatcatgacgtgtcttggtgtgggtctgttttcatccattgtgctagatccttgaagagcactttcagtttggaagttcatgcctgtcatttctgggaaactttattattttgttgataatttcctcccctttattttttctcttcgctttttatggtatacttttatttgggttttagacctcttggatggactctaattttattatttcttaaataaataaataaatttatttcatttatttgtttatttatttttttgagatggagtttcattcttgttgcccaggctggagtgcagtggcgcgatcttggcttactgcaacctccacctcccgggttcaagcgattctcctgcctcagcctcccaagtagctgggattacaggcatgtgccactacgcctggctaatttttatttttttagtagaggtggggtttcaccatgttggctagcttggtcttgcactcctgacctcaggtgatccacctgtctcagcctcctgaagtgctgggattacaggcgtgagccaccacgccggcccaatacatttatttttgagacaaagtttcactctgtcacccagctggagtgcagtgacacgatcacagctcactctaaccttcatctcccgggctctagcgatcttcccacctcagcctactacaggcacactccaccacacccagctaatttttgtatttttagtagacaggatttcgccatgttgcacagactggtctcaaactcctgggcttaagtgatccactcccctcggcctcccaaagagctgggagccactgcatcccgcctaagcatgagctgagcctaagcatgagccactgtacccagactaattttattactattttttctctaattttatttattttgtcctacttctgaggatatttcctcaaatctatttgctaactcttctgttgagttttaaatttttctgacaccattttaatttccacaagcttgttttttttttgtttatttttttgagacggggtcttgctctgtcacccagcctggagtgcagtggtgctatctcagctcactgcagcctctgcctcctgagctcatgcagtcctcctgcctcagcctcctgagtagctgagactactggtgggcaccaccatgcctggctaatcttttaattattattttgtacagatggggtcttgccatgttgcccaggttggtcttgaactcctggactcaaacaatctctacccaccttggtgctgagattacaggcatgagccactgcccagccttgttttattttctgaatattcttttaaaacaacagtctattcttgttttatgtatacaatgtcatcttttatctctgcatatcttttatctgtgataataatttttgtgtgtgggaaaagatactttgttggaaatgacacatgctttgacagtaggagactgtattttactagcatgccaaatttcttttgttgtttgtccttttattttttaaatcactttatgaagatatactttacatagcctagtttacctgcttacagtatacaatttctgttttttaatgtatttgcagagttgtgcaatcgttaccataatttaattttagaatattttaatcactttaaaaagaaactttgtactaattagcagtcactctgtatcccctcatcccaggtaaacactaatctactttctgtctccatacgtaggccttttctgggcaattaattaattaattaatttgagacggaatttttgctcttattgcccaggctggagtgcagtggtgagatctcggctcactgcaccctctgcctcctgggttctagctattctcctgcctcagcttctcgagtagctggaactacaggtgtgccccaccacgcctggctaatttttgcatttttagtagagatggggtttcaccatgttggccaggctggtctcaaactcctgacctcaggtgatcacccgcctcagcctctcaaagtgctgggattacaggcatgagccatcgcgcctggccaggacattttatataaatggaatgatacagtatgtgatcttaagccacttggcatgttttcaagattcatctgtgttgtagcatgtaacagtacaccattcttttttatggctgaataatgttccattgtattattatacatttcattcatctgttcatcagctgatgcctgctgattctttcgtatttatttttttgagatgggatcttgctctgttgcccagactatagtgcagtagtgtgatcatagctcactgcagcctcaaactcctgggcttaagtgatcctcccaccacagcctcctgaatagctggtactacagatgcataccaccatgcctggcttattattattattattttgagataggctcttgttctgtcacccaggctggaatgcagtagcaccatcacagctcactgcagctcaatctcccaggctcaagcaatccctccacctcagcctccagactagtaattattaaattttttgtagagacaggatctcgttacattgtccaggttggttccgagctcctggcctcaagccatcctcctgattatctgggattacaggcatgagccacagtcccctgccctgctggttcttaaacaggctttcggttagtcctcctgtttttagctccatctttatccccactttgaaaggtgcctaatgctataagttcctgagctttttggaggttacgttgtatctcagcctttctcaagcctactgttggtaaccattcatccatcagcttttcagcttctaaaatgttgttactattaccttcactctgattttgtgggtttatgccactccccatcctccattgttttagcaaggttttggaaagagagaggtagctgaggaagagctaatgcataccttcagccctcagtctttcactgaaagtttaaaaggtgggattcccatgctgtatcaggctctaggcccaatagtcatggaatgaccaagctggaaaaacctttagagatgagcagctagtcatatacttcatctttcaggtgaagaaaatgagactcacaagactcagtaaattgtttaatgtcatacaattagtaagtagccaagttaggtccttaatcctgtctcctgccttcttgactagttgctcagacttaatttaggctgattacattaaaatttggtattgaggagagcatggggacccttgttcacatttggcctttgccactttttagttacagaaatgggtttgcttaagcccaattttctggaggggctagcttttagagaaaggtgcatgtgtacctacctgtgtagcctctgggagctcactatatttggaagagtgtgcgtatacatctaactaacttattaattatataaaagaacggccaggcgcggtggctcacgcttgtaatcccagcactttgggaggctgaggcgggcggatcttctgaggtcaggggtttgagatcagcctggccaacacggcgaaaccctatctttactaaaacacaaaaacaattagctgggcatggtggtgtgtgcctgtaatcccagctactagggaggctgagacaggagaattgcctgaacctgggaggtggaggttgcagtgagctgagttcgtgccactgcactatagcctgggcgacagagcgagactccatctcaaaaaaaaaaaaaaagaacacaggattgggtttcttagactggtctaaaagaccatgaattggacagctggttgcatcacccactaaacaggaaataatgtgagttccaggtgttacctgacagatgtgtgctctgcagggcattcggctgggctaaaaggaaggcaatgtgaacaaaagtgctttcagtttgtcctagatgcagtttggaacagtcctgactggataggctctcaaacctagtctctctaaaactggtcacataagaagttcagccattttagaaatactaggtacatgagttggatcatgtgtggtgcctggaagatgttaagcaggaggcaaaacatcaataaaaataatggctgtgtatacaaacctaaaactatctgacaaagtaaatgtattgagaaagagagtgaacaaatctgccttgagaaaataggagtaacagggtttctcttaaatttacattgaaaagcctggtaagcagctttcctgggttagtgccttggaagaggacttagaagtggcctgcggggctggtgcggtgactcatgcctgtaatcccagcactttgggaggccaaggtggacaatggaccacttaaggtcaggagttcgagaccagtctggctaatgtggtaaaaccccatccctactaaaaatagaaagattagctgagggtgatggcaggcgcctgtaatcccagctagttgggaggccgaggcaggagaatcagttgaacctgggaggcacaggttgcagtgagccaagattgtgccactgcactccagcctgggtgacagagcgagactccgtctcaaaaaaacaaaacaaaacaaaaaagtcttgtgggtgggggttggggggcagtggacagttcactgcttgtattctgggtacttacttgtgaatgtctgactcctgagcatcacagtcagctggtgatgtgggccaagttacagcctgtctcttcaaggaacagttaccttcttttctttacggtgtaggagttgtaaaatcaatttcatgtgaagaagagataaggaagagtgatagcttccaaagctctgcagtccttattgtgtatgtgtgcctgtatttaaggtgtctctatttaaaaagtgctgatagtaatgaaagtcatctattaataaaagtaatgataaggttaattctcatttaattagaaatgtgtaatctcttcccttcctacattgtgccctgccatcagacaggtgatgccctctgatttgtataggggttcagaaattatgtggaagatagggagaattgaaatgctggagcagccagagagttgaagacaaaacaacctggctctcaacatgcacaaaaaatagaagtgtgagttggtagcagtactatgctattgggcagtctatttcacaagtgtttataacaggaaagatacagtgccatcttttagtgtgggaaataaactgattatagcatggacgacactcagttgatgaccgtggttggtcaccagtagtatcaattttagtatatcccagaatgccaatatgcaaaggatagcatattaacttagacgtatgcattcgcagaggaaagaatttcatcactcttgctgcagatgatctacagataatatgaaatagaccttataggattgttgttgatatggtaagttgaggcagtctatgtgatactgaaacaggagaggttcccttgtcccctccctggctcactgcttcttcttcttcttttttttttgggagacggagtctcgctcagccacccaggctggagtgcagtggtgcaatctcggctcactgcagccaccatctccagggttcaagcgatcgtgccatctcagcctcccaggtagctgtgattacaagcacctgccaccatgcctggctaatttttgtgttttagtagagatgggttttcaccatgttggcccagctggtcttgaactcctgacctcagttgatgcacccgcctcggcctcccaaaatgctgggattacaggtgtgagccaccgtaccctgcccacagtatagttttgaatgcttgaaatatattgcctgcagcctctgttttaaaaaccctgagaggttgttagaaccattaaaaaaaaggtgttttttttttaagttaaactttaaatttgaggtaattatagatttatttgcaattgtaagaaataatagagagatcccctgtgcactctacccagcttcccttattggtgacatcttgcagaactatatagatattatcagaaactcacgcctgtaatcccagcactttgggaggctgaggcgggtggattgcctgcggtcaagagttcgagaccagcctggccaacatggtgaaaccccgtcactatttaaaatacaaaaaaattagctggatgtggtggcaggcacctgtaatcccagctactcgggaggccgaggaaggagaatcacttgaacctgggaggtggatgttgcagtgagtcaagattgtaccattgcattccagcctgggcaacaagagtaaaactctgtctcaaaaaaaaaaaaaaaaaaatcagaaccaggaacttgacattgatatagtcaaggtatcaaagagttccatcaccataagaattcttggggttgcccttttatagccacacccatctaccttcctctccccacaaccacccaactctcccccttccccaccattctttgtttccctaattttattgtttcaagaatattatataaatggaatcacacaatacgtaacctgttgtgattggcttttctcattcctgtacaggtctactggtgatgaattctctctgttttgcctgaaaatgtttttaatttgccctcatttttgaaggatattttttctgttcataaaattctgggtttgacagatttttatttatttgtgtttttttttcagtacttgtgttgttccatgttttctagccttcattgtttctgatgagaaggcagtagtaatttcagtttcttccccttgaatataatgtgtatcctttctttctagctcttttcaaggttctctcttatcattggtttctagaagtttgtctgtggtgtacttgtgtattattttattggcatttatactgcttggagtccattgagctttttgaatctgtaaatttttgtcttttaccaaatttgggaaaattttgattattaattcttcaaatattgttttctgcctcattctttctattttccttctggaactccaattatattatgttagacttgttgccccacacatctctgaggtcctctctcctgctgcccttttcttttttaatttatacattttattgtgtagagatggggtcttgctgtgttacctaggctggtcttgaactcctggcctcaagcagtcctctcaaccttggcctcccaaagtgctgaggttataagtgtgagctaccacgcccagccagctctttcttttcctaatccttttttctgtctgtatttctgattggataatttttgttgttcatttttcaaggtcagtatctctcctgtcatttccaatctgcttttaagccagcccactgcattgtaatgtctgttctctgttgagatctgttttttttttttttttttttgagacggagtcttgctctgttgcccagggtggagtgcagtggcacgatcttggcttactgaaatctccacctcaacctcaagagattcttctgcctcagcctccccagtaactgggactacaggcacacgccaccacacccgcctgatttttatatttttagtagagacggggtttcaccatattggccaggcttgtctcgaactcctgacctcgtgatcttcccgcctcggcctcccaaagtcctgggattacaggagtgagccaccatgtctggcctgagatctattttttcattcattatgatcatagctgctttaaaattcttgtttgctaattccagtatttgagtaaactcagggttggtttctgttgattgactcttctcttgagaatgggtcatattttcctgtttctttatatgctgagcagttctggattgtaaagaactagattctgttacctccctccagagagcattctttttttattttattattattattgttattatttttaagttaactgtttccctgtagtgggtggcaacttaaatttcagttcagttcttttacccttaacttggctgcttggggtcttctccatgcatgcgtgtttcagggatcagccaggtttgtaggcagagtttgtacacagatttttgggtcttcccttctgtggttctctctggaatctccctctttcacttcccagctgctgtggtttgccttaaaatttgccctctggtttcttaagctagtaagattatgagtttttgagttttacccacctcttatgacagacaggtacttgcctgactggaagccataaaaaagggaaactcacccagtatcattaccttctttgaagtgctgaccttcttccctacttgagaatcttcttgctttttaattctccagacaagctcatacttgtctgcaggaaagttggtctgaagggagctactctgccatgactggaagcagaatctgtatgaactagacataaaatattctgttgataaaatcaattttttcccattgtagtttcacagatctttatattatcctccctatcaccttcaagaggccagatataaaaatgtctttaaactgggtgtggtggagcatgcctgtaagggaggctgaagtcagaggattgcgtaagcccaggaatttgagagcaacctgggcaacctagctagaccctgactctacaaaaaaatttaaacaattagctgggcgtggtggtcctagctactctggaggctgaggtgggaggatagcctgagctcaggaggttgaggctgcagtgagccgtgattgtgccactgcaccccagcctgggcaacagagtgtgaccttatctcaaaacaacaacaacaacaaatgtcgatttatttctggcttggtcaaaacagaacagataaaaaacctattagaagttcttgtaaggcatgtatgctttaaaaaaaagtctgttatgattgatttgaactgtacttccttggaagcagattcacaaagatagactcacacatagttgactaattttgaaattgttcttggaaatgggctttagatcttatatctggatctgctgatgtttgtataatctatatgtgttgaacaaataattagtcgttgtttctaggacaataggacagtcatgttggtgatgtcatattcctaatattgtttgaatttccaagggtctaaataattgagaatttaaggtacctgtgatacacaggtttcaggaggtgggcctatgtaggtgtttctgaggattaagttttcctactgtttcttctcttttttttttgagatggagtcttgctgtgtcacccaagctggagtataatggtgtgatctcagctcactgcaacctccatcccccgggttcaagtgattctcctgcctcagcctcccagttagctgggattacaggtgtccgccactacgcctggctaatttttgtattttttagtagagatggggtttcaccatgttggccaggctggtttgtaactcctgacctcaagtgatccacccaccttagcctcccaaagtgctgggattacaggtatgagccaccgtgcccagccccttactgtttattcttaaaactcagccctaagtaaatgatgagtgaatcatttcactaaaaaaaatcttaggtttgtgaatccccttctcttaccttttctggcactctttgtagagcggctgaaatgagaatatgatttgttttcagggccctcatacttctttatacatctcctttccccttatggagaaaatactttgctcttgctactggtccagtctaattcacagaaggacatttgtctaactttggcaccccgtatagtcctttatttagaaccagactctttaacaagacttcttcccttagctaatttaaagaaggggcagatgtggagaggtggtggtggggacagaggctctaacaatcacttctccagtgattcatagcctttctctcccttttgaccacacttcagatcagctggtcatgctcacctttggctccattcttcatctcacttttaaaaagttctccccttaatcactcagctttcctatcttctcacacatgcatgtcatgtcttagggagctccttacagccattttagatgagatcaggcgcatttagggtggttatggccatagacgcctagagccattttaggaaggcgtctttcctttacagagaacggtgatagttgtcctgattcctctctctgttgtgatatttcgtggtttttactgaggggattttctggctagttaggaagaaatgaacaaactgataactgaaagtgaagaagcttaggaggaagaaacagttatcttctttcagacatgaatgcagtttaaaaatacatcccaagaatttcagactgtagacgagatcattatgtcagcggcttgctgcttaattactttgtacagtaagtgcaggcttaccatgggtgggctctgcaggtgttacagaaagctctgagcctagctctacataagctgtaggccttgttgctgcagctattaccagctgcctgctgatttttgccagtctttagtgaagattaccaaatgtattttgagggacgaaatttactcaaaaagaaagtttcagaagaatttgtttggaagaaggatcaggaaataagaggaatgaaattgtggcacttgcttttaataacagaaagaaggttgggtcctatcagaatttgaaaattgtgaataagtgagctgctgcttctgatgatggacaaaacctcagagaaaatagaggagagattgtagttataaaagcagtaactttctgactggaattattattagtttctggaacaggtgccttagagttattataaacttttctcttttagaaacttttgaggtgcctttgggattgatttagggtaaaggattttctgacttaggtgcatctcatcctgtgatagtgaagaatgcattttccttaataaccacaagtccctttaggttccagaccaacttagaaaaactacatttgtaacagaatttattctgtcaactagcacacgcaaacaggaccctgtgcaagtgtactctgaatggttaggccacgtaggtgaaagatctggagcctcccagataatagccttcctgtgaaatggttatttgtatgtgtatgttctttttcctgtatatttgacactgagatcattgagggtatgtgctttgtctggttcatctctattcctcacaatatctaagtcccttgattactcagtaaacaggtatagatttcacttgaattgtccttgattatgttcccccgacacctgagatttgtttgtttgaactgtttatatgcatttaatttgtcccacactccctaattccttaggaaaagcaatatttgggatagtatacttttagataaagcactagtgactttatagtaatttggtatcagttgagctcttcgttctactataccgtattataatgtttttcaaactgaattatgataattagtaggtctgcagtcagcattttttgttttaatgatatagagtaggaaatatgagaggacattatatatatagtaaaggtaagtattgttttgtgaaatttttgctttaggtaaatttatgtatacacatacatgtatgtgtttattgtttcataatgtaaaatgtaatttgtactggaataatggtcaaaaaagtttgaataacactgctttattgtaatactctgttatttcatttatcatatagcattatgccagtacatacaggcttctaaagccagggatggtgccagccctttcatttcaagtacgactgaaggtaaaaacaaaacaaaattgagaacacccaaagctttctaatggttcttacatatatctctccagtggcattttgtaacctttgaccttctaactttcttgtgccttttttgaccactagatttttcagatttgtatccctctaggtggtgggttctttggttctttctctcttcactttaatgttgttatttcaatatactttagtgtttttaggagggggaatgggaaaacaaaggacaattccagaaatttcaagtaattctgaattgacagaatatctcattagatttaccctgaaatctgcttcgttaatgttcttacatcttttcatttctttgtatttttcccagagatcattgaaatgcatagtttattctgaattttaggtaaaatatgcttctgtgatgtttttagttgactttaagcaaattaaatgtggctttcagggaaaaaaaaaagatagatacaatccttgtcattccttgtgctttctcactctctcccatgaaaattaaccattgggtttgagtagtaatttcattttgaagaagaactgacagctagtgatgtctgacattaaccatgctatactttttcagcttctttactgacctaataactttaatgcctttcctatttttattcttagatggttggcatactaacccccttgccttcatttctgtaccttgctggactaccaagctcagacatttataaccctgtgacttaaagggattttgtagaaatgatttacttcattctttttcttacaggagaaaattttgagcagacaccattgagaagaacattcaaatctaaggtccttgcacgatatcctgagaacgtagaatggaatccctttgaccaagatgcagtaggaatggttggtatttgttagccacaagtatgagataatttacagagtaatttataataggattgtgagttcaggctgtggtagcagtggtgccaccaaataccaataacttttgaagaaaggattataatgcatattgtttattattctgcattttggtcaaaataccaaatattcagaatatattaaatatgctaaaagttataatgtgtttctgttgtgtcagagaaatacatagtattgtgtcagtgaacttattttgtggtcctgatctgttgattatttattgcattgagattatatgatgagtcaattttaaacttcactagtttaaaattgttttctttcattctgcactgtatatatctaagtaatatgacagaagtgggtatttttgtttcatcataattttattttcatttttttgtttcatcataattttagataggacagcatttaaaaatctcatgtggaagaatataccactagagtaagctaacctttattgaatattcaccttgtgctaggcactctaataagcattttatatgaattaacttatttaatccttacagtactctttacatgggtagtattaaataaacacatacacacgtacatattttacagatgaagaaattaagatccaaagaggttaggtaatgtattcaagctcgcatggccaataagtagttgagttggagtttgagcactgtagtctggttccagacctctgctcttaaccttatctttgtactgcctctattacatttgattttgagacagggtctcattctgtcacccaggctgttggagagcagtggtgtgatcttgcctcactgcagcctcatcctcctgagctcaagtgatcctcccacctcagccacccgagtagctgggactactggtgcacgacactatgcctggctactttttggattttttttttatagaagcagtgttttgctctgttgtccaggctgttctcaaattcctgggctcaaacagtccgcctaccttgacctcccaaagtgctgcgactataggcgtgagccactgcacctggccttctattacatttttaatagcattctgtagtttttagaggatggtcttgtttgatgcatacaaaaaccctgtgaagtagggagaggaaactatattattatttcacagatgaagaaactgtctttgagagcctcaagttttttgactcctagtctagcgtttatttcattttaacatgctatgttctagaaatacctagcctttgggaagtcaagtttaaggctaatagatataatataatataggtccttgtatttgttaacccaggatatcatattttatttgtatagccaggttcatgtaaaactggaaaatgggaactgattgattcaggtcagttcgtttaactatccaagtttctttatataacccctctgaattagagtgaaaacagtacatctttatcctgattatgtcatctccttggtttatatgaaatgagcatactttttgatgtgaaaagaagttttactaatgacagaattttgtgaggtgatagtccaatactatttacaagtttgttttatttttaggtataaagttgcatgtatctggtttttagatatatttctagcatcatctcctaatatacatatcttactctctgtcatgctgtcatgcttaaccacctaccatttcctaaattttccaagttttcttttatctccatgtctttgtgcattttcttcttgtccccaaaatacccttctatcccttgtgtacttgatgaactctaacattacctttttttggtgacagtcttgctctgtcgctcaggctggagtgcagtgcatgatcttggctcactgcaacctccgtctcctgagtcaagtgattcttatgcctcggcctccccagtggctgggattataggcgtgcaccagcacacctggttaatttttgtgtttttagtagagacagggtttcgccatgttgcccaggctggtcttgaactgctggcctcaagcgatccacctgccttggcctcccaaaatgctgggattacaggtgtgagccactgcacctggcccatttttgtagctttttctgatattcccaggctgagttgtctgtgctgtgttcctgtagtactttgcatatacttttgtatatccctgatgactgcattatgattttatttacttgcatgtcttgcattagaaagagagagctttaagccagatacacgctcagcttagtaggtgctctataaataaataaatagtgatggtgttctgaaagaggatcgccagtgagtgttctcactgcttgttgccttgttgtcttttgcagctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcgtaagtcagtgcttactagagccttctgcctgcctcaggcttctttgctttccatgttcagatacagtgaggctgactgtaaaggttaagagctattacagtttgagcaaaacccagatcttttgcaggtaggtggtggatggcaaattgatagacatgagagggccagtatttctgattaactatcttcatggccttttgctgggcattccagtcttggaggggaacattgcttcctatgtcccttctgattgaagtgaaaagaggggtgggtaggaggtgatggtcacaggaagctgactttccatcagttctgttctgtcattctgcagagttatttctgcctcttcctcagcctagtaaaattgaggattcacaaaggataatcctttatatattgagaaaatgtggatgtgttgcatctttttgttgtttgcttaactgaattgttttcataaatgggaggttgagtgtaagcagcatatttggacaaaatagtaaagtagattagaaagaaacagatgcttacttaatgagccaggctagtaacatgaaattcattcattcagtacatatttactgagagtgcactatgtgtcaggcattgtttcaagggtagtggtggacaagacagaaaaattgttgctatagtggaacttaaattttagtgggagaagagaggtgattaaataaatatataaaatatgtagtttgtaaggtacttaataagggttataaagaaaaataaaacagggaaagggatagtatttggggaagagaagttccagtttgtaatagggtggttaggtaggcatccctgagtgacctgttaatatctgtaggaaaagtattccaggcaaagggcacaggaagtataaacggtctaagacaagaatgtgcttcgtgtattcaagaaccagaagctgggtggatggaatggagtgaatgagcgggagtatagtaggagatggtgttagagacttaactggaggccagatggtatagaatcttgtaggccattgtaaggactttggcttttactcttaaatggctcttagatagccatcagagttttcaattttttttactttttattttaaaataatttctagctacggaagattcgcgaggggtattcaaaggactcttgtataacctatcccaaattcaccaattgttaacattttgccacatttgctttattatgatctctgtgtgtgaacataactgaaccattgagagttattgtgactcctaaattctcatgtgtttatttcctaagaataaaaacattctcttaaataactatcattgatcaaatttggaaaacctaacattgagacaatactatattaaagtttctctggtacccgataatgtctgttatgataatttaaaaaaattccttattcaggatctagtgccatatcatgcattgcttttagttgtgagtttctcagcttttgtctttcatgacatagacatttttgaagagtacaagcaagttattttatagactgtcccttaatttggttttgtctgatgttttcatgattagattcagattataaatttttgcctaaaataccatagaagtgatgtgcttctctcagtgcattatattaggaggcacatactgtcagttttcatgattacaggaggcaggcatatgatgtcattttgtctcatttttggtgatactaatctgcttacttggttaagatggtgtctgtggtttcttaactggaaagttataatttttcccttggtaattaacatgtaagtcatggggagatactttgaaactaattattctgttcttctttaaagttttgcctaaccattttttttttagtttttattttttgaattatatttgcagtttatggatgcctaatagtttagcatttattgatgattctattctgaatcagttatttcaagaatagtagcaaaaaggtgattttctttttcttttctttttccttttgagacagggtctcactctgctgcccaggttggagttaagtggtgccttcatggctcactgcagcctcgtcctcccatgctcaagtgatcctcccacctcagcttcccgtgtagctggaactacaggcatgcaccaccatgcttggctaattttttattttttgtagacatggggtcttgctacattgcccaggctggtctcaaactcctgggctgaacctcctgcctggtttcccaaagtgctgggattacaggcgccactgtgcccagccttaaaatttttttttttttttaaagaaatagagtcttattctatcacccaggctagagtgtagtggcacaataatggctcactgcagtcttgatatcctggactcaagtgatcttcccatctcagccgcctgagtagctgggactacaggtgcccaccaccatgcctggctaattaaaaaaaaattttttttttttgtagagctaggttcttgctttattgcccaggctggcagaatagtggttttcaaactttatctttatttattaattggcattataccataatgaagagtgtttctttctcctttgtttattattgtatggattcatagatttttattttactcaggttataattcactataattatttattttgatgctcaaatttcccagatttggtccatgggcaaaggaatggacctccacaatggcagggcttttgctttttgctcattgatggattccaagcactaaaactgtggctggtatataagggtgctcaataaatgttgttaaataaatgaataacttaggcttttaacaggatcactctggccattatattaagagtatatccccaaagggagaatggaagaaagcaaagagttccgttaagaggtaatttgtaataatccaggtgagaggtgatgtcagttagaactaaggagataacagtgaagtggtgtggaatggttgggttctggatatagtttgaaggtgaagtaatggaaactatgttgaactgaagagcacatacctcatataaagtggatagccgctaattagctccagttaattccttgtgggtatactggcctgatgttactaaatattccaataattgatgaggacccagattttttacatgaaatctctgatttttaaatattggcaataatgttctttttaaacactgcaggccaaacaaaaagcatctgctggctgaatgtagttcctgaggcttcactttgcaacttctagtttaagatacgaagttagagcctcctctctctgggtgaaatatagacttggacaaatcatattgctttcctagctatttcttggctggagcttcataaaaatactttgaaatggagaattagttgaatagggaggaacttctctggtttagaacagaacagagaggaggaaaccaaactatatagagtgttagaagatacagtaggcttttaggcattgggggtgtttagaggcaaggaaaggatgattgaaacaaatatgatgaacataatggaaaaataacattcttccatctgagtttcttttgtatttcctagaatatgggttactgtatccataataagaattttaggaggtttgaatgtaattgagatggttagtatgtagaattgaatttaacttaggacctaaagtcaggctcagcatggacaagagaaagcttttttcagaaattcctggatattgctgagcctggctgaggccacagtggagtggattacttttcattggatgtaaattatgctttttgttgttaatagagtgctttaaacaatttaggttggttttcttgaagtagttatattaatgatccaaggacatcttccttgtatggataaaaatcactctggccaaaaacaagctatcaccactgcagttgattttgcctgctgcatgtcctgccctctgaatagaaaagaggtgttacatagggaaaaggaatgcaggctgaattgtaagattctgaaagtgtaaccctttggaatgctgaattggcagttttaagcagtgttttctttttggtataggtcattttatttacttttagataatatttattctttagtccatatagaattagtgtttttttaatagcataatttttaattggttgttaaaaaattattgttactttttttgagacagggtctcattctgtcacctatgctagagtgcagtggcacaatcatgactcactgcagccttgacctccccagactcagatgatcctcccacctcagcctcctgggtagctgggactacaggcatgtactgccgagtctggctagtttctgtattttttgtagagatgaggttttgccatgttgcccaggctgatcttgaactctgggcttaagcaatccaccttccttggcctcccaaagtgctgggattacaggcatgagccactgcacctggccttatttaaaaattatatgcagaacagaagctctttatctgaagtggcctgatagagtagttgattggaaaccaaaaaagtcagttaagtcacagaatcctaaaaatgatatgtacaattaattttatagttaaactatttattatttattattatttttgagacggagtttgctcttgttgcctaagctagaatgcagtggcatgatctcggctcattgcaacctccgcctcctgggatcaagtgagtctcctgcctcagcctcccgagtagctaggacaccacacctggctaatttttgtatttttagtagagatgaggtttcaccatgttggccgggctggtctcgaactcctgatctcaggtgatccaccagcctcagcctcccaaagtgctgggattacaggcatgagccaccacacctggcctaaataatttaacttaaaacatataactgtatagtcactaatctttgacgaagggtccaggcatttctcatgattatgacttcacaaatcagatatctgcacttcttgcataaaccacacccataatacattgactagatttcctagttactttacttttcttttttctttttttttttgaggtggagtcttgctctgttgccaggctggagtgcagtggcgcaatctcggctcactgcaacctctgtctcctgagttcaagcaattcttctgcctcagcctcctgagtagctgggactacaggtgtgcaccaccacgcccacctaatttttgtatttttggtagagatgcagtttctccatgttggccaggatggtctcgatttcttgacctcgtgatccacccgcctcggcctcaaagtgctgggattacaggtgtgagccactgcgcccagccctggttactttttttttttttttaaagtggagtgataaagaaccttgcaaaagaacatgagcagagactacttctagatttttgtagtgttccctagttttttattcttaattgcttcatgatatgcctaattcaattacagtgttttttagtgactttgtactactgagtcttttaaaagcatttaattttgtttccagagaaacagacatcctttctttttgccctcagattttaccatttatttacacaatatttggttacgttgtataatccagtagtaagttcagctagcacaggtttgggaacaaatgagtgggagcaatgtatgctttactcagagtggggaaaatcaatcggtaaagtgagttggctaagtggacgttggtaagaaatctccaatgatattttactatctaaagtagtcttttactgtaaaaataatgattgcttaaggcatataattaaaacaattccaaagggaatcaaatattttcctctcttttcttcatatagtagctggatatccaattttttgtgtatccttaatgaaaataatagtttttaaaaacaaataaataatatgtgcacaaataatgcagagaaagttgaaggttctccccaactcacttttttttaagacggggtcttgctctgttgcccaggctagagtgcagtggcgcgatctcagccccctatagcttctacctcctgggttcaagcagttcttgtgcctcagccccccaagtagctgggactacaggtacgtgcaaccacacctggctaatttttgtatttttagcagagatgggatttgccatgttggccagcctggtctcaaactcctgacctcaagtgaactggccaccttggcctcccaaagtgttgggattacaggcgtgagccactgcactcagcccctttttctttgatctagtatcctatccctgagaagtaatctcttaatttttaaaaattccctcttttccagtatttttaataatacactatatatatatattttttttgagatggagtttcactctgttgcccaggttggagtgcagtggcgcgatcttggctcgctgcaacctctgcctcccgggttcaaacgattcttctgcctcagcctccctagtagctgggattacaggcacgtgccaccatacccagctaatttttgtgtttttagtagagacggggttttgctattcttgccaggttggtcttaaactcctgacttcaagcgatccgcctaccttggcctgccaaggtgctaggattacaggcatgagccaccacacctggcctaatgtactattttttatgttaggtgttgaatatatgtgtattaattttaatattctttaaattatacatatacactatgaaatctgtatggtatattaaaataaaacttgaggccaggtgtggtggctcacgcctgtaatcccagcactttgagaggccaaggaggacagatcacttgagatcagaagcttaagaccaacctgaccaacatgataaaacctcatctctactaaaaatacaaaaattagctgggtgtggtggtacacacttgtaatcccagctactccagaggctgaggcacgagaatcacttgaacccaggagacagaggttgcagtgagcagagatcccaccactgcgctccagcctgggcgacagagcaagaccctgtctccaataaaataataaataaataaaataaaatttgaaaaaaggcatttcaggagtgtaaaatgaagggtagaaattcacagcattagaagagtgtacagcgaagtgtgtaacttctgcctctgcaccctggttctccttcagggaggttaccactgttttctgcttacttgtagatatagccgtgtatatactatatatatacttttcaaaaagaacacaaatgggagcatactaatcattgttttgcaacctcccaggatagtttataattgttcataaatacgtaggagctgccctgtagtttgtttagagggggcttatttatagagtgattccaagtctgatgtctttatctgcacatacaagtcataaaaatgggccgggcacggtggctcacacctgtaatcccagcagtttgggaggccgaggtgggtggatcatttgaggtgaggagttcgagaccacccttgccaacatgatgaaactccttctctactaaaaatacaaaaattagccaggcatggtggctcgtgcctataatcccagctactggggaggctgaggcaagagaatcgcttgaacctgggaagcataggttgcagtgagccgagattgcgccactgcactccaacctgggtgacagagcgagactttgtctcaaaaaacaaaaaaagtgctgggattacaggtttgagccattacaccctatttaaaagacatccttttttttttgttttttgagacaatgtcacttaaaagatattcttactgcccagtagcttccaagggttttaggagctgtgtgtttcaggaaccggggaaaagaccaaatagatacatatttatcacactagtaaagttatctacaggttatgctcttctttgattagctaggagcaaggtgataggcaactttcaaagctttattagtgagcaaatgtaggatgttttgctaaacttctaccttaatacttttcagcttctgttccctttgtactgagacttcctcatttcctagaaagttttttgttacttacaactactttatgaaccaagctgtgatttaaatggtggagtgggtttttagtgcataacatcattttaattcctatgacagctcatttgaaaccagccattccagaaggattttactcatatgatttaaaaatgcatatttctgctttgtccttaaatgcctgaaaccatcatatcatcatatcattacaaatagtaatttgtaaaatttaagttttaggccaagcgcagtggctcattcctgtaatcccagcactttgggaggccgaggcaggcggatcacctgaggttgggagttcgtgaccagcctgacatggagaaaccttgtctctactaaaaaatacaaaattagctcgggtggtggcgcatgcctgtaatcccagctactcaggaggctgaggcaggagaatcgcttaaacccgggaggtggaggttgtggagctgagattgtgccattgcactgcagcctgggcaataacagcaaaactccgtcaaaaaaaaaaaaaaagttttaactagtcaattttattggctgtaccaatatatttattagtcattaaaaaaaaaaaaaaaaggctggctgggcgcggtggctcacacctgtaatcccagcactttgggaggctgaggcgggtggatcacaaggttaggagttcgagaccagcctggccgaggtggtgaaaccccgtctctaccaaaaacacaaaattagccaggtgcggtggtgggcacctgtaatcccagctactcgggaggctgaggcaggagaatcacttgaacccaggaggtggaggttgcagtgagctgagatggtgccactgcactctagcctgggcaacagagcaagaccccgtcacaaaaaaaaaaaaggcctagaaattacattctgaagataagccaaatatgatcacaagcccacgagccttccctttaggctatgatctctgacctataacaagagttttgagtagctaaagtcaatcctctgagtctttcaagttctagggaagccttttttttttttttaagaaggagtctagctctgtcactggctggcgtgtgcagctgtgcagtctcggctcactgcaacctctgcctcccaggttcaagcaattcttacgtctcagcctcccaagtagctgggattacaggtgcatgccaccacgcccggctaatttttgtatttttagtagagatggggtttcaccatgttggttggccagtctggtctcgaactcctgacctcaagtgattcacctgcctcggcctcccaaagtgctggcattacaggcgtgagccaccatgcccagcctctagggaagctttttattgaaacgttataataacatttttatgctgttctcattcaggaaaggttgccaggtgtagagcagacttggctagtgtggaaaaccagcttctgcatgcttggtggttctttgtgcttgactttgcaggcaaagctcacataagctccttataggatgttctgcagatgtatcttagtgagaactgagcatgtttttgcttccatgctgaatggagacccaggaccactgtctttctttttgttcagttctcctaccccctttcttaagaggatctacttaacattctgtggtagtatttggagcaagatgtcattaattatttttgttgtatttccatattagattttattatgagcaaggacctgtgtgtgtaggtttatttcaatttgtggtccacaagggtctcttggttgtctcttggacaccctcaagggaatcacattgagcataccctagctgaagtttatcgtgatcgtttctaaataagaaattgtactgaaagttttaacttactgtttggaaagcaagtgccttgtttttgactgatttgtgtgtgtgctttttttgttgttgttgacccagattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggtgagatcttgagtgttggtgcctctggccccaatccaggattggggagagaagggctttgggatgaacccagcatgcatgatgttaccaagtttattttcttctattttggtgattatgaataacttctcaggaaaaaagtaaaaacaatgaatatttagttcaatttatgtcatcccagagacacttattatctttatcaactgacatatgtacattgtaatttctgtatttatgctattgtttttgttttgttttgctttttaagagacaaggtcttgctgtgttacccaggctgggtgcagtagcatgatcgtagcttactgtagccttgaactcctgggctcaagtgagcctcctgactcagcctcctgagtagttgggactaaaggagtgtgccacgatgcccagctaattgtttttttatgtcttgtagatgcagggtctcaccatgttgcccaggctggtctcgaactcctgggctcaagtaatcctcctgccttggcttcccaaagtgttgggattataggcatgagccactgtgcctggctaagaaaagaattgatttaaaataatgtatttcctattccattctaaagtagatttaaagcatgattagaaataagattttttatttttaatttttttagaattaccagcagaactggtatgttactttgtggctgttgtgaaactacctgcagggaagtgctttcctactttgaatttcttagtcattagaaaggcctgggaagaagactttggagtatacatacactggtgtcaccatgactcttcgtttcctccttccaccaccatttttttgggggtagagttttttttttgtttttttttgttttttttttgagacgaagtctcgcactgtcacccaggctggagtgcagtggcacaatcttggctgactgcaacctctgccttccaggttcaagtgattctcctgcttcagtctcccaagtagctgtgattacaggtgcccaccaccacacccggctaaatttttgtatttttagtagagacggggtttcactatgttggccaggctggtctcgaacgcctgacctcatgatccacccgccttggcctcccaaagtgctgggattacaggcgtgagccaccgcgcccggccgggggtagagatttttgtatataagtgaggaatataagtgaggggccccaagaagagagcattctcatggaactggatctgggcagcactgtgtcactggtcatgactgggcagcatctttgatgaataccctgataattagaccatgtctgtgatatttaaattatagtcaaatgcatctctgctcttttctctcttctttagttttagaatcaaaatgtcttccttgtcttccttgtagcttcttccatttctgcccttttttcttctttgactttatagagcgttgtgctctttggggtggaacaagattaattaaggaaaaaaaatctaaatgatggataaaatcattgagttgagataatattggggttttttgtgtacttgcttactgtaccatacataaacctgaagagtcgactggagaaagaagagctttttgttgtttgctttaaacaaatgtctatttaatattgatacaacttagtcaacctaattatgattctgtaaagtcacaaaaagaacaataacaaaaaattgttgaaggtggaaggccaaagaggcaagctatgtgcatactttaatacataggccactaagcaagaagccagatttctcagttttattttcctctttggcatcagctttctttatacttggggcaaattctgatctctctaggatttttcaacgttgttccctatgtgcttcatgtatacggctatacaaagggacctctgagggatcaacagatttcttaatgggactgtttaagaaaccatgggttgtttaagaaacccaaaagttggccgggtgcggtggctcacgcctataatcccatcactttgggaggccgaggcgggcagatcacctgaagtcaggagttcgagaccagtctggtcaacatggtgaaactccatctctactaaaaatacaaaaaaattagctgggcatggtggtgcacgcctgtagtcccagctacgtgggaggctgaggcaggagaattgttgaagcccggagccagaggttgcagtgagccgagatcacgccactgcactccaacctgggtggatcgcgccactgcactccagcctgggtgacagtgtgagactccacctcaaaaaaaaaacagaaaagaaacccaaaagttccctctgttctgggctattggagcctccatgttgctgtattccccatccctgctataaactttgtatctgagcttctggctcccctgtagtctgcttgggaaggagtggtgacagtggaacagtagaattaactgtgtgtgcttcataagtggttcttgggtttcagagtcctagttcatccacacctgtcttctgaaggtcacacatttgtgggagcagttatatagctggatattttctaccttgatttttagcagataagctctggggtatctgagcctatgtatttcccgtggaaaaccttagactaggggaagagagctggctttgaaagacgactttggggtgtctcagaaatgacatgttcatagtaaaaaatgctaacagtgcacaaaagcataaacaataaaattaaaattacctcaaattttaccacccagagataactacttttgatattttgatgcacatctttaaagtatgtggtatcttttaactacagtcttagaaggaagctttggggcagtgtattagtccatttttacactgctgagaaagacatacctgagaccgggcagtttacaaaagaaagaggtttaatggacttagagttccatgtggctgggaaagcctcacaatcatggtggaaggcaaggaggagcaagtcacgtcttacatggatggcagcaggcaaagagagagcttgtgcagggaaactcccccttatgaaaccatcagatcttgtgagacttattcactatcacgagaacagcatgggaaagacctgcccccatgattcaactaccccctactgggtacctcacacaacacatgggaatttaagatgagatttgggtggggacacagccaaaccgtatcactctgccctggccccttccaaatcttatgccctcacattttataaccaatcatgcctcccaacagtcccccaaaatcttatttcagcattaactcaaaagtccatagtctaaagtctcatctgagacaagacaagtcctttccttataagcctgtaaaatcaaaagcaagttagttacttcctagatacaatgagggtacaggcattagataaatattgccattccaaatgagagaaattggccaaaaacaaagagctgcaggccccatgcaagtctgaaatccagcggggcagtcaaatcttaaagttccaaaatgatctcctttgactccgtgtctcacgtccaggtcacactgatgcaagaggtggattccctggctgggcacagtggctcacgcctgtaatcccagcactttgggaggccgaggcaggtggatcacctgaggtcgggagttcaagaccagcctgaccaacgtggagatacgccatctctacttaaaacacaaaattggctgggcatggtggcacaagcctgttatcccacctactcgagaggctgaggcaggagaattgcttgaatctgggaggtggaggttgcagtgagctgagattgtgccattgcactctagcctgggcaacaatagtgaaactccatctcaaaaacaaacaaacaaacaaaaaaaccaaaaaaaaaaaaccaaacaacagcaacaaaaaaagaggtgggttcccatagtcttgggctgctccacccctgtggctttgcagggtacagcctccctcctggctgcttttatgggctggcgttgagtgtctgtggcttttccaggcacacagtgcaagctgtcagtggatctaccattctggggtctgaaggatgatggctttcttctcacagctccactaggcagtgtctcagtagggactctgtgtgggggctctgaccctacatttcccttccgcactactctagcagaagttctccatgagggccctgtccctgcaacaaacttctctctgggcatccaggtatttccgtacctctgcaaaaatctaggcagaggttcccaaaccccaattcttgacttccatgtacttgcaggctcaataccacgtggaagctgccaaggcttgggacttgcaccctctgaagccacagcctgagctctgtgatagcccctttcagccacagctggagcagctgggatgcagggcaccaagtccctaggctgcacacagcatggggaccctgtgtcaggcccacgaaaccactttttcctcctaggcccccaggcctgtaaagggaggggctgccgtgaagacctctgatatgctctggagacatttacccccattgtcttggggattaacatttggcttcttgttacttatgtaaatttctgtagccagcttgacttttctcctcagaaaatgggattttcttttctattgcattgtcaggctgcaaattttccaaacttttatgctctgtttcccttttaaaactgaatgtctttaacagcacccaagagacctcttgaatgctttgctgcttagaaatttcttctgccagataccctagatcatctctcttaagttcaaagtcacacaaatctctagggtaggggcaaaatgccgccagtctcttcagtaaaacacaagagtcacctttgctccagttcccagcaagttccttatctccatctgaaaccacctcagcctggatttcattgtccatatcattattagcattttggtcacagccattcaacaagtctctagggagttccaaactttcccacattttcctgtcttctcctgatccctccaaactgttccaatctctgcctgacacccagtttcaatgttgcttccacatttttgggtatcttttaagcagcgccccactctactggtaccaattaactgtgttagtcttttctcatgttgctgataaagacatacctgagagtgggaagaaaaagaggtttaatggacttaacagttcctcgtggctggggaagcctcacaatcatggtggaaggcaaggaggagcaaatcatgtttacatggatggcagcaggcaaagagagagcttctgcagggaaactcccccttataaaaccatcagatctcttgagacttattcactgtcacaagaacagtatgggaaagacctgccgccatgattcaactatcccccactgggtccctcccacaacacgtgagaatttaagatgagatttgggtggggacacagccaaaccatatccggcagggctggggaaatttacctgggaccgtataagggggcatcatcagggtagtgaggtggggcaagcttggtttataaaaaggactttctccagagggacagagagtgtacatttcctagcccaccaaatcagaattcatcagttactgccgtctttgggcatcagaagtctgtaaaaagctttttgttcctttttgcaccaacacatgagctcagctggccctgagcaagtgaaggtactgagctgcctttgtgaggcatcctttgtcttaggcttctctttggagcttcgttgtctgagttcaggaaggaggcatttcatccacagctatattacagaattaagcaaaggatattagagtaaagaaaggggtaccatttttttctatcttggacccctttttcctacttttcccccattttctcaggacactccttcaatagctttttcccagtcatctgtgtgttgaactccttttcaatgaataacatgaggatagactggagaaacaggctggctgttttttggtattaggaattgagcattgggaaagatcattgtgaccttgagcggaagatatttgggagacttcttgggatttgggggatccatgtgatcactacctcagagcagctaagtctacccatcatccctctcaacaaggcaggaggttaacagaggaaaactgatcacttggcattcggtacctcttccaggctactctccccaaagctgttaggtaagaagtaacccctcgtcagctgaggaaggaggatatatgaggagttcctagtattttgtaagtgcttctgtgtgctagagcccctctgtatgatgggaggaaacagcatgaggctattgtatgagtctagtaattgactattgtatgagtgtagtaatttgcttttttaccactccctcctttagctcaattctttcttctcttttttttgtttgagatggagtcttgctctgttacctaggctggagtgcagtggtgccatctcagctcactgcaacctctgcttcacgggttcaagcaattttcctgcctcagtctcccgagtagctgggattacaggcacacaccgcaatgcctggctaattttttttgtgtttttagtagagacggggtttcaccatgttggccagactggtcttgaactcctgacttcaagtgatctgcccgcctcagcctcccaaagtgctgggattacaggcgtgagccaccgcacccggctcttttaaaactcagtctctagggtatattaacttcaaccaatttttgcaaagaatggctagtggtgcctactcagagggtcctatcttatcttaatctaattcatctctgaaatgtgcatgggcatatttcttctctacccacctctgaccaaaggtttctacaaatgtggacacagcatttggagttttaaagattctttacagactctatatttggttcacagtagtgggagaaaagccaaccaagcattgtttagtagatgtaggtatttctagctgtttctgtgtttcctattggagaaactgcttttttcttctgaggagagggtaactgaggaggtaaatgattgcattgtgtgcctttcgtgggtcacagtggcttgttttgttaggtgtatggacagggcttatgaggcaggtgatcttcatgactagatgatttaattctgtctttatctcttctaatggcgcagcctgatgacataattttaaaatcttaaaggaataagcaaaatgtagcgtgtttttaggtgttaagttaaacatttattggccttttgactaggtggggttcaaagttgttatccagtggaggagctctagaaagtgaaatttaaagtgattcttacagtctttgaatttttgacatgggaaagctctcttagttatagattggtagacagagtaatttatgcactcagcaaatgtttattgaatgatacacacatggacttgttaaacatgcagttttaatagattgagagtttatgaaatagttatattaagctggacttacgcctacccttcagtgtcttcttttttattttttattatcacagacacagagacaatacagacacacagagacaacacacagaaatacaatagacacacatgcacagacacgtaaacatccagaaaacgcacacacacagacaacacagacacagatacacacacacaaatttacagacagctcacacagaggcacaaagacacagagataacatacacagccacacacacagacgcagaccacacatacaggaacaacacacacgtagacacagacacgtacagagacacacagatacacaaatatacaagcacacacagacacatatacatcttaagttctgggatacatgtgcagaacgtgcagggttgtaacataggtatacatgtgccatggtggtttgctgcatccatcaacctgttatctacattagggtatttctcctaatgctatccctcccctagcccctgcagtgttttcttttagaatatgacttgttggcatagggagaaacagatcaatgaaacaacatttagatatacaatagggatacacactcaaggaagagctatttaataatggagctggaaaaattgcttatctgtaggggaaaaaagtaaaccataacaaaatcaacttcagatggattaagaagttaaatgtcaaaagcacaagtttaaatcttgtggaaaaaaaaattaataaatacctttctgacttctggctagggaaggagttttgtaaacaagttataaaaagcactatccatcaaagaaaataaaagattgataattgggggttttttttaattggtccagagtctcacactgtcgcccaggctggagtgcagtggcgcaatctcgactcactgcagactccgcctgctgggttcatatgattctcctgcctcagcctcccaagtagctgggattacaggtgtgtgccacaatgcccggctaatttttgtatttttagtagagatgaggtttcgccatgttggtcaggctggtctcgaactcctgacctcaggtgatccacccacctggcctcccaaagtgctgggattacaggcgtgaggcactgtgcccagcctgataaattggattttctaaatgaagaaaaagacaccttaaagataaaaactgaagaaatacataacatttataacctacaaagagttaatatcaacagaatataaagaactgcaagtgggtaagaaggtgataagcaatccaatagaaacatggcataagatatgaacaggcattgcgtaaaaaatgcacatttcttaatttctcttaatttcttaatcagggaagtgaaatcaaatacacgatgcagtgccattttatgctcattttgttggcaaatttcaagaagtgtgataataccaagttttgggagggatttggatcagtaggatcactttagtttgctggttaaaaatgtaaattgttgcaaccactttggaatacagctaggcatcattttctaaagtgggatatttgcataccttacaacactgtggttctactcctaggatatacccatatataaaatcttgcaggagtccaagaaaacatgtaataacaatcagtgtaaatacagtaaacaaaaaacaactgaaatgtcttttttttttttcttttgagacggagtctcgctctgtcgcccaggctggagtgcagtggcgcgatcttggctcactgcaagctccgcctccgaggttcatgacattctcctgcctcagccttccaagtagctgggactataggcacccgccaccacgcccggctaatttttttgcatttttagtagagacagggtttcaccatgttggctaggatggtctctatctcctgaccttgtgatgcgcccgcctcggcctcccaaagtgctgggattacaggtgtgagccactgtgcccggcccaaatgtctttttttttttgagatggagtttcactgttgttgcccaagctgtagtgcaatggcatgatctcggctccctgcaacctctgcctcccaggttcaagcgattctcctgcctcagcttccctagtagctgggattacaggggtgagccacggcgcccggcctcaaatgtcttttaacaggaaaactgatcaatatattatgttatattcatattggtggaatattatagaagagtgaaaatgaatgaagtatggctacacacaacaaaatggttgaatctcaacctaatgttgattgaagttactaccaaaagactgcttatggaatgataatccttgtataaaatttaaaaacctggctgggtgtggtggctcacacctgatcccacccagtattttgggaggctgaggtgggaggattgcttgaggccaggagttcaagaccagcctgggcaacacagcgacactctgtctcaacaacaacaattagccaggtgtgatgttgtgtgcctatagtccaagctacttggcagcccaggaagtcaaggctgcagtgagccatgactgtgccactgcactccagactgggcaatagagcaaaactctgtctcaaaaaaaaaaaaaaagttaaaaacctgtatgaaatttaaaaatatgtaaaaatttaaaggcatacatacatatatataataaatgttgattaacatttattatgtactatgtgcctggcactgtgctaaatccttgacatttattgttatataatcctcaaaacaagtctatgacattggtaatattgttatctctgttacgtgaatggaacagaagcacccttaagcatttaataatgtgctgcaatgaaggcaatgttgtcttggctagaacagattcatgagtataagataaatatacaaatatgaaaggcttctgtaatttatacctgcaagaacattccaacagggacaagaactacaaagtatttaaatatatatgtacacacacatttttattgacacataattatacatatttacagggtatggtatatttcagtacatgtatgtaatgatcaaatgggggtgtatgtaatgatcaaatggtaattagcatatccatcatctcaaaccttttttatttatttatattggtaacattcagaatcctcttttctagctacttgaaaaaatacaacaaatgtttgttgagtgtagtcaccctacagtgctatagaagactgcaatcctcctgtctagccataattttgtattggataatcagtctctttctattcctcctccttgccacccttcccagtctctggtaaccactcttctattctctacttcagtgagatcaacatatttagctcccacatacaagtgagaacatgtggtatttatctttctgtgcctagcttatttcacttaacataatatgctccaggctcatccatattgccatgaatgacaggatttcattcatttttatggtggaatagtataccattgttaaactacaaagtatttaaattaaatgtacaagaccgctaaagaggagaagagtagatggttaagagcttaagcatatgactgaagtcagggtagctgagttcaagtcccagctgtactagttaatagctgtgtgacttttggcatgttacttaacctctctgtgtcagtttttgtctgtaaaatagggatagctagatactgctgcattactgtgggggttttttgttagtttgttttttgagagggagtctcactctcttgcccaggctggagtgcagtggcacaatctcagcttactgtaacctctgcctcctgggttcaagcaattgttctgcctcagcctcccgagtagctgggattacaggtgcccatcaccacacctggctactttttgtacttttagcagagatggggtttcaccatgttggccagtctggtctcaaacctctgacctcaggtgatctgcctcagcctcccaaagtgctgggattacaggcatgaaccactgctcctggcccctaaattgtttgttaatccagattatctaccccatcagcagtgtgtgagcactatctctttacattctctcagaagcaattttaaatccagaaggaagcacagaaagaacaaagatcagccactaaaccttacaaattaagactgaggctcagaaagagagaatggtatatccagggtcatagagggagatcataacagagtcaaatctggaacctagactttttgaactcactcctagggttcttttcactgagtatagaattcacaaattcaccaggaatttattttttattttttgagacagagtctcactctgttgcccaggctggagtgcagtggtgtgatcatggctcactgcagcctcagcttcttgggctcaggtgatccctcctacctcagcctctcaagtagctgggactgtaggtgcatgccaccatccctggctaatttttgcatttttttgtagagactgggtttctccatgttgcccagaccagtctgggcaacagtctgggttcaagtgatccgcccatctcagcctcccagagtgttggcattgcagatgtgagccactgcgcctggcctttaccaaacatttaatgagtgtttaccatgtgtgagacttttgtgtttgatgctaaacatctatgacattataaaatcttcaccactctaacatacattgtttatctctttatctccattttacagctaaggaaatagaatcagaaaggttaagtaactttcctaaggtcacacaacgagaatgtggcagggtaatattggaactcaagtctgtcttatttctgagccctatcttccttataccatatctcaaatatagccatttcaggtgttttgtttttgccctcttgttcactaacctttctaaaacttcttcctgtaatgctctggagttattcatactcctcatcctgttttgacttccaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaaggtaagatgtgtatatgagtctgtgacacgtgtgatctgtgctagggtgctgtcctggtgaagtaaggtatgggatgagaaagcacccagttctggacaactcatatttgtgagcagtgaaagaatgttctgtatgggggactctgaattccatctggcagatgttatcctagtaaatgctactttaatctaaatctgagtagcttccgctttgaacatcagggagagtctgccatcattctatgtgaacactacagcacagtgattggagagaccatgatagtaatcttagtgttcagacctcttttattttttgagagaggttcttactctgtcactcaggctggagtgtggtggcacggtcacggctcactgcagcctcaatctcctgggctcaggtgatccttctgcctcagcctctcaagtagctgggaccacaggtgcatgccaccacacccaattattattattttttttttgtagaggcagggtctcactatgttgctcagctagtctcaaacttccgggctcaagcagtcctccagccttgcctcccaaagtggtgggattataagtgtgagccaccgtgccaggcccagatctcttttagatccattgccctttgagtttcacagcaacctaaggcagatagaacaggttttatagccaaagaaaccaaggcttagagagcctaagtgttttgcccaagattaaatgcctaatatgtagctgagctgagcctagaatctagtcctcttgaattctcactgttaaattactttcgtaagttacttataaaccaatgggccaatgtaataatcttgttgggctgttttttagtgaaatatttcattttttctgctttagtggagcagattttttttttgcttagtagactagatatttttcaaaaatcatgggcagttaaagaggaacagaaatatttggtgagattaaaaaggtgttttgggctggatgcggtggctcacgcctgtaatcccagcactttgggaggctgaggtgggaggatcaccagaggttgggagttcgagaccagtctgaccaacatggagacaccccgtctctactgaaaatacaaaattagccgggcgtggtggcgcatgcctgtaatcccagctactggggagggtgaggtaggagaatcacttgaacctgggaggcagaggttgcggtgagccgagatggcgccattgcactccagcctgggcaacaagagcgaaactctgtctcaaaaaaaaaaaaaaaaggtttttttgcagaaagaaggaaagtgatatgagggaaaaaataaaaaatcaagagagccagaatttaaccttgttggtttgttaaattgacctcccacattccttcctttctccctgacctttgagataattagcaccttttctttcatggcagaatctctctctgcccataaagatcttatctccactttcattgagttgttggatatctttaagtgaaactctttgacttttctctcctctgtgtctgagtccctttccttttatttatttattttttccagtttttcctcttttgttctcatcatttcctgctaagtaaattagcactgtaaaaaaaaatcagataaaaaaatcaggaattgcattccttgggttaaaaggaaaaagtgtatgtgttctcaactgctttttctttttttgtagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagtgagtgtaatcctgcttgggaggtggtgaggaatgagaacttgccagttatgtcttgaagaagtaatggaaaattactcgaagaagtaatggaagattatcatatgctggaaacaagtttatggtccatttgatgttgataaaataggtcttgttgcttatgaatagatgtgctgattattattatcagacgatttaccttcagccaaagggatctcttaaggcaaagatagacatgtagagtgaacatcaggattctgggaagattggttgactcagtaggttacccaagtgagtttgttccagtgtcaaagtttcaagatacctgaacttacatgagtgggtttttttttttttaatgtagagattttgcagcttggtattcttaaagacctaggcagcctcagagaataattaacctactggatcccttgggcacattgacattacccttttccctgtcaattactgcttctttttggtcccaccaggcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcaggtaaggcctccttggaaatgtacattcaggcctcttggattatggcattaacatgtcccttttcctaaatatgccagcctctttatctgtttctgcctttgtgtatgtggttcccattgcctgcagtcttcttccttgttttctttttgcctggttatcttcttctcatcctttaacactgttagttaggaatggatctcattgtatgtagtagagaccctaatcagcagtgggttaaacaaatagggggttctttttcttatattagcaagaagtacacaattggtggttgctggggttggctcagctgctcaaccatgtaaacaagaactgagattctgtctttttattcagtgaatccttgttgttggcttttatggtcatactgttgcctcattttttttttttttaaatgatgtcaatgaaagcctcatggttacagaagctctttcttttctgcccttttttctgcctgtgtgacagggtctctctctgtcacccaggctaaaatgcagtggtgtgaacatagctcactgcagcttttgaactcttgggctcaagtgattctcttgcctcagcctcccaagcaactgggactacaggcatgtgctcccatgcctggctaattaaaaaattttttttttttgtggagacaaggttttgctatgctccgtctggtcttcaatttttgcgttcaagtgatcctcctgtcttggcctcccaaagtgttggcattacgcgcatgaaccaccacacccagctccagccccagaagcttttcatattcacattcgaggcaagaagaggggaaggttgatgccggctatattcaccattccaccttttttttttttctttctttcttttttttttttttcgagacagggtctcactcagttgcctaggctggagggtagtggtgcgattatggctcgccacagccttgacttcctaggctcaagcaattctctcacctcagtctcccgtgtagctaggactgcaggcacataccaccatacctggctaattttttatattttttagagacagagtctcgccatgttgcccaggctggcctcgaactcttgggctcaagcagttctcccacctctgcattccaaagtgctaggattataggcgttagccactgtgcccagcctatttttcccacttttatcagaaaggaaaagctttcccagaaatttctaacaactttcattgtctcataggccaaaatcatattatatgatcaacctcaagtgcatgggaagctgtgaaagtgaacattgaactgggtataatgttaccctgaacagtatgaaggtctatgagcaagaaagaaggggtgaatgaattatgagtaagcagttgatggtatttgccacacaaacctagcagatacatttccttctctatgaaaccttctctgatgcccccagactgagtcagttgattcttcttctctgttcctgtggtgctttgtgcatgcttttactcaataatctctactttttctagctatcattattggggaacagcttaaggacagagattgtatttactcattttcttacccccattcttctggcattgtacccagcatgtagggatgttataatctacacaaatgattgaacatgtccttttgttcagaggactcatctacattagtttagctagagaatggtttcagcttgaagtactagattaagtagtgtgttcacttcctgcaggatgttcagtgtccttgttaaggcatttttgtatattttggtcactcatttgctgcattttataactacctaccagatgccaaatgtatggcaagtcttcaagaaatatttgccagatgaatgaatttgccaggcttgtttctaggctttgaagatataactgctgacagtttagacaaagtcttgcattttctagttcaaagtcttacattttctagttcaggaacctatgttctaactgagttaaagtagtctaattgcatggacaacttgtcctcaagcctttgccaaaaggactttgccaaaaggtcatcttaatgagggtcctggaacaggaatgaaaggtaaagagagaagactagaaaatgtaagggagacgtgattttgatttgtgtgtgcctaattgtctttttgagaacaaaatcttttattttgatgaggcccaatttatcagttggattatacttttattgtatctaagacacttttgccctaccaaggtcacatagagattttaccctatatttccctgtagaagttttatagttttaggttttacgttcaagtctctgatccatttcaagttaattttgtaagtagtataagttatgcgtccatttttttttcatatagatattcatctgttgaaaagaccatcctttctctaatgaattgcctttttgcttttgtcaaaatgttattagtctgtatatgtgttcgtctacttctggattctctgttctgtttcattgatctgttggtctacatttataccaataccacactgtcttgattactgtagcttacattaaatgattactgtagcttatattaaatcttgaaatcaagtagtgttaatcttgtaactttgttcttttcaaagttgttttggctattctgggttctttgtatttccatacatatttagagtcaacttgccaacttctgcaaagaaacctttcaagattttgattgatatttgacatcctaacagtaccgagtcttctgatccattaacatggcatatctttccatttatttaggtcatctttaatttttctcaacagcattatgtacttttcagggtacaggttttatatgtcttatcagatttttccctaagtagttcatattttttggtgttattttaaattgttttgtgttatataaatttggtgctattttattgctttcttaattttaatttctaattgttcattgctagtatatagaactataatagcattttgtatgtttatattgtgtcctgcaaccatactaaactaacttttaatagcttttttgtacatccatcagattttctacatagacagtcatattacctgtgaataatgatagttttacttttcctttccaccaccctggataccttttatttcttttccttttctttttcttcttcttcttatttatttattttttttctgtattacactggcttgaacctctagtacgaagtcaaatagaagtggtgagagtgggcatcttattcctttgtttttcatagataacctttagcagttaaggatcttactagtttgttcagcgtttttatctgaggtggatgttgaattttgtcaaatgctttttctgtatctatcaaggtaattatatggtttttagctttagtttgttaatatggtgaattatattgattttttttgttgttgttttaatgttgatggggtctcgctctgttgctcaggctagagtgcagtggtgtggccgtggttttctgtaactttgaactagtgggctgaagggatcctctcgtcttagcttctcaagtagctaggacagtagatgtgtgccgccatgcctggctaatttttaatttttttttctaaaaaaaaaaaaaaaagaaataaccttctttattcagagtaatattctttactgtgaaatctgttttgtctgatattaataactactccagctttcttttgactagtgctaacagggcatatctttgtcattattttacttttaatctatttgtgtctttatatttaaagggtatttattgtaggcagcatgtaattgggttttgcatttttatccaatttgacagtttccggtttttaactgaggtcttcagaccatgtacatttaatatgattattgatattgctgggtttaagcctgtcattttgctgtttgttttctatttgtcccatctgttctttgttcccttttcttctttttctgccctcttgtgtactaattgaatattttcaatttttttttctttttttttttttttttttttttttttgagacggagtcttgctctatcgcccaggctggagtgcagtggcgagatctaggctcactgcaacttctgccttccgggttcacgccattctcctgcctcagcctcccgagtagctgggactacaggcgctcgccactgcgcagcccagctaattttttgtatttttagtagagacggggtttcaccgtggtcttgatctcttgatctcctgacctcgtgatccgcccgcctcggcctcccaaagtgctgggattacaggcgtgagccactgcacccggcctttcaattttttttatgatttcattttatctactttgttggtttactagctataacttgtgttattttagcagttgctttaggatttatagtacacatttaacttatcacagtctacttttaggtgatacaatatcactttccacatagtataagaactgtacagaactgccaggcacagtcatgtgcacccatactcccagctgtttggtaagctgaagggggagggttgcctgagcccaggagtttgagtccaacttggatcacatgatgagaccctgtctctaaacaacaacaaaaagaacttcacaaaactctatttccatttctctcttcctagccgacgtgctattgtcatctattttacttttacatatgtcataaacctaacactacatggtcatttttgtttaaacagtcaattaccttttaaagggatttgaataataagtacaaaatctaatacattaactgtgtagttagcatttctggtgctcttctttcttttctgtagatccatacttccatctggcattattttcctactgccagaaggacttcctttaacatttcttgtagtgtagatctgctggtgatgaattctttcagcttttgtaattcttttgtctttgaaaggtattttccctgagtataggttaatagctttttcctttcagtactctaaagatgttgctccaggccaggcgcggtggctcactcctgtaatcccagcactttgggagtctgaggtgggcagaacacttgaggtcaggagtttgagaccagcctggccaacatggtgaaaccccgttgctactaaacatataaaaaaaaaaaaaaattagccaggcatgatagtacgtgcttgtagtccaagctactcaggaggctgaggcacaagaattgcttgaacccggaaggtggaggttgtagtgagccaagatcacaccacagcactctagcccgggcgacagaatgagaccctgtctcaaaaaaataaaaataaaaaaaagatgtcgctcctctgtcttctcactttataattagtttattctcatgctgctatgaagaaatacccaagactgggtaatttgtaaaggaaagaggtttaattgactcagttccgcatggctgggaatgcctcaagaaacttacaagcatggtggaaggcacctcttcacagcacagcaggagagagaatgagtaccaggagggcaaatgccagatgcttatgaaaccatcacatctatgagaactcactcactatcgcgagaatagcatgagggaaaccgcccctgtgattcagttacctcccactgggtccctcccaccacacatggggattattacagttcaagttgagatttgggtgcggacatggagccaaaccatattacacttccattgttttctgataagaaatctgctgtcatccttaattttgatcttctctatatacaaaatgtctactttctctaccagattttaagattttctttttatcactgattttgagcaatttgattatgatgtggcttggtgtagtttccttcatgattcttgtgcttgcagctcattgtgctttttagatctgtggattttttgtttacgtcaaatttgtaaaaattctggccagtatttcttctagtaatttttctgttctccccatccctaccttagggactgcagttacacatacatgtaatatctgggattgcgtagttatcccagaaccgctgatactcttttaatggcaacagttttttctctctctctgtggcttctttgggatcatttctcttgctatggcttcaagctcacttattttttctcctgcattgttgagtgtgcttttaacccagcccgtgtatttttcatctcagatattacagctttcatcttcagaagtttgagttccatgtttctagttttttgttgttgatgttgtttgtttgtttgtttttaagaggttctgctttgttgcccaggctggagtgcggtagtgtaattatagctcaccataaccttaaactcctgggctcaagtgatcttctggccttggcctcctgaatagctaggaataaaggtgtatgccaccatgtctggctcattttttttttttttttgaagagatgaggtctcactatgttgcccaggctggtcttgaagtcctggccttaaatgataccctcactttggcctcccagagtgctgggattacaggcgtaagctatcaggccctggtaatctttgattagatgccagacactgtgaattttactatttgagtcctggacacttccatattcctataaatattctcagtctttgttctgggatgtagttaagttacttagaaataatttgatttctttgtgctttcctctggcaggaccagagcatcctttaggctgtgattaattatctactactgaggcaagaccctctgagtactttactcagtgccccatgagtgattaggttttctagtctggcaggtggggacaggcattattcccagccctgtgtgagcattttgtattgtttctcctaatcctttccggtgattctttctccagccttgagtagtttctttacttgcgtgaactgacccattaccctgctgaatgccctgcagatcccctggattctctctcttctctggtactgttcatatgaactctagccaccttggtctccttaactcagggagtccaccagtctctgcctagaactcccctccctgtgccacagcctggaagctttctctaagcagttagctgggatagttctaggggttacctcatttgttacctgtttctcagggtcctgcccttcattgcctgatgtccagtattctgaagtttatcattttatattattttgcatgggttttttcctattaggcaggaaaatcagtcccttttactctatcttggctggaaatggaagagtagctagattcttaaagaatgtttgacttgatttatttgtgtgtgtatttatgtgtgtgtgtgtgtgtgtgtgtgtgtgtattctcatccagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtgagtcaaccccagggattcactaatccaactccctagctgtaatagggtcatctagtatctgggctagggctgttacccctagaagaccttgtacttttctaaagcagatatggagaagacccagactatctaggtggtttgcttatttgaacaagaaagtatgtgacagaatatctttcagttctgcctccactatgcagattgggatagctccatatgtctaggacctgcaaaaagctgcagatgggttaaaatcatctcatgcctggatcccattcaacagcaagctagcattgtatttaataaatggcagttgaaataatcagaacctgaactgaaaagtaggtaagttagcagaattactcattagttacttttgaagatgactgtatcaaagcccagatagagttaagtgaatatagttttagatctatatgtcaagtgtttgtagatgtttcaagagagacatgttccatgaggaggtgtctctctcatgtccagtcactcatctttaatctgctcttcctcaaggtctctgagctgtctctggtgacatctaggtcatttcctgtgtccagcattgactcgtagtcattcatgttttctcctgttagttgacattgctttttaagtgagacattattaattgcctgctttggttctgattgtgttaggtggacgaaaaggaatgcccctgcccagtggaggcggaaagatcggcagaagcagcacacagaacacctgcgtttagataatgaccagagggaggtaagataccttaagaatgataaggatgaccttgctatcatgctgtgcactccttctctttctcatttcctgttctctggtctgattcaaacgtctcagcaatgacctcaccccataaagaagggttaataataggtctagttcctgatatctaatgctgggcctgggttatcacaaatcagaatgtgggatgttttgcaaattccagctagctactaaccgattgtaatttctcatgcatgatgctccctgaggagttcaataggaacctcagaagttaagagtctgaaacttgggagaaatcctttaaaaattggtgtgagttttgtgtgtgtgtgtgtgtgtgtgtgtgtgtgtgtgcgtgtgtatataggaaaaaagttaattttttttaattctttttttgtttgagacagagtctcgcttttatcgcccaggctggagtgcagtggagcgatctcggctcactgcagcctccatctcctgggttcaagcaattcccctgcctcagcctcttgagtagctggaattacaggcaccacctcaacgcgcagataatttctgtatttttagtagagacggggtttcaccacgttggccaggctggtctcaaacacctgacctcaggtaatccgcctgcctcatccccgcaaagtgctgggattataggtgtgagctactgcgcccagcccagaaagaagttaattttgttagagtttttttcctactgtttcttaccttaaattgaaacagataatcttgactttttttttcttcttcttctttaaaagactaaaggagaggaacattattatcaggtacctggaaacccaagattcttgaatttacctcctgaatcttcattgcttgtaagctgagtttctcagctctactgtaacttgcttcttaagtttctagttataaacttcaggttgtagaccctgccttacttagttgcaaagaagttgtgaaaatgagtgttaacttcagaagcctatttcagtaacttatctttgagaaaagaccctgtaattttcatcttgcacagagagaacccaagaaggcatactgttttcatgtgtctggcagctcagtgaattggaaaataaataacatattctccctttgctatgtttttaatgaataaattaaaattgtaagatatggttatgaatcttcaactgctgatttataggatacagttgcactgggatttttttttttgtgagagtagcataagaaattttggttatttgtgttattttaaaagtctgtcttccacctaacctcctcattactattttcagcagtgtttattgaccacattttcttggtcagaatcactgagtgtattagtctgttttcatgttgctgataaaggacatacacaagactgggcaatttacaaaagaaagatttaatggactcacagttccacatggctggggaggcttcacaatcatggtggacagcaaggagggagcaagtcacgtcttaacgtggatggcagtgggcaaagagagagcttgtgcagggaaattcccccttataaaaccatcagatctcatgagacttatgcactatcacgagaacagctcaggaaagatctacccccgtgactcagttacctcccactgggtccctcccacaacatgtgggaattgtaggagctacaattcaagatgagatttggatggggtcacagccaaaccatatcactgaggtatcaaggaattctttgctaaagacaaaaaaaaaaaaaatcactgaggttaacactttgaaatacaaaggtgacaaaagaggttagtcttgtcctcagggaataccagttgatataagggagcaaaatcagatagaaagataacttcaagagaataagcttttgaaatgaccatatgaggagcaaaccaatgtttgattactgattagagaaagcagaggttacttctacttggggtcatcatcaaacaagatgatttggaagaggagcaagcatctctttaagccttagagaatgatgggattgttagaagagcttttattttattttgaaatggggtcttactctgtcacccaggttggagtgcaatggtgtaaccttggctcactgcaacctctgcctccaaggctcaggtgatcctcccacctcagcctctctagtagctgggaccacaggcacacgccaccattcctggctaattgtttgttgttgttgttttggtcttttttgtatttttggtagagacagggtttcttcatgttgcccaggatggtctcaaacttctgagctcaagtgatccactcgcctcagtgctgggattacaggccagagtcactgctcctggctgtttttctttttctttttttttttttttttaatctttcatctccctggagctataagaagagcatttcaagtagaggacatggcaggatctaaagtttggtgtgtaaatgtgtaaaggaggctgtgggcagaatattttggaggagggtggtatggagatagctaacaagttaggagacaggtaacagcagtccaagtaatagtaattggaccctaaccttggggggttggtagtagagatagattaaggggccataagatagaatggacagagttatgccactggaataaatatgggggaagggagaagtttagggtaaaaatgttggttatgaacctactgagaggatatcagattgcattttactgcattgatgtgggttctgtgttaaacaacatatgaagaagaatcaccagcacattatacaaaataattgcagttgttgttttgagtgtgcaatcttattttccaggccttaattttatactttatgatagaaagggtagatatctttgatacgggcagaggagttaaattcttctcagcttggtgggggaaattattttctcagtgttactcagagatttgagatttgctgtagtcatgtgttttttgactcttgtatctttttttaatttaattttttaaatttttatttatttatttattttttgtgatggagtctcgctctgtcgcccaggctagagtgcagtggcgcgatctcagctcaccacaacctccacctcccgggttcaagcaattctcctgcctcagcctcctgagtagctgggattacaggcatgcaccaccacacttggctaatttttatatttttagtaaagatggagtttcactgtgttggccaggctggtcttgaactcctgaccttgtgatccacccacctcagcctcccaaagtgctgggattacaggcgtgagccactgcgccttgcctgactcttgtatctttaaatcaaaggtaattataccatttggggagtgctttacatcagctaaaacagaaaccatcatctcagtttttctctttaatacaagaattaaattaaaaattttctattcctaactatctgagcctagaaagaggcagctaagaaagtgcgagaaaataagctgggcacggtggctcatgcctgtaatctcagtactttgggagactgaggcagatggatcaccaggtcaggagataaagaccatcctggctaacatggtgaaaccccgtctctactaaaatacaaaaaattagccgggcgtggtggcacatgcctgtagtcccagccactcaggaggctgaggcaggaggattgcctgagcctgggaggtggaggttgcagcgagctgagatcacaccactgcactccagcctggcgacagagcaagattcgtctcaaaaaaaaaaagaaaaagaaaaaaaaagaaaatgtgagaaaataatgccctcttcaggcacccaccagtactgctgacctttggtttatgtacatggacacaaagggtctttatttttctgtttgatatagaagtacatccaggaagccaggactatgggcagcactatccgccagcccaaactgtccaacctctctccatcagtgattgcccagaccaattggaagtttgtagagggcctgctgaaggaatgccgcaataaggtaagctgtggacatctctgtatgtgtgctatttctgttagcagccaaggtaagaccaaggattggctctgaccactccctctggattttaaaaatactgttggctgggcgtgatggctcatgcctgtaatcccaacactttgggagaccatggcaggaggattgcttgagcccaggagttcaagaccaacttggagaacgtagtgagatcctgtctttacaaaagtattaagatgggcatggtggcacacacctgtagtcccagatacttgggaggttgaagtgggaggattgcttgaacctgggaagtcaaggctacagtgagctatgatggcaccactgcactcctgcctgggcaacagagcgagactctgtcttaaaaaaaaaatcgttaatataatgagacagtactaattttaagatcctgttaatttgaaattaggtatatttgttttaaataaaatataccattaattgagagcatgcatgctttgcttgataaaaacttaatgtatactctataaaaatgaacaacaagctgggcgcagtggctcacacctgtaatcccagcactttgggaggctgaggcaggcagatcacgaggtcaggagttcaagaccagcctggccaacatggtaaaaccccgtctctactaaagacacaaaaaatttagccgggcgtggtggcatgcacctgtaatcccagctacttgggagactgaggcaggagaatctcttgaacccgggaggcggaggttgcagtgagccgagatcgcgccattgcactccagcctgggcgacagggcaagactccatctcaaaacaaaaaaaagaacaacagagagatgtagtttttaatttaataaaaaacttttttaaagacaggatctcactatattgcccaggctcgccttgaagtcctgggcttaagtgaacctcctacctcagcttcctgagtagctggggttacaggcatagttttaaatttttgacattttacagtactttaaatcagactagtcttcactctaacttacttcaacagattagtcttatgtatttgcagatattttttcccctttatttttatctgatagcaatgatatcttatatctagaaacagaaatttactgggtacctactatgtgccaggctaaaatgtgtcattccgtttaagcttagattgtttgggtgtttttctctgttctacaaagacattcattcttaatttttaatgttttaattatgaatttaaatgtcttttctaataaaaagaatctttcaaccaaggcagcataccataattttagggcatttcaactaactcagtctctactacatcctatttatttatcaatggaataaaaatagtctcctgcactttcagttctaagtggtgcccatttgaagtgatgttcatttataggagggaataaaatatgctgtctcttgcagaataaattattactgtttaaagctagattggcagggcacagcggctcatgcctgtaatcctggcactttgggagattgaggtgggtgaatcactcgagcccagaagtttgaggccaggctaagcaacatggcaaaacctcatctctactaaaaaaaaaaaaaaaaaaaaaaaaaaaaaaaaaaaaaattaggcgtggtggtgcacacctttagtcccagctactttggtgggctgaggtaggaggatcatttgagccctggaggtcaaggctgcagaatgagaccctctctcaaaaaaaaaaaaaaaaaaaaaaaaaaaaaaaaacctgattaatatatcagtactgatattttaaatttaggttaaaaaaaactctggccaggcattgtggccagtgtgtgtgtgtgtttgtgtaaaacttctgtcagttcactctgagtaattaatatctgtgatttttttttccatacaattttgtctcttctgcctttctactatgaagaacattggtgatgctgcatttctgcattttttttttctaagctgctggactgtcattctttttttttttttttttgagatggagtctcactgtgtcacccaggctggagtacagtgacacaatctcggctcactgcaacctctgcctcccaggttcaagcaattctcgtgccttagcctcccgagtggctgggattacaggagtgcaccaccatgcttggctaatttttgtatttttagtagagacagggtttcatcatattgaccaggctggtattgaactcctgacctcaagtgatctgtctgcctcggcctccaaagtgctgggattacaggtttgaggcactgcacaactggcctggactgtcaaaattcttaagtcatgagatgcatgacctggctgtgacaacttcctattcctagccaatgatgactgtgaaatacatatcaattttagacatgttaatatgtgggaaaatatacatctagaattgaagaaatatagtaatcaatgtaacatcacaaagtattggcttgcacgtgaggcaacaggctgttgaaagtataaattggtatgatgattttggaaaacagcatagtattgtttagtaattcttctcctaggtatattccctagagaaacttttggagcatgtcccaagagatatgtacaagaagtttacagcagcattcttttaatagccccaaactggaaacaaccaatcagttgagaaagccaatcagtaagagaattaataagtatattgtggtgtattcatgtggtggaatgctatacaacaatggaaatggataacagttatacacatcagtgtggatgaatttcacaaatataaacgagtgaaaaagcaaatcagaagccaggagtatcagcacacacctgtgatcccagctacttgggaggctgaggtggggggattgcttgagcctgggagttcggttccagccagggcaacatgctgagacccagtttcttaaagaaaaaaaaaaaaaaaaaatcacaaaagaaacatgcatgcctatagtcccagctactgcgggggctgaggtgggatgatcagttgaatctgggaagctgaggctacgtgaaccatgatcgagccactgcactccagtctaggcaacagagagagaccctgtcttaaagatacatacaggcaaaccaaaccatatattttagggttaaaaatataggtaataattttcttgcttttctgtagtttcgttgggtaagtggtcacttctagagtgggaaggtgaatggaagagggcacgtagggtgcttcaaagatataaacagacagtatttataaataaaatactggccaggcgcagtggctcatgcctgtaatcccagcactttgggaggctgaggtgggcagatcacttgaggtcgggagtttgagaccagcctgaccaacatggagaaaccccatctctactaaaaatacaaaattagccaggcgtggtggtgcatgcctgtaatcccagctactcgggaggctgaggctggagaatttgcttgaaccggggaggcggaggttgcagtgagccgagattgtgccattgcactccagcctgggcaacaagagcgaaactccatctcaaaaaaaaaaaaaaaaaaaaaagaaggaactggcctggcgctggtcataatgatgtaatagcatatatatattatatatttcacaataagaaggttaaaaactaacagtggaaagaaatatgccaaaatattaagagttgttgcttctgaaaagtaggattggggtgatttgttttccttttcttagatttttatatatcacaaatttatagcatagttaaatcttacttttgaacttggactcaaagttcaggcagatatgggttcaaaggccagatctattgctactttgctgtttcattttggacaatatatatatatatataatttaatagagtgctatattacgtatagattttgggcaagttacttaagagaattaaactatacttagactataaatatactatattgttttatactatgtttaaatttagtatattgattactgtatttctcaatttccgtattggtaaattgggaacaataataatagttacctcagattgttaggaggcttaaatgagataatgaaatgctaagtacaatgcctgacatagtacttaataaaaactgtgattatcattatgcagtatgtgttttcttggttatgatcttacaataagcagttgaaaatttttatgtaaaataaattacctcctcaatttttgtccccttgacagttatttcagatatgtttctaagttgtatgtatgctcaaaggtttgtttggtagggtcatttaagcagtgggaatcagacaatgtcagagataagcatgactgaagggtttatttgtttcttgcataaatgcaaaaactgaatacagagtgatgaaatcactggccaggagtcataaagattgctgtgttcttatcctttccttaactacatatttttttttttttgagacggagtctcgctctgttgcccaggctggagtgcagtggcgcgatctcagcttgctgcaagctacgcttccttggttgacgccattctcctgcttcagcctcctgagtagctgggaccacaggcgcccgccaccacacctggctaatttttttgtatttttaatagagacggggtttcaccgtgttagccaggatggtctcgatctcctgaccttgtgatccgcccaactaggcctcccagagtgctgggattacaggtgtgagctaccacacctggcctttcttaactaaatttttaaagcatgcactcccttgtaacctgacctacatgggtataaatatattctgtgtccttggggctaattcatcctgtccttcccagcccaacagatgtactgtgcaggctgtcagaaccctctccggttgtatgtaatcctgctcactgtggttatttaatcctgttgactgcttccttgtagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggtaatgtatgtcttgcctctcattgctgagcaaattgtcttcctgttttcagttactagctttcccacactctttttgtccagctgactggctttgaagaatggtgcacagtgccctggagtgagatttgaaataaacaattaaataaatgtgatccaaactattttccttaaagataggctttataaatctgtgtgtttgtcagacttttaaaaagaggcatctttcttcctgggggtagagctgaaggccaacctgataggtcctgtttggcagctggccctagtctagagatagaccagaaagagagaagttggagctcaggaagtaccagtcatacactaaaggttcttcactaatcatatattcacagtggaaaaaaagtctgtcattaacatttcttttgtatgcagatggtttaactaaacatttgagagaaggcctcaggaagttgagtaagtttgatttttccacttaatacccagagaatttccttatttcaaaatactctgttttcaattggtagtcaagatagataccttttatttttatgtatttttaaatttgaaaataacttgaaattttttgaaaagaagttttatcatggaaaaattagaaaatacatattagtatccattggtatttctcaagggcctactatgtcaggtactgttgtaggcactagaaatacctcagtgaacaaaacagaccaagatctcttgccttcctgtgtcattctaatgggtatagcaacaatcttccacacatgttcttcagagcattcttctgtgtacatatgcccatgcgtatatagctgtatatttaaaaacccagtggaaccacaatgagatactatttcacatccactggagtagttaaaataagtaacaagtgttaaggatgtggagaaatgggaactttcatacattgctgatgggaatgtaaaatggtgcagccactttggaaaacagtctggcagttcctcaaaatgttaaacagttcttatatgacctagcaagcccacttctagatacatactcaagataagtgaaaacatatgtctacacaaaaacttgtatacaaatgttcatagcaggccaggcgcagtggctcacacctgtaatcccagcactttgggaggccaagacaggtggatcacttgaggtcaggagtttgagaccagcttgatcaacatggtgaaaccccgtctctaccaaaaatacaaaattagccaggtggtggtgcatgcctgtaatcccagctgcttgggaggctgaggcaggaggatcgcttgaacccaggaggcagaggttgcagtgagccaagattgcaccattgcactccagcctaggcaacaagagtgaaactctgtctcaaaaaaaaaaaaaaaagaaaaaaaagttcatagcagcattagtcataatagtgtcatcttatgtggctattatgacccagatatttatcagctgatgagtgggtgacctaaatttggtataatacattggaatattattgagcaataaagggaataaagtacctacatgtggtacaacatggatgaactctgaaaacatactaagtgaaagaagccagacacaaaaggccacagattgtgtgatctcatttatacaaaatgtctaaaataggcaaatccacagacagaaagtagattaagggttgccagaggctagaggaagggagcaatgggaagtgactactaatgcatatggagtgtcttttgggggtgatgaaaatgttctagaattagatagtggtgatgattgcacaactctatactaaaaaccagatttttttgttcagaaaattgcatactttaaaagtgtgaattttatggtaatatgaattatatctcaatgaagtggttttttaaaaaatccaaatgagttaatactgtatgtaatgctttgcaacttgctttgtttttatctcatatcttttctatgtccttaactaatttttagatgatagtatagtaagtgtttaagagcttgactgtaaaacagacagatctgggtttgaagtatgatttccacttaataactttatgaaactaagcaagttacctagcttctctaagcctgtttccttatatgtatgatggaattttattttattttatattaatttaatttaatttaatttttgagacagcatcttgctttgttgcccaggctggagtgcactagcatgatctctgctcactgcagccttgacctcctgtgctcaactgagtctcccacctcagcttggagactcttggagactgagactacaggtgtgtggcaccatgcccagctattttttttttttgtagagatgaggtctccctatgttgtcctggctggtctcaaactcctgggctcaagtgatcctcctgcctcagccccccaaactgctgggatcacaggcaaaagccactgttccctgcctgatggaattttaaaagtacccacatccattgggtccttgtgtggattcgataattaatgtaaagcactaagctcagagcctggtttctggctctttggatgtttgtggttattgtaaaatctcagttttaatgactacatctgttgtatagatgtgccatactttaatcaatctcttattattagtcatttaggttaattctgatttttcagtattgtaaacaacactgcatttatagttttttaaatgttaaaaattgtgtattgcattcctaaaattttgagactggtgtagtagcaacactatgaactgtgagtcagaaagacttgggtttgaatcctggctccactggatgactttaaataagcaacttgcactttctgaaatccaaatccatgaaagatagatagttaataaaaacctgtctttcagaatattaattgttctaccataaagacatatgcacgtgtatgttcattgcagcactattcacaatggcaaagttatgatcaacctaaatggccatcaacggtagaccagataaagaaaaggtgatacatacacaccatacaacactacacagccataaaaaagaactagatcatggcctttgtagcaacatggatgcagctggagaccatagtcctaagtgaactcatataggaacagaaaaccaaatactgcttgttctcacttataagtgggagctaaacattgaatacccatggacacaaagaagggaacaacaggcaccaaggcctgcttgagagtggagagtgggaggagggagaggactgaaaaactacctgtggggtacgaggcttattacatgaataatgaagtaatctgtacaccagacccctgtgatacgcagtttacctatataacaaacttgcatgtgtgcccctgaacctaaaataaaagttaaaagaattaaataaatatctttcagctgtgatcattagaggcaatgaaaggaaatacctggcgtgtgataagtatccaacatatgacagctattattatgctgggttctgtatggaagggtttgtttctttttctctataataagtgagtagaatacatataatccttttatcattttccataacatttagcaagcctggcactatagttgagctcttttagctttgaggtaaaacatatatgctgaaaacttttaaatatttactgcaaaaatttctagggagttagtgaagcttcttcctgtattttgaaaaatagtatcgtatcattatatgttctaagtctgtgttctactgtattctgcagtaattctcaccataggaggaatttattattctgcaggaattctcacagtaagaatatcttccttccttccttccttccttccttccttccttccttccatccatccttccatccctctgtccctccttccctccttcccctttccctcccctccccttctctctttccttcgagagtctcgctctgtcacacagcctggagtgcagtggtatgatctcagctcactgcaacctccacatcctgagttcaagtgattctcccacctcagcctgccaagtagctgggactacagctccgcaccacaatgcctggctaatttttgtatcttttttttttttttttgagacggagtctcgctctgttgcccaggctggagtgcaatggcgcgatcttggctcactgcaacctccacctccctggttcaagcagttcccctgcctcagcctcacgagtagctgggattacaggctcaggccaccacgtccggctaatttttttgtatttttagcagaagtggggtttcaccatgttggccagactggaatttcttttagagttcatttgagccccctcttattttggagagttaggctgcttgtttggtgagaaaccagtgcaaaataatgggggctttttagttgaggttccattttgttctgagtcctggcttttggagctctggaagtgaagcagtgacagtgtcaccagaggagagtgaggatctgttcttgctggcatggcgttaatgctcttagggatacgtgttcagctggagattgaccctgatgatctatgttgggttcctaacaccatgttctccctaggcctccattttgctggctttatcctgctgagacattcttcagttatcttccaatccagcggtcacaccctggttacctgctgtcctttatcatacacccagattgtgactaaatttgctctcagagggtgattttattatgcccttgtgggggtaccttcctaagcaaccgcccattattatctgctcagaaagtagagagaacccaaacagcatttttgctgctggcctcttaaattttgttactagccttgactgcttggatgtaaggctgcctgcagcaagtcttcataagaacctctgttatcctcaccactctctttggctttcagtgacatcttccaaggagatgggcttccacctatagtatgtttttctatcagatagaggtttggtttttcatactggttttgtaactgctgccatttagggttgacacatgaaaaggagttgttacttatctttcttgcttatgacattcttgtagaatctgatgcagtttattgtgtgtccatgtccataaatggatagtcaggctgtattgaaccttgcaatcccaatcagaccctttgcaaaagaggaaaaagagtaggccatgtctcttgaactagaaagaccaaagagcagcccagctgctgctcttccactcctgcccttgctctttctcctcacctctgtaaacattgtgagccaggggcttccttcttctggtatagtggcctgattttgcccttgtccttggctctttagtgttattgcatgtcaggctctctggtcaccagctgtacttaatgtgtgccacattcagacagttctattaatttatcttaggctgctttcctagtctgcctagatgctggggagcctactttctaatggttgtggtagatggaaggatgaatggatttctagaagttgaattactaagtcaaagaccataaatattttaagctcttatattatctgttagatacattaatagacctttttttttttttaaatggagtctcaccctgttgcccaggctggagtgcagtagtgccatcttgactcactgcaatctctgcctcctgggttcaagcagttctcctgcctcagcctcctgagtagctgggattacaggtgcctgtcaccatgcgcgcctaatttttgtattttagtagagatggggtttcctcctgttggccaggttggtctcgaactcctgacttcaggtggtccacccacctcggcctcccaaagtgctggggttacagatgtgagccactgcgcccagtcaaccttctttttttttttaagttttttaaattaaaatttttttttctttttggctcccaacaggaaacaatagaccttcttagaagcagttagtataggatttgtaagtctcattaatgttgttagacattttttttttcaaatatttgttatttggatgaataaaacctggtattttctaattttagtttttatatattttaaaaattgtctttgaagttgttgggttttaagtttatgaattttgtaggaagtacaaacatacagcaagcttattttgacagcttgctgatctatagcgagggtttcctaccattcagatgtttgtttttttttttccccagagtagatcaagtttgtgaatagaaacaaaatagaccctcagtattctcatggggtatatcttaagaccttaaatcttcacattaattccatagcacaaaattttcctcagaaagtataacttaaaaagttaaatgatcttttcagaagcatctcgtgtagcatagttattaagagcaatggttttgacattagatagacttaagcttgaatcccaacactctgcttactaacggtgtgacctcttacaagttaacttaacctttccgatcctcaatttcttcttctctacagaaaatagggatagagatatctaccttattagactgttgggagcattaattaaaatattgtattttgaacatctgacatagtgcttagttcatagtaagcctcaagacctggtagcttctatcattattatagaaccaaagtcatttataaaattattgtaatcttactaaaacaaacataccacctttatattattttattatctgcatgggaacatttaccatgaatctgaaataaagttatcacttaacaagggttatgatgtactgaacgatgattagaaagagacaaagcagttgctgggtgaccagctgggctcactcattacccaggtgaattactccctcacatcaggcttgcaaatactattcaggtttgtgccttggcaaaatgacaaattgctacatatctcaaatggtttaaagtgcagttcttacctttccaaacgccaaggttctattatattgactgtagtttatttcagccatgcagttaagtaccagcctacctttctgcacatttcttcaactataccttcaatagtaaatccttgttatagtgatgacttactctccctggcctgcactaacaacttataaggtagccaaagataccacagtttcccccacttaacagagaaggaaactgacattcagagaagttcaccaaactgctttgcctagttcaccaagtagcaaaatcaggactagaacaatatttaaaggaataactttaaatattttaggaaattcaggagctaagatggaagcttataggctggatatccactcctctgtgcaaaagccatcaagctgacataaaaccagcagaccatttagaggatgataggtcatttgcttcttttttttttttttttttttttttttgagagggagcctcattctgtcacccaggctggagtgcagcggcatgatcctggctcactgcaacctctgccccccaggttcaactccctccacctcccaggttcggttcgagtgatcctcttgcctcagcctcccgagtagctgggacagcaggcgtgtgccaccactcccggctaatttttgtatttttagtaagggttttgctgtgttggctaggctggtcccgaacttctgacctcaagtgatccgcccgccttggcctcccagtgttggggttgggattacaggtgtgagacactgtgcctggcctgcttttttctttctttcttttttgtttttttttttttgagacggcgtctcaccctgtcgcccaggctggagtgcaatggtgcgatctaggctcactgcaacctctgcctcccgggttcaagtgattctcctgcctcctgagtagctgggattatagccatgcaccaccacatcctgctaatttgtgtatttttagtagagacagggtttcaccatgttggccaggctggaatcgaactcctgacctcaagtgatctgcccgcctcggcttcctgaagtgttgggattacaggtgtgagccaccgtgcccagctgcttttttctttcttatccactggtcccttaccaggctctctttcccatctcctttctattcccagtaggggaccctttcctttttctgttaccttccattgtttatatttcttctggattttagtaaattgatatatttgcatacactgtgtcctggatgtacattgaaacaagaaacagtacatatatttttttagcaaaagcttctatctgtatgttgaaagccttgacccctgaaatctaaactgataggtgtttctcccttgcattggttccaggggaaatcagccttatggtcccacctgttacattatcaggacaaccggcagagaaaactcacatcaggaagcctcagtacctcaggtaagatagtctctgcaatggagagtctgccctctctccacttttccatcacccactggcgtgatcactttgaagcaaactattccaggtcgaagaagcttttgctctggaatgttttctcttttaaatatggagccaccagactctctgaaccacagagcataccaaaaccatggcatttgctttcattatgtatttctataccctttttatcggcaagatagaaaatttatttgggcaagaggccagtctcagaatgaatatgggttttactgtggtactggtgtcctgggtttggagcaggctgttttcagagtcttttgttttatttctctgacatgggcattatgattatctatcccgttagtcaagagagctgttggtcagtgtccttccttggacctcctcaaagtcaagtcctggtgtgaatgatcccttatacttcctttctgtttctaacctaataaaaatgtcagagtttgtggcaactccagaggtcatctagtccaggccctttattttacaagaggaggaaacgagtctggagaggaattgaatttacttaagatcacaaagtgagctcatggaagaggccaaacaagagccagtcatcttatctcctgctctgatgtttagaccatcctacagtgtcctttccaggctagtctccctgcttcttttacttcttgggtgcatctccccttcacatcatcctttgttctccactctgccagacatttgtttacctttcttggatgtttttatcttaatggtaaaggtgagttaaatggggtaaaaagatgggcatgaactcgttgcccttgaactagttgaccttaactagcactgaacctggggagataattggctgaaaactagagacaagagttctccaggtaggcttatgaggaatttttttggcccgctttctggatgtgtaaaagcaggttcttattaagaatgctatagaagtcattgctgaggaataaactgtagccaaaaattctcaacagcttgatgatgaaaatactaagttttaaacattaggccagacatgaggatataaaggtattatatcttctcttctcctagaggtcctatcattctggaacagaaccagaacattcttgttctttatatattctcttgggcttttgtaggctgctgtgaagccagaacaggatgtgagtagtggctccaagtggaagcactgcttctgtggatcatggtgagagcatgatagactaggagccaggaggtctgtgttccagtactgactttgctgcttggtgacataggcaaagcagctaacctctctgaatgtcattttccttctctgttaagtgggggaaattgtgatatcttttttggctaccttataaattgttagagaattaaatgagataatatccataaaaatgtaaaattcggtctctagtaggaatttcataaatatttatgaaacaatcaattaaagtgttaccagtgtaaccacctgtttcccatagcaatttgtgatttaaggtaagggaagggcagtcagctatttggatattcagatctctttggacatgaccaacttgtttattctaggaatacttcttgattcagaacgtaggaagtctgatgccagctcactcatgcctcccctgaggatctccctgattcaggatatgaggtcagtatgggctcacatgtaataagccactaaaatcctgttttcagttgctgcttaggtgtccacttttagtaacaaggtctcagtggctgctacagcatctcagctaacatggaagccctcctaatcacaaagccttgtgtttcataatacatttgtaaagctgtacaaaccgttgggtttcctggcatttttggaggtgagggagcataggagagtatctcaggccctaagggctcagagttagcctggctttttaagggctgtactgtcttttttcctcccaaaatatggtgagcctatctggtaaagctacatggaagcccagtatttggagaatatagagataggctctcccagggtgagataagtctgtctcagcaggtctcctttggctttacaggtaagttattggcagtgagttcatctcccatcccaccctccacttcctttttacattcttcctccaggcacatccagaacatcggggaaatcaagactgatgtgggaaaggccagagcatgggtgcgactgtccatggaaaaaaagttactttccagacacctgaagcagctcctctcagaccatgagctcaccaagtaaggctgctccgccaggagtagaagcaggctcccaggaatggagggaagagattggaaacttgtgtgggaagggggagtattcagtgtgacattgctgctgcattcagctaacctctttgcttatgaaggttttgcagtatttcctcttctccctttttatcagtagaagaatacttccgctatattggttctccctgtcttctcaacctgcatgcccaaaactagctttcttggagaggtagtgggaaggatgaggtcttcctctccttcctgtattcaggtgacatgtatacctcttggacataaggcgtttcctttgtctctttcctgttctggggagcaaaggattggagaattaaaaggaaacttctgagatgtcctcttctctctcttgttcaacacatcatacccctcacccctctcgggatgtctgtagccttttcttgtctgtacttctgcatgaccctagtccctgtccacactctacctggtaaacttcttcagggctcagttttctttcccagagttttcctggactccccagaaacgtggttcatccctcttccaggcatgcataacatttgttagaatatttgttcatccccttttcaccatgatgtgttgtattatcattgtctatttgcttgctacttactgaagtttgctttcattgaaggcataaacctgtccctttcccaaggctgagcatgttgcttggcatccactagggattcagccagcccacataaaaggtatgcttagctgcacagacaggaggtggacagtctatgaagagtatatcttgatagaatgtccctcagtctctgggatttccagctagcccccaagactgtttgtagcttggagatgggataaggtggaggcagggttgtatattcatgggggctgtgtattcatgggacccactgaattctaaattccaaaggaagaaatgagttagctcccatatagggagcctaaactctttctccttaacttgtctgcagtgactaataccatgtagtgccccctttaccttgaaactcactttatgtggctgccatgaccttataccatcttgttctctttctccgcttactctttgcacagtgttggctttcaccatcttcaattctttgcatgcacacagtttctttgttgctttctcgcttgctctcttacttggtgatctcacccaattctcatgacttctctcacctctaagcaggagatgcccacatctgaagttctagccctgacatgtcttttaaactccactcctgcatttatttccattctgatattctatctttagctcagagagaacaaaagcaagcttcacagagtcttcaccataactactttactctcagattttttgttaatgtcaccactgtgctctctgaaaagcttacccccacttcttctccgtacctacactgaaaatttggagtcagttttgactccttgctttgctttatctcccacatacaggtttcaggttcttcacctctgtcccacctgtctccttaccatttttactgcacagacttagtttaatcctcatttccctttcacttctcacctgcactaaatttaaatttcctgaagttggtcatggctgtctctttttctagggcaaattgcagaaaccccttacttactgggcagattgcaaactccttagtttaaaattttaggaccttccttcatttgaatagccttttttttttttcatttgacacctttggtacagtagcttaacttcttagtctcattgctaactgatcacttccctgaaccctcaactccagccaaactggtttccaaacctgtctgtacaacagttgtctaaatttctgctgcccttcaggtccctcttgttctagaaggccttccaggaccactgaagcgtatggctctttaaattcccagaaacagccttttgtttgattattcattgtgagcagtcctataccatggcctttacctgatttattcacttagactgcatttgaggataggcgctttcctctccagcacctggacataacaggcctgggttgataaattatctgttgaaagtgccttgtaaacctggctaggtagaacctcacagttctgaattctgtacccgtctggccatggtgattgcagcttggacaaccaggacagttgtcttcttttgttctttgtgttgaaggcctgtacatttggctctgggtgtctcctctatttgggggaagatatcattgctttgaagctgcggagggcctggaatgtcaggcaaaggagttgacctctgatgaataggcagtgaaaatgaagggagaaagtttgaaaaaaggggaaggatatgatctgcatggctcttccttgcctgtgacctggatcagaggcgggagcagaagcctgccctttctcgcctctgaatctgtcctaggcttatacccccattcagagcagtgttctgacttgtggctctcagatctactcagggttcgaaactaggcctggtgatgaatggtgaccacagaccttcatccactgccactcacacaccatacactagctgacagcctagctagaagcctgagaagacctgtgtcatccttgatggaatttcattccagccctcagtttagaaaaggagatttcatgacttctgacacttgatattatagtaacatcaacataccttggacacaggcagtatttgatttttgttgttcctgctgtagcttaaaccgttgtccctctgtcccttagttagagtagctagctttgttcctttatagggtgaacctaaggaacttgaagcttgacatcttatgcttcccttagctgtctccttccagaactgaaaattctagtttctttcccttccttttggtcggagactgatgtattacctcctctccaacagaaagttatataagcgctatgccttcctgcgctgtgatgacgagaaggagcagttcctctatcacctcctgtctttcaatgccgtcgattacttttgcttcaccaatgtcttcacaactatccgtgagtagccctgtgctcccagctggccttctcaaggcagtctttatgaacctgcctgagactcactcattgtcccctttttaaagaaagaagattatcccttgtactttctatttgtcttttgcctctgtggggagagaggtgcacttgccctccttggaggctgtgttttctctgaagtttctcattcttgttctgaactggagagctcagtcttttttgccattgtgttgtcggtgttgtcctaggcactgctctgggagcctaagctgatgaaggtggagtggagtcagttgagctgatgcagtttacctccctccctgcatacccacaaagaatctcccttttgttttcgcctgagaggctcacttggcatcacagaatgtttcaaaccaggctgaagggaaaaagagctcttttctgaggtagcagaaagaactccagataccagtgggagatttcattctgggctcagctttggctaactcattatgtgtctgtgagcagagtctatcctgctgtgagtcccagtctctctatttacagaagagggaagagggttcaatatggtctaattccctttgagcctcttctttccctgatgccaggattctctactgggtggagggtagtctctgagtttgccacatggctagttctttggccagttactcagcagcatggactcttgtttctgtctgatgctgcatcttcccttttagagactagggctgtgggcttaatagaagtagccctggactggaatttagaagacccgaggcaaactttctttctctgtgccttggaaaaaggattgcaatacttcctctccaaagattatgattgttattagggttcatgagatgatagattgaagagtgctctaaaaagcagttcagtacaatgttaggagttggggatattgtttaacgaacaggttcatttagttctgagcctacagataggcttggatctttgatgtttgggtggtaagcctgagaggagtgaaattgaggaggggccatggggtagctggctaatattctacattagccagggactaggtcctggggccctcttgttccagggctctgcttgagctgagatagcaggagccacagttgtgccagccttcctggagcaggtcagagtcccatctggtatgggaaagattcctaattctcctcaatacttttgtggcttcccctaaacagtgatcccgtaccacattctgatcgtaccaagcaagaagctggggggctccatgttcactgccaacccatggatctgtatatcaggagaattgggtgagacacagatcatgcagattcccaggaatgtgctagagatgaccttcgaggtatgtgttatttggggccacagctctgtggggatctgagtttgcaacagccgctttggggagttttctgcagggtttttcagagggcttgctatgtacagtgtaatgcttcagcatagctgaccttcctgagatgatctgaggctggatccaaagactgaccctgaggagggggaccccaccctgtctaaacaatgtttggaaggcacttacttgtctggacatgcacatctctccatgcatagtgtgttgagaagtccccaggagttctttcagctactcagcccacctgttcccagagacctcagaacccacttccagaatctcttgctccctgaccctgttcttctaggtagagtgttttctttctcagccttgggcacccccatgagatagtgctgtaccgcagttctggcggtatgtagagccatgacctctaagcctgcagatgctgaggggtcaggttgcaggcagccagtcagatctgtgcctccgagaactactgttcttttctctgattttcctgacctacctcatcttctctattctctaatagtgccagaacttggggaagcttactactgtccagattggccatgataactctgggctgtatgccaaatggctggtggagtatgtgatggtcaggaatgagatcacaggacatacctacaagtaagtataccctcaggctgtaaggtagaggggcaaggtgtatctacaggagctcttcgatgcttgggtatgtggagttcccaaggagaccctttaggttgtgataacctgaggcaacttcctgtttggctctgcctcatacacttgaaagtaagtagaaggagggtttcttctgttgtttctttttctttcttttttttttttttgagacggagtcttgctctgtcacctaggctggagtgcagtggcgtgatcttggctcactgcagcctgtgcctcctgggctgaggcgattctcctgcctcagctccccgagtagctgggatgataggcatgcaccaccacgcccagctaattttgtgtttttagtagagacaggtttcgccatattgaccaggctggtcttgaactcctgaccgcaggtgatccggccgcctcggcctcccaaagtgctgggattacaggcatgagccatcaggcccagccagaaggagggtttctaggtgaagatgtgtggaattgctgtgcccagatcccaggccacctatgccactcagggtgattctctgatgatacatggtggaaccagcagagcattgaaggagtctctatcctggtttcagagcctatctccagggattggctttgttgatggctcttcctgtgagcagcagggaggagctggctgctctgacagtccattgtctgatcttcaggttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccagtaagtgggaggaggggttgggccctcatgccatacagtctagggaatgggtggatctctgtgagccctgataatgggaacctgggtcccagcctgtgcagctgcctcaggaaacacttctgctaacaaagccacctcacacatatggcacccttctcttatgaatcactgagagcatttggcactctccttagagggctggcaggagaggagagaactcatgctgccaaacctgggcgctgtatatattcatgcatgatccattaaaggagaggggcctactttctggactccccctgcctgattcctgggcttcacagccaaggcttggctctcttttggttacccacaattccaaggtaaaatggaaactaaactttaccagcatttcttagagatagaactctaaggtgttagcttttgtgtttttcccccaagatttgcggaagagctaaatcagcaaagctgggtgggcaagcgcctctgcttcctagggtccagctgccctgcctctcctatgggccctccccgtgtcctcagtctcctgctcaggcagctaagcactgttagcctcagagattggttagggatgtctgcttgatttttattagagctgaacactgggcagatccaggagtccatcggggaggcagtcaatggcattgtgaagcacttccataagcctgagaaagaggtgagccttcctgccctccaatccagggccttacattgaataagagagaataattttgtttttccgattatcttgttatgctcttccaggcccatgtgctgtggacaccctagagtcttgtagagtgtgtgcctcagctagttggagatggagcagactccttcctctgggggcctttgcctcaggttaccctgttttccctccatactgatgacccaatagagtccctgggcccctagtgaacagtgcctattcctgtcctcttctagatttgcctgggtctccttgaatagtggccacactggctttgtcctccagtggagaatctccttgtgtgtgacccagatccatcatctcttctttcatccatttattcagcagctcttcactgggagctgctctgagccaggcactgtgccaggtgttagggaaacagacaaagtcctagcctgtcttttgcagccctcccaactctgggctgtgggtttagggatgcaatggtgggagggcagctcggctgagacaagcctggcaccctcccctgtttccttacgtagcgaggcagtctgacgctgttgctctgtggagagtgtggccttgtctcggccttggaacaggctttccagcatggatttaaatcgccccggctcttcaaaaatgtcttcatttgggatttcctgggtgagttgagctggagtatgagggtgggagaagcatgtagagatataaggggactcaccagcatagcatgggtgctgaccactctgagaggcagaacccaaattaggtgactctcagatctcatttgtttgctctggtttttcttgaagggagtgacaagagctctcctccccgtccttggtaaatgcttacctcttgagaattgcacagaaaagattcttctagacatctgttatttagtatggacttagtcctgagtcctcacactttccccttatagatcccaaagtccagttgagcgtattggagccccaagccctgtgttgcacccatatggagaattttcatgcaagaaaccatcctcagaattttttgtgtcttcagactagggaaaagaacatctttatatcaagggccacatacataaatttaaaaaataaggatagggaagctaaggatcattttgaaacatgaccagtgacatcagaacacttgtgctattctcattaagttacctgtgtggacttggagaggcccatggcaagtggcctgtaggaccgtcagggttggtgttgagagccttttcactggcaagcttttctactcttcacagaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccaggtactgcagacccagggcccagagtgcacagcggttagccttggtggtggtgttggaggcctggtgcagtgcaggggtgaggaatggctcatcaggtgcccttagggagatgaggccttagaaggtttcctagaagccctgaatttcctctgtgtatcgtgtatggtcacacactgcataaaatgtgctgcgtaacaacatttgtcagtgacggactgtttatgggatgatggtcctataagattatactctgtttttactgtaccttttataggttgagatgtttaggtacccaaatacttaccattgtgttttagttgcctacggtattcagcacagtattccttcatttttattcttcaggctgctgtggcaggaagctccaggagaagtgtagaagagcaggcctgggggctggtgacagggctgtaccgatttgtagcttaggagcaacaggctagacatatagtaggctctaccatctaggtttgtatgagaaccctataaagttcgcatggtgacgaaactgtctaatgacacatttctcagactgtatccctgtcattaagcaacacgtgacttatgtgtgtggtgatctgtcggggtagggatgacaacgtgtatgtaactcggggcagaggggccccattttgaaaggaaagatcaaaatcacaccactggggaagtttgaagcagagtatatctagttattccttcattagacatttaaatggccttatggaagttggtaggaagacagctgaataaaacgtggccccttaccatttatttatttatttatttatttattttgagatggagtttcgctcttgttgcccaggctggagtgcaatggtgtgatctcggctcaccacaacctccgcctcctgggttcaagtgagtctcctgcctcagcctcccgagtagctgggattacaggcatgcgccatcacgcctggctagttttgtattgttagtagagacggggtttctccatgttggtcaggctggtcttgaactcctgacctcaggtgatctgccttccttggcctcccaaagtgctgaaattacaggcgtgagccaccatgcctggccaacatttagaagcttacttgtcctaattaaatacagagcatggaagaaggttttgagggtccaaaaatgaagtgtacattcatacaatatgctgaaaaggtagaggagaaagatcagagaagacttcagggaggagttggtatttaagtgagcctttaatggaaggaaataacagaacgtggcaagggcagtaataggaaacacagttgaaaggagggtagggcccctgagctgggacagagaaagattcttttcatattagtacaaagttgtttcatcaggggactgaagtaatattaatctgatattatgggtggtatgcattagagtggacatgattattaggggctattcctgtaggtcaggtgagagagcatgaagctcaaataaacttaaggcagtttattcaggctgcataaagggagagaattggcatagtggttaaaaacagactccagaaccgcattcactaggttcagatctcaagttatccatttactagccatgtgatcttggacaagctacttaacttccatctaccctactttcttcatctataaagtggggataataatagtacctacctcatatcacagggttatcatgaagattaaatctcttatgtcagtgccagcacatgctgagtgttatgtgaggttagtgcttattattattcctggtggtggtagctgtgggaggagagaagctctgggagacaccagtggtggggctgactaggcagggcgagggaggcaggggaggaggaggcttggaggctcatgacagggctgatttgggtcaggtttgtttggtgtcctggagctgaaagacctctttgccagtccctgtttgggaaaggggggtgtggggggctgtcagcttctccagcttcagacttagttcatggtttcccccttggccttgcactaacgctctctcttccttttcctttgcccctctgacctgcctggactgctcccgctctgccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaac

SEQ ID NO: 37737 - DNA, 29065 bp, Homo sapiens
ctcctgcgcacgcggcccggtcgctgtcggaagcggctgtgcgggtggcggccggcgcgcggtggggcatggcgggttcgcggggtgcggggcgcacggcggcgccgagcgtgcggccggagaagcggcggtctgagcccgaactggagcctgagcccgagccggaggtgactgtggcgatgcggggcggcggggcgcgtccctagagggcccggcgggcacgtggccgcgctggggcgggtgggcccggcttctgtcacctgggcgcccgcgcccagtgaatcggtcttgggcgtgggtgcagctcctctatcggggggtctcaggcagagcggactgcggggtaaaggacggcgtccgggaagcaaagaaacgggggagcggggagtggggacggggcgccccttgcagcagcctctccagccgttccatttgtgcatcctgccaataaaagggctcggcttgcgctcccagtaaatgcttaacctacgtatacgctagttaattgcgtttttatgctcatgggatagacatgagaataagaaaacctgaatagaacccagtgtctgctgcatttgctgtattagaactcactgttgctctctgctagctcagccctgtcttggttgtggggatcatcaaattgggtggtggaggggatggacagccagcccctcacagccccctcggccgcggccgcgctgggttgttgaaactgccccattgctttgtgaagcgaattcaactcatcctggctcccatgggctgaatggcccgcaggccactctaggcgccaggttctgcgacttccacccttggactaaacggtcctcaggagccagttgtttgcgcccaggccacggatgccatttccactagttattgtgattgtgtagccgactgaataccaagacacatcatgactctgtgtgagagaggcattgtgtgaacactcggtatgcaatagctaatacatgcaggtcgtaccttaagtgagacttgtaaactattaggaaaacagtaaaatctagaattctgcattcaactgcttcctttttcttttcttttccttttctttcttttttctttttttttttttttgagacagagcctggctctgttgcccaggctagagtgcagtggtgcagtcttggctcactgcagcttccacctcctggctaactcagcctcctgagtagctgggattagaggtgcccgccaccaccagctaatttttgtatttttagtagagatggtttcaccatgttggccaggctggtcttgaactcctgacctcaggtgatccacccgcctcagcctcccaaagtgttgggattacaggagtgagccactgtgcctggccttcaactgcttcctaagagtctaagttcttgttccaccctttaaggccagtgaaggacccgaacactgtgtgtgccggtgtcacgcagccagcagggctctgctcagaggcagctgtggtcctgctcagagagaggagtgggtgggttggtgcgtggttgcggttagagtctctatcattcctgtgactcttcagccaatcctttcaatttactgatcaatcgttggtcccaatctggttaaatgaggaggcgtctgcttcaggtggtaaaagccctttggggacccatttctcttccagcccccagccccttttctagtgacctcttggctctggggccttggatgccagggtgaggtgtggagagggctcaggcaggctgtctgagggacccagtggagtccagcccagcctgaccccacagggcctccggagtgtcagtgggtggtagagagcagtgttagttttgcgatgagagctgagctccaagaggaggaggttgtccttgaaaagccccttccctgtgaggtgctaggaattaaaatgtcgatggcaaaggcaagaggctgtcttgtcagtggaggtagaagatgaggaaggctcaggttgggtggatgcttttggtggaagtttgtgactggaggggtgtggtcctggaggccacatggagctgctggtgggtggctggaggggcgagaggcagctctccctgcagtgttcagtgccccatgcctggaggggcagttgtcaccaacccagtgtttccttgcagccccccctcctctgcacctctcctctcagccacagcaccggcagcgattctggcgtctccgacagcgaggagagtgtgttctcaggcctggaagattccggcagtgacagcagtgaggatgatgacgaaggcgacgaggagggagaggacggagcccttgatgacgagggccacagtgggattaaaaagaccactgaggagcaggtgcaggtgggtgagcgaggagccccctcgagggctgtcccccatgtgcaggtggccttgggctttctgagactgccactgtactgccttctccaccgtccctcagaaccccaaggccggcgtccctccttcactgcacctggggcacgcttgggctctaggacgctggtttccatccccagttgcgtgccgttcccaggaactctgaaaatccacatgcctaggcccttccccgtcagacgatgctcgggcaaccctcctggcaacaggttgggtttccttgaggtggggattttactgcttggaatccagtggcaggacccagctgaggagggagctgagcagcatggcagggctcaagcaggcggcatgggggccccaacggaacccagctgggcctgaccccacagggcttcaggggcctgagcagccgacgggtagagggtttaacattgtacctgttgcagcgatggtgggggaggatgcaccctactcttattgagaacaacaggagaaaagcataatttaactaaaacacagcatttgttatttttttttattttttatttttttgagacagagtcttactctgtcgcccaggctggagtgcagtggtgtgatcttggctcactgcaagtaattctcctgcctcagcctctctagtagctgggattacaggtacatgccatcacgcccggctaatttttgtacttttagtagagacagggttttgccgtgttggccaggctggtctcgatttcctgacctcaggtgagccaccacgcccggcctattttttttttttttttctaagacagagtcttgctctgttgcccaggctggagtgcagtggggcgatcttggctcactgcatcttccacctcctgggttcaaacaattctcctgtctcagcctcctgagtagctgggattacaggtgcccactaccaggctcggctaatttttttttgtatgtttagtagtgacggggtttcaccatgttggccaggctggtctcgaactcctgacctcaagtgatctgcctgccttggcctcccaaagtgctgggattacaggtgtgagccaccgcgcccagcccagcatttgttactctaaacattctggaaatcgtttgtaaggatttactctcccagtagtttcggtgttctggaagttacggccttggcagaggtccccgtgatagaagccaaggaaccatggcttgttcattgtgtgctagctgtgttgggttggcttgtttgctgggaagaaaagatttaaaatcacacttaattcaggctttaattataccactaacatacacagagaaaaaatgatgtgctgtgttggcagtggtttgtaagattatggacaactacgttaccccttcttgagtttttaaaatgatacaatactgggccaggcacagtggctcatacctgtaatcccagcagctcgagaggccaaagtgggaggatctcctgagcccaggaatccaggtcacagtgagctatgatagagccactgcactccagcctgggtgacaagcaagaccctgtttcaaaaaaaaattatgagataaaacatcctggaaaataatgtagatattgtagcagcaccattcagtagggtggaagctcccactcagggccctcacacctaacccgtgagcacagttagtggtctggtgtacatctttctgggtcttctgtccctttttaaattaaggatttacacatttacatgttaatgatttttttattaaattctttcagcgggcgtggtggctcacgcctgtaatcccagcactttgggaggctaaggtggatggatcacctgagctcaggagttcaagaccagcctggctaacatggtgaaaccctgtctctactaaaaatataaaaattagctgggcgtggtggcgcgtgcctgtaatcccagctactcgggaggctgaggcgttagaatcacttgaacctgggaggcggaggttgcagtgagccgagatctcaccactgcactccagtctgggtgacagagtgaggctctgcctcaaaaaccaaaacaatgttttcgcataataacatatccaagtacttgaaaggtactagaggtgtctgcggagtctagggaggcgccatcttctcttctcgctgcttgtctcctggcccctggagcaccaggtcctctgcactgctgagtgtgtgcttgtcctgcccattgccctgctcgggtttctgtgactgcgtaactggctgccccatgcagggtgttttccaaagtaccgctgtctgtggtctgtgtgctccgtcatccagcagggcctgaggtggcaaggccggccgggctggtggggcggtcctcagagttccccacgctgctggctgcccaagtccctgcctgaggccctgccctgttgtggcgctcatgcacctgcccgcgtgtcctgtgctttagctgaggggccgaggccctgccctgccatggcgcccgtgcatctgcccgcgtgtcctgtgctttagctgggaggccgaggccctgccctgccgtggcgcccatgcacctgcccgcgtgtcctgtgctttagctgaggggccgaggccctgccctgccgtggcgcccatgcacctgcccgcgtgtcctgtgctttagctgaggggctgaggccctgccctgccatggcgcccgtgcatctgcccgcgtgtcctgtgctttagctgaggggcaccttgggccctgtcagggtgttttcagttctaaagtgtgatcctcatgactgggtttaaattcttccaggtcaggagaatgaattgatgaggtgggggtgctttcagcttcttagtgggaacccctcccttttcccccctgttcatcagaagccacccaggcaccttggcctgctgagcggccactccctcctgcctgccctccgcgcccctcttgaatggtgggagtcctttcccattgtgcagccctgcaggtggaaactcagccggcagcccagtgctgcctcctgcatgttctcttggcttccatgagcgtggccacgtgaggcctcccagagtgccgccaagatggccccgtcatgcccagttagtggcctcaggttaggcctgtttctgtgtcatcccgaaggcagtccagggctccttacgcctgtatctccgccacctcccactcgcatcgtgggtccacggggccgggccaccaggggctctgccagacaccctcgcccgccacagccatctggaggattctgcccccgatgcccctgccagtggttgtgggtcctcaacccaagaacccttccgttgagcggcttctagaatcagtgccccttggttctgggaattcacaccacagtgacacagcagcttctcctgctgctaagtgtccttgccctgcagtgggcgcacctgggattctgtggtcctggccacggccactcgtgtggtcttgcagatggttcatgggcctcggtgggttacttggtaagtgagggtaatgtctgcctggcagcccctgaaggacgagatgatgtttttgctaatttctcttctgccacgtgcttctgcctgtccccccactccctcctgtcgctgtttcctccacagtggttggcaagacgtggcccctgtggcctctgcctcgtgcatctgaaggacatcccagccacagcatcacatcagactggaacagtggcgggatggggctgggcatcaggcagcatgcatgtgtcatgtcacggacacctcagggacacacgaagtcaggcagggcgagggcctcactccccaggccgcctagcccttggtgggtatacccggccccgatggtgctgtgaagaaggggctgtgtgactggcatgggagggagctgcggcttttgttcatctctgccatcctggcagcgatgtggctgatgggtcaccttcagagagcctcctccataaatctgattccaagtgtgtgccccaaaccaacccagaccggcccggggcgtcctgcggagagccccacagtgggaggcccttgtagcggggagcccggtgactgctgggggtcagctgctggcggcccctgtggagacctggcgacctgccaagggctccggacctgcctgggtggacccagggtgggcgtgcttctggctgcagggccgggccacaggcttccctctggctttctgccctcaggcctttagcattgacatgcacacgaccctgcctcctttctaaggactgtgtagaattacgtggcattcagtgagcagctgcacgtggtgttctagggcacctttggatgctcaggtgctcctgaggggtgtgccagggaacgagtctcctacccttccctcctggctcctgttgctgcatccaggcaactactgtttccagtgctgaagtctctttccaggatgttctagacatatccaaactcgcacagagtttttgaatggtggtttcttaagagaaggggcagccgtgcgctgtctcaggatggttctgtcagggaggccatggctctggtttgtacagtgcttggtgcccgtagagtgcctggcagctcggcctcaacagctccagtgggtgggcagttgcaggcttttgctcttacagttgacctgacagtaacatgctgtttctcacatgtgcacaccattcttggggaaaattccaagagaatttctaggtcaaaggataaatgcttttttttgtttgagacagggtctcactctgtcactcaggctggagggcagtggtgcgatgttggctcaccaaaatctcaacttcctgggctcaagggatcctcctacctcagcctccctggtagctgggactacagggtccccgccaccatgcctggctagttttgttttgttttgttttgttttgttttttgagacagagtctcgctctgtcgcccaggctggagtacggtggtgcaatctcggctcactgcaacctccacctcctgggttcaagtgattctcccgcctcagcctcctgagtagccgggattacaggcgcccgtcatcacgcccggctaatgtctgtatttttaggagagacgggtttcaccatgttggctgagctggtctcgaactcctgacctcaggtaatccacctgtcttggcctcctgaagtgctgggatgacaggcgtgagccgccgcacctggccatcaatgcatttaattgtgaaggtgcttggagcgtccctccgctaggcggtgatgccatgcactactgcagccgcccctcagctgctttcccaccaccagcctccctcatggtgttgctgcttcatcttttcctcttgtttagtgatgtttttctttcattaagaatgaggctcgcacagctgggcttaactgaaaaaataaaaataaaaagaatgagtcacaggctgggcccagtggctcacacctgtaatcccagcactttgggaggccaaggcaggtggatctcttgagcccaggagttcaagaccagcctgtgccatataatgagaccccatttttacagaaaatttaaaaaatgagccaggcatggcggtgcgtgcccgtggtcccagtcccggaagcccttctgtctcttccctgtggcggcatcatccatgcacttagctggctggaaaccctcatggctgttgcccaagggcaggacagctagctggttcttgtcattttggtctgagctccctgggccaggagccctttgctgttttctctctgtttgtttgttttgttatctggcaccacaacaaactgccccaaaccatggagcctttcttttttttttttttttttttttttttgagatggagtttttttgctcttatcgcccaggctggagtgcagtggcacaatctcggctcactgcaacttctgcctcctgggttcaagcgattctcgtgcctcaacctcctgagtagctgggattacagatgccagccaccacgctcgggtaattttttttttttttgtatttttagtagagagggagtgtcaccatgttggccaggctggtcttgaactcctgacctcaggtaatccacctgccttggcctcccaaagtgctgggattacaggcgtgagccaccgcacctggccaccatagtgcctttcaacaacgagcatttgctgtctgtgtttctggggtcaggagtcctggtgttttgtgaggtgcactcaaggagcagggtctggctgtgccctttgcagctcctcccctgactgttggcatgaggagctcaggagtgaaggtgaagaagggtactctgtgtctggggggtggtcagaggatagggatgaggacagggacagggcccaagaagatggggtgggtgctgtacctccctcttccttccctggggtatctgtgggccacggcagggcccacagctgttgctagtagcctccttggggccagtgggtttgatttatttttgtgtttgtgtggtttgagggcaggcatcccttccccaccctttgcgtccctgctacagtgacccctctttctgggtccacctgctctggcacgagcttggtgggccagcctcaccccagggcccaccccatctccagcctccctgccttgggcctggcagtcctgcctcttaattgcgttctgtgccacctgatgacccacgagttctgtctcctggcctggttcctactccctgggactttctgcagcccctgcccttccagctgttgactgtgtctgcgagccatcccactggaggggcgccctgggctgtgtgctccctgccctgcagcacccctgacacgggtgctcccagccctccactgaccagccagggaggaagctgcctcctgccggcctgtgcctcgcttcctgtcccctctccagcagcacacggcagcgcgggccgcgggctcaccggagcgaggactggttgcagggccttctctttatcgctggtgtctagtggatctgtggggtccgtgcgctcagagctgttttttcctttctgtgctcatttagattcatttttttcccagctttgcttggttttgtcttttcatttatgtgagtttttctttttattattttgtgcagaagtttctgtttttatcagtttaatctgcttgtcacagtcaagaatgtgagaaaagactggatgcggtgagccaaacctgtaatcccagcactttgggaggccaaggtgggcggatcacttgaggagttcgagaccagcccggccaacatggtgaaacctcatgtgaattgcttgagcctgggaggcggaagttagagtaagctgagatcatgccactgcctccatcctgggtgacagagtgagtgggactctgtcttgaaagaaaaaagcactagtaagagaaggcctaagacctagtattaaagtaagagaaggcctaagacctggtatgaaagtgagagaaggccaaagacctggtattaaactgagggaaggccgaagacctggtattaaagtgagagaaggccaaagacctggtatgaaagtgagggaaggcctaagacctggtattaaactgagggaaggccgaagacctggtattaaactgagggaaggcctaagacctggtattaaactgagagaaggccgaagacctggtattaaagtgagagaaggcctaagacctggtatgaaagtgagagaaggccgaagacctggtatgaaagtgagagaaggccgaagacctggtatgaaagtgagagaaggccgaagacctggtatgaaagtgagagaaggccgaagacctggtattaaagtgagagaaggccaaagacctggtattaaactgagagaaggcctaagacctggtatgaaagtgagagaaggccgaagacctggtattaaagtgatgattccagatttttttttttttctgagacaagagtctgtctgtcacccgggctggagtgcaatagcctgatctcagctcactgcagtctccaccccccagattcaagcagttctttctcctgcctcagcctcccgctgtgattacaggtgagcgccaccaagcccagctaattttttgtatttttagtagagacagggttttccatgtaggccagtctggtctcgaactcttaacctcaactgatccgcctgcctcggtctcccaaagtgctgggatgacaggtgtgagccactgggcccggccttcccagataatttaaggagagtttggcctgtgccggagcataatgcacactcttgggcaggggatcccgccagcgtctcagcgaaggctctgggaatggcaggtggcaggccgcgttgctgcagcgtgggaaccctgggctcgggccccctgtcgctgtggttctggggtctgggtgctggtgccgtctgctggagagtggtctggagctgcagctctgtggagtctggaaaggggctgcccagtgattctcaccagctagtcagtggtggagaagttgcctgggtgtggaccacagagctggggatggaaccaggggccagggctggtggtaaactccgctcttgcctctgcctgtggccttgctttgggttcttttgaagactgccagctccaagcttcttggcccccatgggggagtcaggcagctgttctgccacctgccctgacactttgcagcatcaaacagatattttgtagcattctggattcgaggggtcagagttcaggccgaaagcagcagggtcagtacaccctgagtacagtgtcatgctgaggggccggggagccccagagggttctggtacattccacctgaggaagatcgacactcagctcacatcctgtgctctgggacttgggtgaggatctcaggtgagcacagccgggcctcttgtgtgtccagaccgcccctgacagccatgttcacgaagggtacccctgtccagctgtcccctctcccagggctcagggctgcaaggacgtggtctcctgtgccaggcagagccacacggccttcacgacctcagcccagaatcctgtggtgtcagtgtgggctgcctcccttgggtgggtaaagcagccacaagcccacccagatttgcggcgggggggacatagactctgtctcttgatgcgatgaaaatcaaaggtttgtggccgtgttttaaaatggtcacagtcacccttacgcttgccaaatagtctcttcccccagcgctccccagaacctcattccactgccagggtctcatctaaaccaggcctgatagatgggggtccttgggcccctctctgcacagctgtctgcagtggggcaccgagtcacagtgctgtggagtggtctctggtctgtggtggtcctaaggtggctgagcacatggctggtggtggtcttggccatggtggtcttggcccgtggtggtcttggggcctgtggtggtcgtggcccatggtggttgtggcctgtgatcgtcagggcccatggtggtataggggacctgtggcagttgtggcctgtggtgatcgtggggcccatggtggtcttagggcctgtggcggtcgtggcacgcagtggtcttggggcctgtccttgagacccatgatggtcttgagacccgtggtggtcgtggcctgtggtggtcttgaggcccatgggggtcatggcccatggcggtcgtggcccgtgacggtcatggcccttggtggtcatggcccgtggtggtcttggggcctctggtggcagcacacatggccagtgcctcatgcagggttggcctccatgcctgggaacgaccctgccactcttgggctcctgccccgagttaccttccttttccctgagtaaaaagggatgtttttcggctgtattttctctgggcttttcagttcctgctgatgtactttctttaaaacaaaatgtgggtttcctaggtacctgttgatgagtcgttgctgtcacacgagccatcggcacagagctcttggatagcagcctgtctctgtgctgggcaccctgcggctagcgtgggcagggccctagggagccttggccgtgctgaggtgctgggtgtggggtctgtggtgcagcgctgggttgtcttggtgtccttggcaccccgacagcgatgttctggctctggtctctgggcaagttaggactgcttccctcctgctgtccacgtctccagcagaaccctcttgtgggcagccctgggagcagagttctcttcccaccgaaccgggacaccgcagctctgtcgccatcctctcccaggaggtgagggcagagcccgtgtctcatgcctggttggtggcagtggggcacggcctggctggcctgatgctggggaggggaggctctggtgtggtcacaatagggggctcatgcgcttggacaccgtttctgtctggctgagcccactgtgggtttctccctttggtcctcatggtgacattctagccctggggctgggcagaggccacgcagggttcagggactacagcagcctttccttggccccagcggccccgcatcctgctggcacctcgtccttgcgctccccctcggcggctccctgcccacccgtcggtccttcagacccgcctgcctctgcccagtggcgctcgcccgcccactctctcagcttttacttcaccctcacgcaactctcgtgctccatcgggcccgacccctcctcagtcaggccacgcacactgcgggtggtgctggagaccctggagaatccgggctgactccaggcatgggcgtggcgggagggggtcctgtccccaggagtccggagcgtggcgtgggctcatgttccgttgtctgtgtcgttagggttttggtggccttttcctctaatttttaagttaaaaaaaatacgttcaatgccccacagcatctgcctccaaaatctgaaggggccttctaggtcaggcagttcccagcagtggccgcccctgcctgcaccgcccctgcctgcaccgcccctgcctgcaccgcccctgcctgcaccgcccctgcccgcaccgcccctgcccttcgggcgctgggcctggctgagcgctgtcgccccctggtggactctgtgccccacagctgtcccacggggatgctgcgcccctgggaacccagcaccttcgaaggccacctctgccccctgcccagagcctgcctgtgccgtggcctgtccacatccagcacaggggccacggggcacagagcgctgggtgacaagtcttttgtcacctgccaggaccctgggactgcggcccatgagcagcgaggctgggactccagcgtgcggtgcttcagccccggccactgtgagggttcgggagcccagcccggtacccgtccgcagaggccaggcgggggcagccgaccgcagccgggtgtggaactgcccttgtgcgcgtctggggcttggggccggggtcacggatctgctgcggctgtgggggctcatgtgctccaggcaggggcaagagctccgtgtcactgagcgccccaggccactgtcagcagcagggggagacgtggaaactgaatccttccttgttcctggcctgggaaaaaacttagtctcccatctctctttatattgaaggaaaaaacaggcaggggaggagcccgggccggagagaagaggggctcggggtgggggcgggggcgtgcccgccttcgctctggggttcctgcgcccgagcactttactgcccccacgggtgagaggtgggcctgttttccccatcagccttggttccgccagtaaacccgatccggttggagccatcctcacctccgcagtcgagggcagaatctgttttccaggttgggatgtgaattctcagtggcgcccactctgtgacccggcgggatggggtcagcctgggctgtggacgtggtgggtgggagaacgctgggcaggccttctgagtgttcggggccctctctgggccctctgctggctggactgggcgggacgtggcccccgggatgggtggacaatgtgtgtcccccgccccttcaagagcattggccccagtgaccctgctgcgacggctgcgtctccttcttccccccgaccatgctgcccccgtcccaggcggggctcggcaggagcgccatgtggggcccctgggaggagtcctgtggctttgacatgaatgggggtgcgggtggttggcggtgggtcttggtcctcagctggcggctttgctcctgactgccccagtggcttccgtgtctagcctgacacccgtgtcagcccagggacagaggccccgggaggctgcagtccagccctcacagaggacagggccgtgggcaggacctgcggcgccgggtgccagccacagcccccagaggcccccttagagctgggtgttctcggccttgtgctgaggcctgtgccaggctggagctgctcagagatttcggggtggtgggcttcctgggatccccccaaggtcaaagggtaccctgtatcccctgaagtaaccattttctctctctctctgcaggccagcactccttgcccgaggacagagatggcgagcgcccggattggggatgagtatgcggaggacagctctgatgaggaggtaggactggggctgcttcccactgggcagggtggggcggcttccatcacagcctagcaggtgctgggggttggggctggggttgccctgggggtgctgggacctgccgcaggtgggccgcactgttggagccgaggcccacgtgggcgtcctgcttccccatctgcaagagcaatttcggggtctgggacacaagactgcaatgtatgtgtgtcatcatggcttgtgaaggggaaggacctgggtgtggctccatgcccctgtgtctggcctgtggacgggctctgggggctcctgtggcgtctgcagggtggctgtgggctccctgggcgtggcgtgcatggtctgggtgggggtcatggtcggggtgggggtcacgggcatgggtggtgcccctgtcgtgtgtgctgtggggtgggccacaggttggctgggggccaggcgggcagaacagggccagggccacctcctaatgtcctgatgttctgggcagtggtggcccttcccttcccctggggtccccctgccccccacccctggtggtggctgatgtgggctggggccgttgcctctggacctctgactgagtcccaggagcacatctcaggaggggcaggaggtcggctgtttctcataaggagcttgcaggcgaagggggatgcgtgctgctgggctgggctccaccagcgtggagaggctggcaccgggctgggctccgccagcgtggagaggctggcaccgggctgggttccgccagcgtggagaggctggcaccgggctgggttccgccggcgtggagaggctggcactgggctgtgtccaagagcagatttggctgcggggggctgccctcatttgggaggggctggaagctctgagaagctctgaagccagaggcagtgcctgcctataccctcctcagtgtggcctggccccagggtaggactgtggtcccagtggagcacctgggtgtgaggcagagtctcctttgggccctgggggctgtgggggaaggagaaggctttggtgtagggccttcctgaaggagctcttcctgcctgcctgtcaggaactgtccccggggggcctgggggagacacgcgcccccctccccccaggttcttcccccatccttcggctctcttggctgtggctgcaggagccttggccgcccgcccgatccggtctctgctgcgcgttcagagaacagagacaaaacaaaataaattggtttcctggccggagcagcgggctcactcagagcgggggggccacgccgcgcactccctgcctgtctcccctccccctcccaggggctctggctgtcggcagccacatcctgtcggctacttttttatatttggtattttgagaaatcgatgatgattgtaaacggagcgcggaggccgggggaggggcctcggcggggcctgtgggaccctgctgcccctgggggtgctttgccaggcctgtccagtgccaccgccgcctgccgggtgggcagccccctgctgtgctgggaggaagccggccagggatgtgggggctgcttcctccagtgatgactatcccatatgttggtctgagtgacagcgagggagcccgggtgctgcccggtgctcctgccagcacagccggccagtggctcgagggggcggcagagctcagctttcaggagccaggccaggcccggacagatgcctcccgtccagagaagtgcgcatctgcctgggcctctgttcccttggagcaaagtggggtggccctaggggagtgatttggggccacaggtgggcaggaaagaggcttgggaggtgggagacagcctgcagctctcccatgagacagtggggtgaggagagcagggcccgtcaggcagccccgtgtccttggaggtggccgtggcaccaggaccatggtcctcctcggcactgggcagagctggctgagagagggccgacctcactgccggggcccttcagggctgtggagagggcccctggtagcagggcagggagggcgccgctggggcgtgtgctcctgcgagcggcgatctcagctggagcgcgtgggtggcagtggctgtgatgctgagaaggtctcgggccaagctcctgctggtgggaggtgcctccctgccaccccctgcccacctacctccccttctcctcaggccacttccctgcccttcctgggtctggatccagggcctggacctggatgacactggggcttcagggaccccctgctggacgctgacttttgaagacctgagcagcccctcacaggagagctgtactccagctcttggtgtcttattcccctcccccaggtgcgcaggcagcagcgagcaggcggagggaggcgggcggagcccctggaggaggcgctgggcctggctggggtcctgccgccggcagtggggggcccccaggagccggctgagctgcggctgccccgcccccgcatggccacctcacccctctcccaccgcgcctggagcttcacagacgtgatctcatccagccgctgggacccccggggaggtgggccggggtggaggggcggggcaagggggctctcggcctttgccgaagcagcccctccgctttgatttgagcggttgggagaaactgaggccgggtggctgctcaggcagaggatgcagccacccaccctccccctgcctgtggccgtgtttgtcaggaaagcgtagcaggctgagggatctgggtggccgtccactctggccggaggagccgccctctgctgtccctttcctgtgccccgtggtgctggcctggggccgtcccccacgaggcctccactggggcctggagtctggggctggggtgcagcctggcagctcctcggtgcccctgaccctgcctgggctgtgagtcaggttcccgcagggatgcagccgggcctgtctgcgtccagagcccgtggtcccctctgctctcgcgccaagcgccgttaatggcttctcccagctactgaaccggcagctgcctccagtgctggcggcctccgctcctccgggccgcccccgcccccgcgtcctggccccgcgcactcaggcttgcgtcgctgctggcggcgcggcctcggctcaggtttcccggcgagcgaacggccctccccacgctgcttgtggagggcgcccgggcctgcagaccgccccaatctccctggcggccatccacccccgcggcctcctgcatgcctgcctccgagggggctgctgactgggctggggctggccctcgggtctggtccctttccactgaggagggaaacgggcgcgccctgctacccaggctgtgggtgggtgtgtgtagcctgactgccgcgtgccccttggccggcttgaaggccctcctaggcctggcctgctgcactcagttgtccggtttgggagaggagagaccctggggtcagtgatgaggggcagggaagccagggccctcatgggggtaccctgggctctcggatgaagcagggctgggcagtggctggtaggtgggagtggcctcttcagagccgcgtcctcctgcttgtgggctgcaagggtggtgggggccctggcctgctgtgcccactcggggccagtgtccttggcagctggaacccgggtgggcagcggggggtgctctacagggctcttgagcggaggctttgccctggggctggcagagcagcctgtggagtggagccggggaaggcattggagggcaaggtctgttgggcaggtggtgacggctgcaggctctgggccctctggggaggccggctggggagagctgggtctgggtgtacgtcccaaggccggggctgttctgcaggggacgggagtcccaggtacgtgtgtgtgcacggatcaggactgggggaaaagtctccagaatgagattttggaggtgtccggagttgggggctgagcgggtgtggacctctagagccctgtccccaccccacctggaagttgtagctctgagttgtggggctcagagcaggccgaggaggggtgagcactggtgggtgtcggtggggggtgtttggggtgtcatgccccaagcctgtgccccacccccagcatcctggtttctgggagcccctgcttatgagatgccaggcgttggggtgctctgcctgggaacagctattgtccctgggtcagccccagcagagaccgaggcaggccaggtctggaggaacccctgggtcggtagtggcttctctccagcctgcagacccccaggaggtgacttgctgccctcccagctgtggaggtgcaaggacccctgggtcagtagtggcttctctccagtggtggaggtgccgggagaaggccgagctgtgtgcccagcctctagaagggcagatgcgtggttggcgggagccgggccggagctgagggcgtctgggctggtggctcctcctgcctggggccccaccttgggctgggggttcgctcagctggtttggactttgaggaggaggagactaagcaggacctggctttctcccctctggccccggcgccagggcccagcacccctgctggaaccttcagtagggtgagatgcagcaggtgagcctcccgccctggccttgccctgagcacttcaacagataaaaccctgaggaagaggaggcggcctcacgtcgcacaggaaggccgtgtggcgctccgagacaggcgggcgttttgtgcaggggagcggcgcgaacgctgaacactacccgcattgtaatcggagaggggctggggaagagagagacggagcgagggcggctgaccccacgctcccgggggacaggtgggagaggcggaacgaggagagagtgaaggattccagaggtgggccggcttcctctctcgcagacagacacgggaggaggcgggcagcgggccagccccatacctgcagttccaatctgtggtcctgacagctgcagccactttggggagggggagggaagggggctcatcgagagcggaaaaatcccagccgacacatcagccggttgcggcctgtgtccggtgcagtctgggctgggggcctgtccttggggctgggcggcccccaggagagccctgatgctgggtctgtgtgtgcccccggccggccggccggggctctccgtgcggggcctgacccggaggggtcacatgtgtttcctggcagcccgcaggtgctgcgctgggcggggcgggtggtgggcgcaggcgaccgtgatgaatcatgtgtcccgccagcagctcgttccccaggccggggacaggagctgacagctgaggcccagcagagcgtttccagcccagctcggctcgcaggggcggctgctggcccaaggtgcaggctggggccccttccgtcccagctgcctctgtggggcacaggcggagggagccctgggtctctgtggaggtgaggccagcactctgggaagggagccaggggctgtggtgggcagggagcacctgccactcgtctgcccggcggctgtgagctacgagtggattcgggtgggctgccgcaggcctgggggtcagcccacgccacccccggtctggtttgaatttctggagcagtggagggtgacggagtgttcctcccccgcccctcccctcttgctggctggcgggccgggccctcggccgctgctaccggtgcagctcagggagcggctgggctggctgcccaggcctgaggctggccaagctgcagccgcggtcggagtcaggcccgcagcggagggcttggctgtgagtgctgcaccccaaccagcagggccctggggatcctttcagctccgaggcctccaggtcgttgttccctgttcactttcttctagcctcgttagacaccccaaactctgaccccagtccacgggggctctgacatctctttcccctgcactccctcttgaccctgcccagacctccccatgctggcccgcaccttcccacctgctcctgtctggcctcctgcattcccgctctgagctggctctgccctgtccttggtgccggccgccgacgccccgcacctgcccgctcaggccagcagcccctgatgtccctgccctggagactttcactatcttccatcccatttgtccccaacgttgaccggccactgaggttgggggttcatgtggaggtttgcaacccccactaggcccaggtctggaaatgggaggcctggaggtgaggggtaggtgggctatggaccctccctacagaactacacccagtgcccagtggagggagggctggcgtgggcgccgtgggccttagggtgctatgcagagtgcccggcctggccatgctcctgggtccaccctgctcctcactcaccagcgccttggtgcctgggagggtggcggggcgggggtgtgaggaaagctcccaagaagggaaggggctgcgtcagcccctagctgcatgtccgtgtcccccgggccctggcttcccggcgggcggaggcttctgcagtgactgagcttgtcctctcctcccctccctctggccagctgtgggctcctgcaggattagggagaggaaatttggggttgggtttctctctgaacgaaacctgccgttgtgactttttatcctgttatatttctatcagattggactcagcccccctctagcccttaatggctctggctttgagaatttcctccaaaattacaccactgcttcctgctccgccattccctggagcctgtctttgcagaggaggggcagtcctgggccagccctgcaccgatgcccacgtgggccacagcacctggtctccccccgagggtgcgtccctgcctgtgctagcggggaactggggccggccgccgccctgacgcccgcacctggcaccatcagccattgtccacccagccggaagttaggctgtggcctggcagggttggggggaggtggtccacacagcaccgcccttcttctctctgtgcccactgatctcacaccactcaatggtaattgtcacctgcagggttttaatggccagccagctgtgcacagagcactgtgggggctaaacccacctcctgtggtgggcggggtcttcagggggctggatgggccgtggtggtgggaggaggatggccaggggtcctccttcccacgtgggcagtgcttccaggggccaagtggcactggtgcatgaggagatgcccctctctccagtcaaggctcgtggaggcaggacacccactgccctcgctggggctgggagccccccctccgctgggcagcacagctcgctccactccttgtggccacctgcagcgccctcctcaccctcagggcccccgggtgcccgacaggcccgagtcgggggcacccttgccctgctgctgcctctgtccctgccgctgcctccctgtccctgccttacagcgtccctgccttgtgcctcgccctccccatcttctgccacgcagctcctcccccaccctctctcccggcgtggctcccttgtccccaccccacagcttcccgatatgaggctctgtgggtgagctaagcccatcctcaccgcctcagcccagggaggggtggccctgagcctggaaagtgggggcttcccagggagccggggtacttggcccaaggaggatgggaccaccaagggtgggaatggaggctcaggctgggggctgggggtggattctgaacctttcatgaggacagttggcctccatatttggaagatactgttttgtttttaattatacaaaattttcagactttatattatcatatcaaaaacacaagatgccatcacacagtggccggaagaaaagccagcgcagaaagttccagtgggcccgggcaggtgctggggccagcgcagagtcccgctgccggcgcctgtctgtacgtccgtctgtccctcggccccgctcgcagccagggctggcctgggggcatgcttgcggtgggccttgcccagctcaggtccaaggtgggggctgtctgcagtcaccccgggcgtccacctcccccagcagcgtctgcctcctggctgctgccggccacctcctaactgcgaatcgctgtctttctgtcgcggtccttgctctgcagaggggagggaggagtgtcaggccccggcagagcccagcgccagtctgcgcctctctggcctccctgctgggtgccatctcaggtggccagcgccaaggcacctccttcccggctctccccagcttccctcaagcgttttggggaggggagcatactgctgcacagccgaaattgtaaaattaaatttcccagatgttcaggccccaggagctcgcgcgtgctgtctggagaggaaatggggattgggaaaagccgtgccgtattttctccctgctcaccctgcttttccggtgccaccaagcacagcaggagctgtaaatcacagctggccagcgtctcctgcaggggccctcacccccagcccccacatctcctgccagcctctgccttcgtgtcccatggcccacgtctcgggcagccctacaggacctggtgtcttggtgtgcggcctaggtgggggacggacagcaggtgcccaagatggcttaagccagtgctgggccgcaggggctaagaacccggggtccttcctctcttgccttgcagcctcttactttctgaactcagctgttttcactccgcctttcaacttactgaaaagggaagcttgcagcggcctggtccagctccccagcctccccgccctgggtgggcccctttggccatccctagctcttacccctcatgcagctccctgcaggggactccacactccactgggagccgagtgtcctagggacgccctcgagaggagccccaggagaaggccccagcccccggcaggcctgtgttacaggtgtgcctgcctgtgccctgttggggagccctgcccgtgtggcctcgcctcctctgcctggcaggtgtgggctgaggggcgcgttggaggcccccctcggcgccccacggcccgtgctcaccaactttctctggttgctgaggcagaaggtgcagatctgtttgggctgggtgttctcgccgtcgcgggcgggaggcggcgggggcggcggcggggggctgccggcgcgcgccgcgtggaagaaggcgggcccggagtggcagggctgtccgtcgccgcaggcctcgcccgccagcagcacgttgcccaggtgcgagatgtagctggaggccaggcgcagcgtctcaatcttggagagcttgcggtcggcgggctcggtggggatcagcgtgcgcagcgccgtgaaggccgtgttcacgctgttggtgcggtctcgctcgcgcgcgttcgccgtgtgccgctgccggggctcacggcctggccggccccctggccccccgcccccggcccgccggccccccgccctccgccgggcgccctggaggccgcagcgcgccgcgtgcacgcgacagggtttctcgtcggagcccgagctgtcgctgccgcggtcctcgtcctccgacagcgggctcacctcggggtacaggtagcggcccggcggcgccgggcgcagcgtggcgaaggacatggggccggcgggggcgcggcgtcagctctgtcgcgcgctgctcatgccgcctcctgcggccgccgcgggcctcgcgggccggccggggcgaggcgcggggtctcggctgcgccccgcggtggcagctgccgggcgtcgcgcgcacatgtgcgtcccgggccggagcggggccccgagctgcgcctttatagcggcgtcccggcccctcccccgcgcacgccccgcccctctcagcccggaggctcctcgagcagcgcccgccgcgtccctcggccttctgtggccacgctttggcgggggtggggggggcggggctggtctttgggggcatcgttccgtctctggggatgcggaggaactgggaggtcgcttctgggctgtagttactcagggccccaaaactgcagtgccccccgtccccgggagaggggaggaacccaccaccccgttttctcccgtggcacaactgagttaacccagccgccctggccctgctgcctgaccgcaccctgtctgtctttgcctcccatgtgcgccagcgcctgcctgtgccaggccgtgtgcagggggcgggcacaggcgagtatttaggggcctagagctcagtctctccgcctgtctgtcctgcacctgcctctccaggcttggcacagactgtgccttctgctagctggccatgtcccctgttcttgtgctgtgtggacctctcaccccgtcggtctccttgccccttcctccttcccccgttcctctccagggccaccaggcccctcaggaagcacacacatacccccattatccaatttggggatggccccctatctccatggggaggagagggaaggaccctcagcagggggcagggcccaaggggtccctcctgcagcagggggcccggcaggctcccagctgtgctctgtcttgcctgggcccctccccgtggctactgttgcaggaagcagcctcctgggcagcggtccccaggctggaaggagcgagggtggcggctggcaggggctgcaaccaggaatgtacgtccaggaacgtggctgttctgcctggggaggggccgagggcagacggtggggggtcccccacagagaggtcttggcttctgcctctctgtggaatgggtcagttggggtcttccccgagtccccgtcttatagctgcccacttctgcctaaggcccctgccaggggagggagcccgtgggtgatgaggtcatccctgtctgtggctgcccagagccctggccaaggaatccagtgaggggggagctctggggttggcaccacttcagtggaaaatgtgaaggtgcagctccggcgcctccgagggcgggggtgggggcagcgtggccgccatgccacgtcagaccccagggctggggaacaggcgtaggtcagggccagtgacctcagggcacttgaggctgggcctgcactccccctgcaaccccctcacctgctcccctgggcggcccgaagcgggggtgggccttgtaggatcagatgccgacatggtggcccccggctgcaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggtgagggctggtggggtggggccagcagccggggtgggcccgaggggtggggcagggctggcggggtctgactggcggtctccaggcgcaccgtgcaggacccgatgacagggcgggacctgagactgacggatgagcaggtggccctggtgcggcggctgcagagtggccagtttggggatgtgggcttcaacccctatgaggtaggtggcaggggctggcccctgggcggcgggggtcctggaggcaccagcagggcctcagccactctggcccacacgcccacatcttctcccccagccggctgtcgacttcttcagcggggacgtcatgatccacccggtgaccaaccgcccggccgacaagcgcagcttcatcccctccctggtggagaaggagaaggtggggcacacagcccctggggcttggcctgggctgaccgccccgcactgcccgtcctgacccggctgtctatgcaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggaggtgggcctgcatcctgggggccgggaccctgtccccatgcttccctgtgaccctccccacccctgtgtcttggtctccacagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgtgtgggggtggcacaccaggggggtggcacagggggcaaggctgacctggcgctctcctgccccaggtgaatgtagaccctgaggacctcatccccaagctgcctcggccgagggacctgcagcccttccccacgtgccaggccctggtaagtggagactagggggctggggttgcaccctcccagtctgactcctcactgccgccgcctcctcaggtctacaggggccacagtgaccttgtccggtgcctcagtgtctctcctgggggccagtggctggtttcaggtgggtccgagctgggggcagccttgagctggggggcaggtgggatggccaggtgttgagagctgtctctgccgcatccaggctctgacgacggctccctgcggctctgggaggtggccactgcccgctgtgtgaggactgttcccgtggggggcgtggtgaagagtgtggcctggaaccccagccccgctgtctgcctggtggctgcagccgtgtaagtggaggccctgggggctggggagccaggggtggcactgtgcttaggggccgtgtctgggcctggctcacagggaggactcggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaaggtacgtggggcgccttgggggtgaggctgcagcgggaggggcctggctcagccactcagccagccttgctctcctgcagccagtgacgcaggtgacctggcacgggcgtggggactacctggccgtggtgctggccacccaaggccacacccaggtgctgattcaccagctgagccgtcgccgcagccagagtccgttccgccgcagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgaggggtgggggcggtgcaccctgcaggtgaggggtgggggggggggcggtgtaccctgcaggtgaggggtgggggggggcggtgtaccctgcaggtgaggggtgggggtaggggcagtgcaccctgcaggtgaggggtgtaggtgacgggcagggcagtgcaccctgcaggtgagagcgggaacacctgcatcacagcctttggccctaggtgacaacgtcatctgtgggagctacgatagcaagctggtgtggtttgacctggatctttccaccaagccatacaggatgctgaggtgaggaaagctgggggtggaggcggccagcagagcccctcccttcagcccgagcctgccttcaacctggttccctccccccagacaccacaagaaggctctgcgggctgtggccttccacccgcggtacccactctttgcgtcaggctcggacgacggcagtgtcatcgtctgccatggcatggtgtacaagtgagtgctgaccctgcctggccccctccccagggcagtggtgtctggccgtgccctgagccctcctcgtccccacagtgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctgtgctg

SEQ ID NO: 37738 - DNA, 81813 bp, Homo sapiens
agccaccgagaagccgaggaggcaaggctcgcgagagttcagggaggccgccctgagattccggcgaggccgcgggtcccacctcccgggggcggggcgagggcggagcggggagaagggagctgacgggcgcccggccggctgcggtccgtgcggaggctgagccggccgcgggcgcgaccggaggcaggtgagttcgcggatgtagcgctcggctgagggcccgagctcgccgcgccagccccaactctgcgagcaggagcaggaggagattttaggtgtctttgggtgtccagggaaagccgggctaattctggggctggaaatgtctccggggaacctgcggcgacggccttggccctcttattccccggggtgatactggccccatgtgtccagagagggagcctcgcacccggggaggaatctttgtcctctgctcctttctccttccactccccggcccccgagcactccgctccgggtccccgcctgggcttcacaaacaataacaaatgtcgcggatcctctccgggtagccccagcgctcccgtcccgtgccctccagccgatgtcacccagagccaggatccgaagcatggctcttcaattgtgggggctgtttgtgtaccgttcctaaaaactgatgcgtcagattgccaaacatttctcaagacagactcaggaaagcctcccagctcctagaagccacggagtgctcaaaaccagtcttagaatctgtctttaccattgcacccgtagccccttcctttcaaaatcatttctcccactccttttttcacctttagtatcgaggtcgaacgagtggttatttggtgtgggagtagaaaagagtataaccgattgagtagggcacgtttcacctttaaaaagttgccaggttgacagcaaaagaacaaactttattttcaaaaccagtggcctccccttttactggtgctgcttttgttttgtggaatagcttttcgggttctaagtttggaggaatgatataaaaagaagtgggaggtggggggagggctagtggctctggaagtagtggcttgtccaaaagtaggatgctattgtttctcacttgataaaatgcagaaccaacacttttacccatttcacataacttgtgataagttttgagagaagccacttaatcggaaatggcctattagcttattttactgctcaaatctgaaaaaacagctttaagtgatttaagttctgcctcttgattgtaagatggggattgatgagtgagaccttgtcttttttggcgctggggcttacgtttgaccggtctctctactttaaggcagggcctattgtacttaagcccatttttgcttcctcagtacagattcttgaaagttctttgtctcaatcatatatgtatataaggtactgtaaacctctttgaatttgattggcctttctctctgtgcctcaggatatgtaaaacaattaagtttattatactctctccccagtggctgagaggtattgtatgtgaattagccacccttgtgactatttgaggagagagaagttagtctaaaatattatgttaaattatgatattacataattttattgcataagttcatcaaactacttccatctgaaaaatcctgatctcaaaataggtaggtacaatgaattaaaaaatgttttggtttgacctcacttagctttgttttctccttgttaagatggctgataatgtttcccatttggttgtgatgtgtttagaatgagaagcaaagttgggtgtagtttttgtactcttttgaaaggccttgccactaggaatgaaaaaattagacttagaaaacacacattaaatagaagcagtttttctctagccatttgctcttgagtttgttttaaaataagtcaaagaatggagactgagatgatttgtgccaacaaatagatgtccttgttagtttttatgctgaaaacttgatttctaaaggtaggacactgtaagaacaaaggagaaattggacttcctaaaaaatgataacaaagcaatggactcagttcagctgtttgctttcagaaaagttctgttctcttaaagtaaggagagcatcattgtgttagtgaaattggataacgcaccttagaaagtgcctccccagtgatccaggataagttggaggctcttttgtgtgtgtgtggcactttttgttaagagggagaaagggcacaaatcagagccagaaagatttgcatctcgatgtattgttaaaatgcttttattttatgtaaatagtgtcaggtgaatcaagcaagcatattgttgtctagcatccttaggattacattaaaatcagcagattggcaagttatgattaggttagacttgacatatgcagaaattatgcttctgtatttttatattaaaagcaccatggtctttttgaatgaaataatgaaagcaagcttttaagacataacttttttaaaaaattaaaaatctgtctttggttagtttataaacatgaagcatatcctcctcttcttccccccaaaatttttgtttaagtcttaagaaagtctttagcaaggtatgaccagtacttaagtgcactggttgcataagccttctgtctccaggtaaaagtttgctaattgacagggtattattgttcagaatctttagagggagagaaatgaaaggcaacagtgaacagtgtttgctgctctgtacactcggacgaactgtggttgctactctgtacactcggacgaactgtggttgctgtcttcaaggagatgtgatccagtgggagagaaatatacctacccaaataaataccatagaaaatgtgttttatgaggaagccaaggagggagggattaagtgctgctagaccaattaaggaagactgaaataggaaaaggcgtttctgtggatgatttaagtgatctagtcatatgataatgatgataagtaaatactttatataatgctgcttcctgctaaatcctttacatatattacttacttgcctggctttaatcctcacaacaactgtatggagtaggtatttttattattcccgttttgcagatgaagtaactgtggtactaaggttagatagctattgagtggtaggaccaggattctgacccaggcattctggcttgtacccatatggcatgcttaactgcaatccatattttctctcctgttcatgatggtcttcctcagatctgtagtttcaaaaacttgacttgggaaatacattcttctgacatctaaattttggggtcagttttctagaaagagttccaaaataacacccaagtaaatgagttatttttgacatgttattttaatccatttttggaagttattcttggtgcagattaaatataactattgagtgggactttttaataattttgacttattacctataagtactcataagaacttagaagtgagaagttattccatattaactcttttgcttaatggaatgtttgcgtctttgtatattttgtcctgtaatttattttttttaaagaaagaacctcactgtcttgcccagcctggactcgaacttctgggctcagatgatcttcttgcctcctaagttgcaggaactataggcctgagccactgtgtttggctttgttctgtaattttttttttttttttttttgacagagtttaagtctgtcttttaggctggagtgcagtagtgcaatcatggctcattgcaacctctgcctctcaggctcaagcgatcctcccacctcagcctcctgagtagctcggactacaggtgtgcacaagcacgcccgactgatttttaaattttttgtagagacagggtttcactatgttgcccagcctggtctcgaactccttggctcaagtgatcctcctgccttggcctcccaaatgttgggattacaggtgtgagccaatgtgcccagccctgttctataattttttaaaccacttggcactggatagtttttgggttgaattatgaagttgaaatttagttaatgattgaatgttggtctcagcccttttagtttattttcatgaatagctatgcttataatggcagaaacagggtgaatagagtgttgtacatgtaaaaatgagagaagttccatcactgatactttatgttggggcaactttgacagttctttgggtttgtgaaataaagggtgctatagaagtgcacagtgtcttgtataggcctactcagtactgtaaatgtccacctgattttatttatgaagtttcaggaatagtccacatttgttattgtttaagaattggaatcacaaattcaattggatttaaaggttagaaaaaaagtatacctaggcagggaatacagcaggtgagcggtgggagaggtattgcctgccttttcctaactgtccagcaggatccagactcttcagcttctttgtcagtgcctgcagttgaccgtactcatagtttaagtacagctccagagtcatagtctctgtgaacgaatataagtattctccacttgactcaatggggtaggttctagaagacacctatactaggacagttgatggttgatgagcttaaaacctaatgggaagagtagcagaactaaagccaggatttaaagcacgtgtgtttatattattgaaataagacagagatggcaaaacaaattttaaaaagtttttttttgaaacataccttaaattaatagtgatggtatatcatttccatttaccatgccctgattggcagatctttagcccatcatttcatggagatacttagatgtggacttcgctttgttataaaaagtttccaagttcttctaagtacaggtggtttgggaagattgtcttagtaaaaaggtgtgtgagtaggtctatcaaaagaaaaccagtcatactgttacctccttgctgattcaagttttgggggcatcttttcccaccaggaacagcttatctgcattgaacgtctgctgaggcaggtagcctgcctcttagatgagctctgcacagatcttagggaagaccttaacagttacaggtcatgtggtgacctgatcattcacagtcatattgtataaattccaaacaggcctggagccttggcaattgtctgtggtatgtgataacacttctactatgcttagcttttatttatttatttatttatttttgagacagagtttcactcttgttgccaaggctggagcgcaatgcatgattttggttcactgcaacccccgcctcctgggttcaagtgattctcttgcctcagcctcccaaatatctgggattacaggcacgcaccaccatgcctggctaagttttgtatttttagtagagatggggtttcaccatgttggtcaggctggtctcgaactcccgacctcaggtgatccgcccgcctcggcctcccaaagtgctgggattacaggcgtgagccactgcgcctggcctatgcttagcttttaaattcttaacaagctctttaccttccccttaattaacaccagatcagttggtaacccaaattgttgattctctggccatttatacagaaggcttcctgttttccttgccttttgctgattctcgttgattccacaggtatagaatttctacatgttataatagataaatctctgatcccgtatgcacagatagcatccattgttttcttacctctttgagttatttactatctctccagctgattcaggagattttattcctcgttttcctgattcctgggacacttttactgcttttgcagttcctgaatagggtggagttaataatgtttaacacctcaaatcagctacagatacacccagaataaagaacaagatggcagaaactaacatgagggcatgatagctaacccaggcattcggggttgctgtacctttgctatggagtctagctttcattctgtctgtgaaagtttagaaaattgagtttgggacagagaagcttctgcacacattaatgcctacttttcagggggccaagttctcccattgctattctgcttttatgaatacggttattgctattctgcttttatgaatacggttattgctattctgcttttatgatctggagattttgactgcatttctcttgattcctcaccaattcaagagacacagtaagtaatctgaacatttaatatgaagcatactttgtgtaatttatatttctcaaagtttgtctcccagtggtaatatatagatttagctccctgaacatcatctttccctcttaaatgttcttgattcctttttctttctgaatgtcacccattagggcacaggtctgataattttatcaatgccagtaaccacttatcccttactatgcaccagacatagtgctaagtactttatatatattatctcatttaatccttatagcaatcttgtgagttattatctctacctacaaatgaggaaattggagcttagagaggtgaagtgacttgcccagggacacacaggtagatagtaagtggtagagttagaaattgctccttcaggccgggcgcggtgactcacgcctgtaatcccagcactttgggaggccgaggtgggcagatcacgaggtcaggagattgagaccatcctggctaacatggccaaacctcgtctctactaaaaataaaaaaaatagccgggcgtggtggcgggcacctgtagtcccagctgctcaggaggctgaggcaggagaatggcgtcaacccgggaggtggagcttgcagtgagctgagaccacttcactgtagcccagcctgggtgacagtgagactctgtctcaaaaaaaaaaaaaaaaaaaagaaattgcttcttcagatcaggtttgctctctcttacattgcattattttactacaaaaacttctccttttctctttaatttacctccctcttctagtcccaccccaagttttctttcttctcttttttcccttccttttttggtaatttcccctttaggagttatttacagttttgcatgtcagacataaattctcttgggaaaagtatgcagaaataattcaattgtattctgatttcttatagacagggatttactcttagcacttattttaagaataataccaggagcccttatatttgtattacactttatagttttatgaagcgtttttacacatttccttacttaatcctcatagcagtcatgtggtctaggcagtgagggttatggctattacacctattttcaggtaaagagaggaactcagattaaagtgacttgtctgagatctcaaaataagagacagagcctgaatttaaacttaggtctttcgactctaatataaacactttatttaacacactggtcttccttgtagagtaaaagctgctacaagcaaatcgttcactaaggcctctacaaaattagttgatgagacaaggtttttgcccttagcaattacagtgctgaaataaatgatataatcaaatgttctgacttcatttaagccaattaggagtgggtaaatatcattatagcatggcattttctaaagttttaagccttgagctttgttttgttttgtgagaattgagaacctggaattttagttctgcattttaaatcatgaaatgttaaagtccttaattcttaagttattgtctatctcattgtgcactcaattgcttacattctaactaaaacaattatgataaaggaatagggtgaagggaggacagacataaacagtgaaattaaggaattgggaatcctaacaagggcttgctgaggtatcttacagtagcacttttttttttgagacggagtctcgctgtgtcacccaggctggagtgcagtggcgcgatctcagctcactgcaagctctgcctcccgggttcacgccattctcctgcctcagcctcccgagtagctgggactacaggtgcctgccaccacacctggctaattttttgtatttttagtagagatggggtttcaccgtgttagccaggatggtctcaatctcctgacctcgtgatccgcctgcctcggcctcccaaagtgctgggattacaggcatgagccaccatgcccggcctacaaaagcacttttgtagaaaattgaatatgatccttaaaagaatggataagctgcaagtagtattcacttctggaaagtgataatgtttgagagctcagacagcttattcaatgatccatttttgacatactatcttgtactagtgtctgttttattaaattaatttttactagcagtgttcatttttacttagttaagtgtctacccactgacctgctcccattgtggaaataccacaccgtgtttgccccttacgacttttctgtatttggcagcagaggctggttgctcagtttattgtagtactagggagttgccctttgttgtgtttttcacaacagcgatccatttcatttgaacattttcagatctggttgaggatgttctccatatgtcgactcttatctagacaaacagaatagactttttctatttttgtggctagagtggaaaattttagtactgaattgcatgtatatgacccattgatattcttgatactggcaaatcctaaaggaatcacagactcataatattttagtgaggttaatcatcataattcattatttatcagctatttgcagggcactgtgttaggtaccatggcaaaatagagacaaatagatgtttggccctccatttagaaaagttcagtccagtaagaggtataatgtatgggtacaaatgactgtaattcaaacagaaagtgacaacggagtaacagggtactgtgggagcagaggaaagagagattgcttctggctgtagagattaggaaagcttcctatatgaagtgaaatatgaattgagcatttcagagtgaaggacatgccacgcagagggattagcataaattgggtgtatctgtacagcacctggtaagttctgttaattatctacttctctttctgctctgttggatttgaaccctttgaacttagagaattgatgttttccagcttttcattctctacttcaccacctgttcaacttggtacattaattacttagagttgtaagtggcagtagtgtatatggagtgaattcaaggaaagagagtccagaaatgggaagaccagtgaagagacaaataatctaggtgataataatgaagttctaaactaggtgagattgggaaggagagacttgcatggatgggtctctctagtgaaagaacctaggcagttctttcactgtgaattgtacataaagtacataccgtgtgccaggagatatggaaagggaaagacatggtgctccctcagaagctgggcaggtgactggagagctacattcacaggggtagaaatagctgcaatcaggcatagcagctgtcatgaaagagcagtgagaggcacacctaagggagaggggcacctacttgggatagtgagagaagctttccaaggatgtgtgagtgtttgagcttagacttgaagggtgaggaggagtgtttcaggccgagaagcctcaggcgggtattatcacatagtgatgtaagacacgaagcatattagggggccacaggaaccggaattgttgccgtgatgctggacaggagcaatgaacttttatttgctgtctatttatgtttatccagctttagcactctgagcttttgtaagaaagtgtttctgttgcctctagtagcctcttggaagcacctcttctgtgcttctcactcccaacctggagtgcagtgctggtgataaattgtctcttgcttccattttgtgaaattaaacagaaaaagtaaagataccatcagccagagagataaagagaaaagtaaatccactaaaatccttttctttgatgaagcctagaaccaccgaggttgttgtataaagagaatgctgcatcaaagcacagcttcaagagcacctgacttgagggaggggattgtggtaggaacatgattatttacctttcccatagggttttatggaactcttaaacatttcccaagactgtaatacctaataatgaagtccttttattctagttctagccttgattcttttctcctctctactctaagccttattattttttaaaaataacacagtttaataactaacatgaccctaaacttcagatggtgtcaaacatcatctctggtcctcctctatccttgtttggtcattcagagacctgtatgtgcaaatcgttattataaactttgtatgtataatctacgttagattgctagagataaaaagcactacagatttcttttttacatagatttactttctacagtggttatttttttttctgtcctttggattggaccactgaaacagaatataaagttgttttctaaggacaaccaaaaagttaatggtagtctctaattcaaattatatccattgtatttctaggccagcggttggcagctgttttggctttagtgccattactggtaatactaaaagatcatgggcactctcaggaggaaagtgaaaggaacagaaggaggaaaagcgggcttgtggggtggtaggggaggcacagagagggggcgggagaaaaagtacatatggttaaaagagatcaagtacctccacacctcttccaggtaccacttggtaggaccagtgccatatttaaggattaagttgaactcccagcagtcctgtctgaaaatactctggttgtatttttatgccaaaaatggcagtttcttttaatcaaacatttctggatttaatttttaaaattgtatatggaccagtgtctctttatttttagaattgagcagaaaaggagacagaaatcaacatactttaaatatcaatgaaaattataagcacatttctgaaatgtagttaaagctttaagatctaaatccatagattagccccattgtatagcccaattcaggcacaaggtggcagaaagtaaagggatgaatagctgggaacatgtgtttgaatttttaccgtagtaaaactgcattttcatactaaccaagagtgtaactggacccacagaaggaaaaatagggctaagaaattagagcctgtgcttttctgtacaagtaaaccaagtactctctccctttcagaaaacattatcaaacaacaaaaaatttattttttagaacttacacaagatattggactgacaaagccaaaaacaaaaatacttaagattttagcttttctgtaatagtggtgaaaagttatttctcagattgtaagaaatactgtcttgaagtttttgattgattttcagagttgaaagatgctttagaggtcatctagtccaactctgttgtgaattccctgtacatcatctccaacaagtggatgtttagtctttgcctaaatatttaagttccttgcctaaagacaaggaacttaacagatcataagatagctaactttcattcccttaaatggttaatgtgctcttttgtccccaatcctcttctcactccctgcactgtgagtgtgggtgatctcatatgctgtgatatcttcaataacttctctgcaatgatgacttccaaaccggtatatcttgctcaggtccccgtcctgatcttaagaccccattgtccatctgtcttctagatatcaccacctttggtgtgttccatggataacttggattctgctcacccagagctgactttatcttctcccttcacagagccattcttgtgctccttagctttcccagtgcatggcgttgttctctatttggttcttaagctgtaaacctggaaatcacccttgactcgtcctccttgtttatgactgacatctagtcattttttaggtcttccttaactatgtcttgaactctgcctttgctcttcctccagtgccagaatattcattcaggtgcccagtgattgaactagccatctttccctgctaccagtcttgccttctttcagtctgtcttccatgtggctgccacaatgactgtcctaaacttgaatctcattatgtaactttcatccttaaaatttctagtgactccccatggcctcttccaggctccttagtgtgacacatgagttcctttttagttttccagccttgtcttccatcactcccctactcacctctccaaccacactgaaccactagctttcttgtaccttcggtctcacacactactttctggaatgccctttcctatacttcttgggtaattcctgtgctttctttggtattctgcttaggcatctctttcagggaggcctgccttgacctcttacctctggcagggttaggtacctctcctaggctttctgacagtgtctagtatgtatttcttttatgttttttaaatatccaaactacagtaagaggtaataatgttgggcatttactatatgtcaaaacttaatgagcatttgctatgtgccaggcataggacagtgctaactggaaagtgtttccttatataattttcaactggttctcatctcagaattagagataattttatgtcactgcaagagtaatatttgaagatggctatctaacatctctctttcaggctaagtatcttcattgaatttgttcaaatatggatttcagacctcttgccttcctggtcactcccctccatgtgttttattttgttttctctcttaaaatatgtggttccgttttacatcaaatagaattgtcataaaggaacatagggcttctcagatggatagaagctggatatggattgtcatatttaaggtatatacctcacttacctaggtcgttagctatgaacatttttctgaacattttccagaagtcactagaattacgggaatttacttatagttagcaagtgatggagagactgacacaaaaccaagaatgccagttagtgaatttattaatataactgtgagtggaacagaagcttatagtttggtgagcacactctcatcactataggagaatctacaggggaagccagcccatgtaatcaaatgggtaatcttaatggggagtgtcactaagtcaggataacctgatggagagtctttataaggatgcagctgtccagcgctgctctggggatatggtcagtgtgctttcacctcagacagtgttggggtcacataggcaaagtcttccttgttaaactcctgctctgcccccactacctcagattaatataacctccttctgtcaacatagttgacaaggtttcagctttcttaattcacattccaatcctgtctcccagaaactataacctactcacttttgaccagacttgggtatccccggcccttttcagtcacacattttcttggaattacttacagtgatggctaaattccatcactctatttgattcaggctggtgttactcccagaggatgacttaattttcaaattatgaggacatttattttgccctttgtatgactatagggcatcactaagtattgaataatttctccagatatgagccaactagtacagtgtagagtatggcattcaccttccttgtgcatgactttatttatatgtgtgtgtcaactcagcccaagattaagattgtataaattttaggggcagccatttcacactttaatttatgtcaagcttttttttttttttttaagtggagtcttgctgtgttgtccaggctggagtgcagtggcacagtcttagctcactgcaacttctgcctcccgggttcaagtgattctcctgcctcagcctcccaagttgctgggatgacaggcgagtgccaccacacccagctaatttttgtatttttagatggggttttaccatgttggctaggctggtctcgaattcctgacctcaagtgatccacccacctctgcctcccaaagtgttaggattacaggcataagccaccatgcccggcctatgtcaagcttttatttgaaaaaactctttagttctttctttaaaaatgtaatttaaaaaatattttaataaagacaggatttcgttatattgcctaggctgttctcgaactcctgagcttaagcaattctcctgctttggcttcccaaggtgctgggatagttgcctttttgtgtgtgtgttttgagatggagtctcactttgtcacccaggctagagtgcagtggcatgatctcggctcactgcaactaactgccacctcctgggttcaagtgattctcctgtctcagcctcccaagtagctgggattacaggcccctgcctccatgcccagctaatttttgtatttttagtagagatggggtttcaccatgttggcaaggctggtctcgaactcctgacctcaggtgatgtgcccgcctcggcctcccaaaatgctgggattataggcgtgagcccccgtgcctggcctggttgcttttttatgtatacaacagttttcacaatttgtatttagcatttgatttttttaacccaaatataattctttacattttctctattaaattttatttgttacagttaatattctgttaaaattgttttagatctgactctgctctcctttttttcattattctctccaggctctggtcatacctacattttgataaggatgttggaaaaacttttatccagatcattggtaacactattgcctaagcccagtgaatattgcagaacttatttatgagcattctgagttttgttatttaattggttatgtatatgtgttactcagcccatctctcttcctctcagaaagaaatggagagtggagcttgttaaatacctttcagagcatcacatagatttgtcttatagctttgccaacaaaagaaataaagttacttggcaagacttgttcttcctgaacctacactgattctcagtgattgcccatctttgtctattcagaaactgttttataatcatctaggattttcttccggctgaatgataaacacagagttaatcttttgccatgttcattttcttttgttatgtttgtgttttttcctcactctgaaagatggagtactttgtctcctgtcttaacctctttggtcttcctgacttgttaaagagttatagcattcagcagaattcccatgcaggctcacagtagacaactggtcaagtcagatttgcagtgtgtcgggggcaggtcttttatggccgcttcacgtgtcatgggcatcagttctttcatcctaacgcgccactttttgctgtcgttctcctagactgagaagagaggcagggattgagtgatggacactggactggaagttctcttttataaaataggcgtcatacctacctctccaggtagaaatatgtaaaaggtctttgtaaactgtgagggggtattcaagtgtagaatttttaaaaagcaaaatagaagtgaagggtttctttcccccccttttttttcctatcatgtattaactacaccatttaccttaaccaacgtactcagccttttgtgtataccaggccttttgtaaactttctcttccagacataaattcaaaagtcctttttgtagcccttgctgattttcttaagttcagctcattgtggacattttacttcctgataccatcctgtgtttcttttataggcatccatgttatgtgtccctcctttctttttctgtgtctttgaaaatctgagttcattgaagagctctttgtgcagccagtcttttcagaatcttcccattttctgtcattaatatcctttgcagtttatagccagaactctgtttcttatatcaagttttaatctttttgttgtgactagaagaaagaggataggagcaatactggttttatgtcagtctgtccatcacttgtttggttatacaagtcccccaccaccaccaccaccatgtttttctgactcattctccttctttgtctctttttttcatctttcttttctggattcttcttgtgatataactaggaattattctaaagctcacaagtttcagtctggtactttatcagatcatgtatagatatggaacatttcccttgttattcttttaaattcattttcaatttataatttacttccaacagaacaaaatgacactgtcttcagggcaataatcatgtttgccttcctttgtatttttctcataacatctagtgaaagtaggtatttaatacaagagagcatttagtgaaagggaacctaataagtgtgaattctcatgggcataattcaggagtaatccaaagtccttactgtctttgcggggttttacacgttcttgcccctgtcacctctctgaactctttcttaccactccccctcactctctctgtgccgtactgaactccttgctgtttcttactgcatacctctgcttcagggcctttgcacttaccatacatgctgtgtggtactctcctcccttcagatttctaaatcattctttttcatctcattcaaacctccttctcaatgaaaccttctgatgtccttatttaaaattgtaatgcctctcccagcccctatactttctttccatcccctcgccccactagaatataagatccataagggctggtattttgtgtcatttgtatttttatacggtgccaggaacagtatctggcacatagtggatgctcagtaaatatttgttgaattaattaatcaaggctagtttaactagacttctgttgttgagagcttcctaaaacagatgactcatctttcttttttgagtctcaggcaggacttacttttcttttctctgaacattttgtaatttttgttgcctaattgtgtcccatgtttccattcccagctattgtaacaaacttgaaaattccatggtaaattgctctccggtttcccagtacttccatttatcatcgaatttcttcccagtggtcacattcacatccagaatatttcttttcctatttgagaggtggaagggttagcaaggcatttatcagagacattgattttatctgtgggagaattctagcggctatcccaaaagttgaagtccccatcacagcttatttgtgtcagcctcagtctctagaataccagcaattcttaatgcttctactttccttgcttttgccctgttctagtgcagagtcccatttcatcaaatctcagtgatgcttaatagtatcatattaacttatttgtaaattgtcagttttctttctttgtttaatacccatattctgggcatgggtttccacagacctgagaccactttgttgctaacacctttcccatttgtttttctgcaacaaataattgacccaagctttcccattattttcagttttctttttcagagcatgcccagccagcttctttcattgttacagtaatatctgaactttttgtatctcttcttccattttcagcttaaggtctacttgatcagttaatcaaaattacatagtgattagaaaaagctcaagatccatcaccattttaactgtgtgacctgaaacaaatttcttaagttcttctctaaatttgtttttgtatctgtaaaatggggagtggagagcagtaatgcctgcttcttgagtcattaatccttgctttcagaattgagtgatatgaagatgatgatgataaacttttatgtagggtttactatttgccagatgttgttttaaaagccttacatattattaactaatacagtatatatggcatacagttctgtttattagcatatgcatggcatgtggaagcagtcagtaaatgttagtttttattagcagcagcggcagcagatctctgggtaaacattcttttcttagtttttgcaaggtatacttcctcaccagtgaaaagtctgttacagatgattgtatgctgtggtatgaatcagacgtttgtgtaccatttgtaccatttttgacgctattcatttgctataagaaaccacagaaatctcacaatagtcccttctcttaaaaaattatattttaggattagagcccagacaataataatgccattattgagaagccagccattacacactgaaactaaatacaaattatgtctttaaagtaaaatttcaacttttaaaaatagaaattttattgaaaattagtttttataatttacatttagtaaattccatatattttcactgattcagtacaaaatgttcaaatcaaaatacctattgagaaagcactatagaaactttgctaggtattaacgttaaaaatcgtaaaacattacattttccatggcagaaaactgataaaatcattgagtagtcaatttctgaaatgtttcttaattttagaataatatgggtaaacagccaggtgcagtggctcacacctgtaatcccagtgactcaggaggctgaggtggaaggatcactcgaggccaggagtttaaggctgcagtgagctatgatggcaccactgcactccagcctgggtgatggagtgggactctatctctaattaaaaaaaaaaaaaaaaggaataatatggatagatgtatttaaagtacactaagaataaaacaaaatatttgttatatgtagactctgagaattttttttttttttttgagatagagtcttactctgttgcccaggctggaacgcagtggtgggatcccagctcactgcaatctcagcctcccgggttcaagcgattctcccatctcagcttcccgagtagctgggattacaggcgtgcaccaccatgcctggctaatttttgtatttttggtagagatggggtttctccacattggccaggctagtcttgacctcaggtgacccacccacctgggcctcccaaagtgctgggattacaggcgtaagtcactgtgcccagccaagattgttttgatagaacactttgtgtctctctcaccttgtatttagaaaagttagaaaataaaggataatgtatatagaaagctttttgaagactcttaaggagttcataaatatggggcactacgactatgcatatgaaaatatttcttatcagttggcagttaccacctcttacagtggcatgaaacctcttgagttaaaccaaggctcagtgagatttggtgatttaggtagtatcactttatgaacaagcaggtcttttattttattacacttctctttgacattcactccagttaaagaactctttcaaaagacctcatgcctggtctcatggagattgaaaggtgtttgagtccttccttattatccccttggaagatgctttgaggaccccagtgatgaatcgcaagaactctgtctccattatccctggtatagggcacctcatcactctggtgttatccctaaagggccttcatcataatgtgcttaaagagtcccctattatgtcctttaggatggagctttgacttgcccaaattgctatgtacatgttaaagagaggctggaactgaagttggtcatttctcactggatcagtcaacaagatttgagtactttctgtgtgctctgcatcattctgagtactttgggggacagaataaggcgtggctcctgccttcaaggagtgtggaatttaatagaagatgacaacatacatgactgtaaatctgtctacgtgagagtgcctaattgtgagattcctaataaatggcaagacatgttctgaaaacgtgaaacataaatgaggctgaagaaattgtgaaaagtttagcagaggaggaatagttcgtcaggttctttaaatacaagtaaaggggaaaggaaggaccatttttaagtttagatattccaagggttagtggtgaggttgattatggtatgtcttctcgttgatgagggaggagactggtgaatagtggaaaataaagttaaatggctagggtggggccaaattatgggctttaataaaagccaggcatagaaatttagattgggatggtagaaaaaggaaagctttaaaagtttttgagccaatgaatgacatcatacaagttctatgagcaatgatttcaggatgggagagaatggcatcaggaagacccacttgaatgctggtaagtaatgttaccaacagtgccattagtaacattaatgttactagggcctggactgatatgctgatggaagtgagaatgaagaataaggtgggatgaaagagattttgaaagaggttttaaagaacctgaaatgggaatgggagagattaactaagcctgcttgccatggacagcaatggggttgctagaagattagctgtggggaaaaagttatgcatttacctttgggcataattaaatgcaattgactctccatattcatgggttctgcatccactgattcaaacaactgtggaacaaaattgtcagaaaaaacaatacaacaataaaaaatgatacaaataaaaaacagcatggtataccaactatttatgtagcatttacatcatattaagtattagaagtaatctagagatgatttaaagtatataggaggatgtgtgtaggttatatgccaatactacactattttataccagtaacttgagcatccatggattttggtatacaagggggatcctggaaccaattccccatgcatatcaaaggatgactgtatgagttatctgtaaaaaaatgttttggttgaaatgtttagaaaacagctagacaagactggctgttggatgacaaaaacataggactaggaaattcaggtatgctactctttttgagtattgtttaaagccataggaaaagagctctctgtgagttccaaggcagatgcaaggactggcattcatgcacagcttctaatagataaatctgaagagttcttagtatgcatgttgactgaaattactttagaagtaatttttctcctggtgataaaaggcatgtaaggctgttttaggaaattgaaaaatgcaaaaaggtatgaagaaaaagaaaagataatcattaatagtactttagtaaacaagatttgactaaagatatggctttccttccgcttgttttcttatgcatataaagggataggaaatatgtatgtgtgtatgtgtgtgtataggatcgtgcactatatatagcttgcttctttttccatcatgataattttcccatgtcatgaattatggcttgcaagtgctattcttaaagggctgcattatttttcattatttggatttattgttatttaattggagctctattattgaacatttagattgcttccaaaattttttgctgttattaatatattgtaataaacttctgtgaaacacatactcttcacctgctacttacctatgacttctgtaagcagagacctctgtatccccaggacctagaaggttacctggacatagtagttgcttaattaaaaaaattattgattgaatgaaagaagactattaaatgttcagttcttctttttttattctgattgcctgtgtatccaggggcctcttatttggctgcatgtgtgagtttggctgtaatgaaagtattggccatgtatgaccataaacaggcattcctatttctgtcacagttatatttgtcattctgtattaatatatctgtatcctgatttctgttgaagcatgattaattttgtttgcttctaagcaatgtagctaccctattgatgctgataaaaataaatttctgaacctataaggctgaggattgggcctaggttgtggtaaactggcaagataatggatgctaccctctcaagagccctctgaagagaaaagtctgctacccttcaccaggtagaaactcctgacagtgccacattttccagtttgactccctgtgataccctgaaaagacagatgtttgactcttttcaaataatattttaacatattttaagacacaaaggcattgtgtcagacttttttcttaagaatatatattgttgccactcagaagttagcttccaaaagaaataagtgtgtgcaaaggtttacgatagtggtatagagaagtttttaaaataaatgtgcatcttttcctatagtaataaaagcacattatgaagaattttgtaggtccagtccacatattccctgtgcctggggaaaactttagtagaaaattagataatttataatttgattcggggaagtctagtggaaaaactttttaatggagcgatccaatttgaaacatgaatatctgtgctggaagcttctattgaactttacttaagtaacatctaagaccctctccctgtcagtccgccattaccctaacagtggtagaaattctttatattacacctagatctttttttgttgcacttttaagctgtgtaggaaacacattgcccacatgttcatacaacacagagtgattatccacttagttcctaaaaagttgtatttagttatggggtttgatcccacttgtccaggatttaggtcagctactgaagattaggatatctgggtacctcttactggagaatccattcctgttttcatttcattcctgggggcaatattcaatctggtgtggccctctgtgttataaaatgtttcccagattgtgtttatctgaaatacaaatccaagaagaagcatggtgttaactgctgtgtaaaaaagattccggagtcaagagcttgagaagttctgttccttccttcataggttcagttgtttaacccagcatttttcaaacgtatttgactcctagaacctgttttccctcagacatatttaagaaaaaagcgttttgtagaacacattggacaaatgatactttatatcattgctttgttttttaaattttagtttgactcaattttacagtttcgggtttttgtttctgttgcaggttttaagctcttcttttataaatagttactttcctagtctgaaatctatacattgtttcagtaatgaattcattatgtaaatttgcccatcattcatctaaagggaataaacgttaaattgtttttttaaattttgacttgtgtcacatatgagaatataaagtatatctgtacaataaaggaaaatgaaacatcaaagtatctacctcaggttaagaagcagaacttggccgggcatggtggctcacacctgtaatcccagcactttgggaggcagaagtgggaagatagttgaagccaggagttggagaccagcttgttcaataaaggaagacctcatctctaacaacaaccacaacaacaaaaaatcagccaggcacggtggcatatgcttatagtcccagctactggtgcaggctcgaactcctggtctcaagccatcttcccacctcagcctcgtgttctagtgaacattgttatgatgcagtgtctcctattctgcatgtgcaggagtatttttacagtatgtacctggagtggaattgcttggtcattgggcatgtgtgtgttcagctctattgagtggcatcaaactgttctccaaagcagttgtactaatctataccctcaccagcagtgaatagtcttcccattgttcttcctcattcgaaactagatattcacagccttttaggtttttgttagagtatgaagtggtatctctttggggttttaatgtttatttccctgattagaattgtagttgagcatcttttattatgtttatgggccatttatgttttctcttctgtgaaattcctattcgggttttttgctcattttaaattttgttgtttgtgtttttcttatataggaattcttcatgcattcaagatgcatgtatattgttcagaatagtacctgagacatagaaacaactttgtaagaatagctatcattgtattaccattgtatttaatcctttgtttttatgtgttacaattatcttctgctagtcggtggcttatttttcattctgtgatgctaatttttttttaattatcctgtaagttttagggtacgtgtgcacaatgtgcatgttagttacatatgtatacatgtgccatgttggtgtgctgcacccattaactcgtcatttaacattaggtatatctcctaacgctatccctccccctttccccccaccccacaacaggccccagtgtgtgatgttccccgtcctgtgtccatgtgttctcattgtttaattcccacctatgagtgagaacatgtggtgtttggttttttgtccttgccatagtttgctgagaatgatggtttccagcttcatccatgtccctacaaatgacatgaactcatcattttttatggctgcacagtattccatggtgtatatgtgccacattttcttaatccagtctatcgttgttggacatttggcttggttccaagtctttgttattgtgaatagtgccacaataaacatacgtgtgcatgtgtctttaaagcagcataatttataatcctttgggtatatacccagtaatgggattgctgggtcaaatggtatttctagttttagatccctgaggaatcgccacactgacttccacaatggttgaactagtttacagtcccaccaacagtgtaaaagtgttcctatttctcaacatcctctccagcacctgttgtttcctgactttttaatgatcgccattctaactggtgtgagatggtatctcattgtggttttgatttgcatttctctgatggccagtgatgatgagcatttttccatgtgtcttttggcttcataaatgtcttcttttgagaagtgtctgttcatatccttcgcccactttttgatggggttgtttgtttttttcttgtaaatttgtttgggttcattgtagattctggatattagccttttgtcagataagtagattgcaaaaattttttcccattctgtaggttgcctgttcactctgatggtagtttcttttgcagtgcagaagctctttagttgaattagatcccatttgtcaattttggcttttgttgccattgcttttggtgttttagacatgaagtccttgcccatgcctatgtcctgaatggtattgcctaggttttcttctagggtttttatggtttttaggtctaacatgtaagtctttaatccatcttgaattaatttttgtataaggtgtaaggaagggatccagtttcagctttctatatatggctagccagttttcccagcaccatttattaaatagggaattgtttccccatttcttgtttttgtcaggtttgtcaaagatcagatggttgtagatacgcgacattatttctgagggctctgttctgttccattggtctatatctctgttttggtaccagtaccatgctgttttggttactgtagccttgtagtatagtttgaagtcaggtagcatgagccctccagcttttttcttttggctacatgttcataaccatgacatattcatgttgcatatgttctgtgtcataacccagacctttctatctttttttatttttgaaatggagttttgctttgtcacccaggctgcagtgcaatggcgtgatcttggctcactgcaacctttgcctcctgggttcaagtgattctcctgcctcagcttcccgagtagctgggattacaggcacccaccaccatgcccggctgatttttgtatttttagtagagacgttgtttcgccatgttggccaggctggtctcgaaatcctgacctcaggttatccgcccaccttggcctcccaaagtgttgagattacaggcatgagcagctgcacccggccaactttcaatcgtaagtacccttttttgctgctgtttctttttttgaaccccaggaaaaaattaactcatttaatcccgtattcaaactgctacaattttattttcagtgttgtcgcctgattgtagatgcatttgtctctccgaatgtactgggattatttcgaagacaaaacatttttggcactgtgatttcaaaagtttaatcttaagactttaggagctacctgaaatctgcaacaattgcctataagagatccaaatgaatctttttttattttttagtttggagacagtgtctccatcacccaggctggagggcagttatgtgatcacggctcactgtaacctgtacctcccaggcccaggcgatcctcccacctcagcctgccaagtagctgggtctaccagtgtgccaccacacccagctgattgattcttatttatttatttatttattttgagtctctctgtgcatccaggctggagtgcagtggcgtgatctcagctcactgcaacctccacctcttgggtttgagcaattatcttgcctcagcctcccgagtagcagggattacaggtgtatgccaccatgcccagctaatttttgtatttttagtagagatggggtttcaccatgttagccaggctggtctcgagctcctgacctcaagtaatccacctgccttgggctcccaaagtgctgggattacagacgtgagccaccgcacccagcgcttttaaatttttttttatggagacagggcctcgctttgttgcccaggctggtcttgaactcctgggcttaagggatcctcccacctccacctcccaaattactgggattataggtgtgaaccaccatgcctggcttgaatcttaaactatgattttagttgaatctttatgatgttatttgtaatatgtaacttgctgaccaaactatctatgaattacttcctttggcttagtagagagatcctaattatcttttggtagatttttccacatattggaggatgacaaaagggacatgttaacagtgtaattgtaaaggtacagtgatgatagcagtgataatgataatgataatttcttcaaattgacccttatcatgaatcaggtactgccctaagtgcattacatatattaactcacaacaatccttttgatctatgagaaaaccaaggcgcaggcagatttagtaacttgtctaagatcacacagccagcaggaatggaattagggattcaaagtcagccagtctagttgcacagttttagacgtagattcataggtatctgaagaaatactaattcatttttagttttaaaagaattcacctaagactttgttttttaaatgtgatgatgagagaatgggaaaatacattttcactgtggttggtggggtccagtacttttaaggaaggagcaaaacttggagctggagttgcctaatggaagtgtatggtggatcaggctttcattatgaatagttttggttcctcatgagtggatgctggcctctgaaggatttcagaaaattcatagcttgtaattcaatttcctatatatgccatatgcagatgtttggggggtagttagtagagaatggttttaaatattccacagaggactccgattggtttttgagcttggatagttactgtgcagttgagatagagccattctaaaagactacagctatttgggagacagctaaccatatttgaaatgtgtctactcattagctttatttttgtattttttattttgagacggagttttgctctgtcacccaggctggagtgcagtggcacgatctcgtctcactgcatcttccgcctcatgagttcaagagatcctcctgcctcagcctcccgagtagctgggactacaggcgcacaccaccgtgcctggctaacttttgtatttttagtagagacagggtttcaccatgttggccagattggtcttgaactcctgacatcaagtgatccacctgccttggcctcccaaagtgcttggattataggcatgagccaccgtactcattagctttaggttaaaaatattttcctcctgtgaatctttattttggattttaaacgctctcattggttcaaaaagcaactttcattaagttgctgttactgcttcggctcttggctatttttagatagagttttcactcagctgtggtttgtttacttagctgtaagtaaatataaataatacaacgaattaaggtcaattcatttactctaaaaattgtagggttaaatggctaagcaaaaagaatgagacattatagctccttatccattccgttttgagtagaattagcacagcgttggaatgaccatgtataggaaagatagtactgaggtgatctgctgtatggtattatgctgatgaattagctagggtgtgtatattagtgcaaaagtttaagaactttgccatgcgatttaaatattatgctttgttttccttttgatttcccctcaaggaaggactgggaaagtagctcttttccctcctttatatggtcataataaaggattgcaaattaattagctgcattcaaggcatcacacagattgaattccatatttgtcttggagggaagtccagacttctgcctggggtgactgaatctgctttgtgagactgggtgcaacttccgtgtattcaagggtgggatcatcttgtcaacagccaaatatcttacaagatgtaagtcacttagaagaaattatccccccaaatgtggtttgtttttaatgtttctttcaaaacctctttcccccaacacacacagtgcagcagagaaaagttgcacctgcctgctacttgacagtagattctgtgatgattgattgtaggcattgttttctgtgtgggttgggaacagaaaaatgctctttaaccttttgccaggtctctgataagtactgaaaactttggcagttaaatgtggactgtaaaacacatgaagaaatactggaaaaacaaaaatggactcagattaaaaagctgaaatgcattattttctaaactagttcctttggggccttgattgtgtcagaaatacttactgatttttttcttttttttttttaagatcctcatgacctttatgctatgttgacaaagccagtttgtgtttgatatttttttcttccttattttgtatgtttatcttttttcttttaaacaagggcggagattttctactttattgatccctgtaagtggctatgatttattttatggagaagaatgggagtattggaggcagaatgggaggggtcctggactgggagccgaatggtgcctccgtttctatatgtgtgaccctagacaaggcttgccaaacacctgcccacctacgcatggcttgggagagcagtactgaatagtggaagagtcctaggctaatgagtgttgacaggcttgttttggttttataacatttataacatacacatctctgagcccattttttctgttgcaaaatggcagtaacattatttaccactcgttagggctaatgtgaggatcaaaaccaaatgagataatgtatataaagtattaagcatattacctaccacataattaatgtatagttaattatgaattatttatttttattattgtcaataacagagtgttagcatttaataaagttctgggtatggaatagaatgatcagatttctaggttttgacgtttggtactatagcctcactgctgagaaaatctgggaagtataaggaggtaatggttaaaagataggcagaattttctaatttcagaataatagtcattaacagcaggacattgtctagataatctacctttctgtgccttactttttatctttattcaaatgaagataatatgttttgaggaaacaatattgctgttgttttgtagaaattgaaacataagtacgtgtggtttgtggcactgaggactgactgattgcttctctctgatacttcttttagaaatgccctttttgggccgggtgcggtggttcacgcctgtaatcccagcaccttgggaggctgaggtgggcggatcacaaggtcaagagattgagaccatcctggccaacatggtgaaaccccatctctactaaaaatacaaaaattagctgggcgtagtggtgcacaccggtaatcccagttactcgggaagctgaggcaggagaatcagtttaacccaggaggccaagagcgcgccactgcactccagcctggcaacagagcaagactctgtcaaaaaaaaaaaaaaattgccctttttggagctcagataaaagacactatgtaatttgtaagaaaaaagggtgtcctgttggagtctacgtgtcaggagtagtctaaatcttaagtaaccagaacttaactatcctctccattattttgagaaatgatggtgaggatcattgctgatatggttttcaaatctggggggaaagattacagaatggtgtaaaaatcacctgaaaaagaattctttttgtttgtgcattttatcacgtcactactaatctggccagcagggagttaccatctgtactgtgtggcagtgaccagagaaaacaggtccagtccatttcatgtgtttaataatatatcatgttcacatataacccacatttattcagtacctataggtgctatgcttgaagcacataagccgttcatgatgaatacatactattgttcaatgctgcagtttttatgttatcttgaaagacagagggagaaataacttgcatttccaaactcgtctcttttatactttgaagaaggaacttgttacctttattgtacattaatgattacatatataactcactatgttttcttttctctacttccaaacccaagaaggcattctaacagtatctcagtaatctccgctaaccctgccccagttcagtcatatcctgctagaccattttagttatctaataattacagtaaacctcccttccattcctcccctcttccttcattcctcaaacattgccagcaaccaccaaatccaccttcctgccccaacaatctaaattgtaaattggaccacatcatactcagacttaaaatcttttaaatggcttccttaccacttttcaaggtaccatccaaattccatggcatcacattcatggtccttctcaatctggttcctactttcctgtcctccctcatctcctgccactttttctctcgccccttcatacaaaattatttacaattccttgctgtctcacactactaaggccttttggtattttcagctccatcaccccattatcatacttactttgtgttattgttcgtttgtttatatgtctgtcttccatgattagactgcatcttttttttttttttttttgagacggagtttcattcttgttgcccaggctggagtgcaatggtgtggtctcagctcactgcaacctctgcttccccagttcaagtgattctcttgcctcccaagtagctgggattacaggcacctgccaccacgcctggctaattttttagtattttaagtagagatgggtttcaccatgttggccaggctggccctgaacccctgacctcaggtgatccgctcacctcggcctcccaaactgttgggattacaggcatgagccaccacgcccggactgattagagtgcatcttgaaggcagagattctgtgtcacttaactttgaattctacccacatgtgacactgcctggcacatagtatgcattccctaaatgtttctcaaataaataaataaatgagggatgaaagatactcccatatggtcacagtgtaccattataacatttgcaattcttactatattatacaacatctgtaagccagttttataaatccaataatcatgatatggctaaagggaacatagatatcttatccataaactcaaaatcaaagagaccgagtaacttagacaagagcaccaagctgactagcagtgcctcaggactaacctggcctggctccctgatccccttgccatggataggcctaacaaatggaaatgtgtacaagacttaatagaatgatatttaagtcatttattttagctttgagattttttttaaaaaaacttcattatggaaaaatttaagtatacacaaaagtaaatgaaagagtaaactgtacctccctgtgtgcacatcaccaacttaaacagttctcaaaccatgaccaatcttgattcatctatacccatacctactccccttcgcattattttgcagtaaatccttgatgttgtatgatttaatctggaaatattttagtatgtataggataggtttttaaacttctaaatatgagtttctctggtattttgggaagtcatgataattgaaacaaaataacgaagcccattgaagacacaactgcagaaatctggcagcctgtccctgtgctttctccttctctatgaagctgttcccaggaccacgacttccaccgagcccatctcctagaaatccctttgttcacatgccctggagagagttgtgctttgttatttaaattgtgcaaggtggaagtgcaaggaagaaaagcaatggtgattatatgaatgagagtagatactagttagtaaaaagcaagatactgtatttatgtataaggttaaatagttttaaaaaattatccataagaaacctttaaaattccttggaatctttgtcatttctattttatcaaaattacagtataaactagtaactgaagtttatattatgaattattgcaaacatacacaaagttatggagaaaaatacaaggaacattcatgtgtctactgcatatctttaccaagtctctccctgttacctcagattttctttaagtgacagaacattgcaggtagagtgaagatgccttggtaatccttccctttcctctctcccagaaatgaccattatcctggatttcgatttattgttttaaagcatgtataaccttacattgaatagtgtcttgccttttataaagcattttacctctttcgtttgatcttcacaactcttgaagtatttacttcacttctaaatatgtataacccaccaaattatcccaatttcacttaatacaaagctataaagtatgaagtgaattagtgtttcatgatttacagtgtatcatctcattagaaatagagtcctgaggcatgtgtgtgaaaacttcacaccccgctttgttcctcgatttaatttaaagtacgagtaattactcgtacttttaaaagtataaagtataaagcactttgggaagctgaggtggtagcatctcttgagcctagggctttgagaccagcctgggtaatagagcaagacctccatctcaaaaaacacacacacacacagcagtaggagaactggaaggaaccacacacacacacacacacacacacacacagcagtaggaggactcgaaggaacctcaaagggttaaatagtctttaactccctgattttagtgaaaccgccttaaaaccaactcaaaggtaagttttctgttcatttcaaaggacataattgaggaaggaagagctgtctaccctgagtaatgttttctggaatgacaaatgagtaaagaaatcatggagatatcttatctcataattctttaaaaattaaataaccatggagtttgcatataattttaaaaatttaaagcaaattcccactccagttcctcctgaccaatttttccagctatttgagcagtattttttgctccttggaaggggatatagtgcttatcctgtttattcaagtaaaatttaaaaaaaagataaaactttctccccttaaaaaaaaaagtctagagctggtaaaaatttctgactcagtaattttggaaagaattgcctctttccacaaatagatgagcttacatactaggtcttccaagtggactagtaaatttccgtgatgtcaggaaactgggtggagtttttatggatgcaagtccagtggaggagggacttttcaggtcatgtataaggagagtaggatcagattctggttttgaataacctataagccacaaagcatggggatttcccattgggttaatctagtgctggccacagtttaggcatatgatctagagtagctgctgcaattaagagatgcttgcttatgggatctttgcccttttattggaaggctgtaagtgtagcccagccttgatttataaaccaacttgacataatcactatttcttttcacacagacttctgaatagctgtcactaaattttgattaccaccaggcatttagttaagctagagctgaactatttgatctgttagtttttattgggcactgcagcccacactgatcttcccctgttctaaagccctgcttgtatcagaaaggtccacccaggctaattgtttatatgctaattgtttatatgggttagtcttaactcttttttcgacaattttataggatcttagcatgctcatatcatgtctcctactatttgggtctcttcctactgtcatattgcttggtacattgataggtgctagtacctaaagccttacctaaagccgatgaaactgttagcttagttggcttcttccaggtttgtctttatttggtcaccctgaaagcctaagtgtcttgcaaatactatctactaggtttgttgaatatctcattttgttttctataatcaataacaatgtaagcttggatgcaattttttaaaagtactttaaaaaccttaactctcagtttggatacttgtcccctagctgacagaaataccttggcaaagtagctaaagtcagccctgaagctgaaatcagctgaggctggatagtttaaatcatgcttttcctcttctcaaaagatgatagggaccaaatcaaaatctcaacagtaatttaaattgaactttccaagtagatttctagaattcatatgaaaaagtataataatttggaggataaaaaaggaaaaagagtaggggcctgcccaaatagatgtcaaaatacagacagtccctgacttatgaattttcaactttaggttgggtttattgggatataagaccatcgaggaggtcattatgatttctactgaatgtgcctcattttcggaccatcataaagtggaaaaattgtaagttggggaatgtctgctctgctgccactattaaatgcactttcgacttagtgatgttttcaaattaggattggtttattgggatgtagccccattgaaagtcaaggagcatctttttattatagagctgtgaaaataaaatagttggtttagctgtgataataaatgtttaaatagtttaaaggaacagagtctcaaaatggactgtttctggtgcaaaagctctatgcttatattcatgcttctaagtcttagtacacattttttcccttagttttaaaaaaatgtttgcaggctgggcttggtggctcacgcctgtaatcccaccactttgggaggccgaggcgggtggatcacctgaggtcaggcgttcaagaccaccctggccaacatggtgaaaccctgtctgtacgaaaaaatacaaaaattagccgggcgtggtggtgggcacctgtaatcccaactactcaggaggctgaggcagggagaattacttgaacccaggaggcagaagtttcagcgagctaaaaaaaaaaaaatttttttttttttttttgctacattcttaagtgtgactctctttagctttgtgaaaccttgaggtggttgtttttccacacggtttataatgaaagagatgagaaaaatacaattttttataaagagcttgatgctttctagaacaacatactctaaaaagggaagcttacacatttaaaaaataaaagtctgatgaaagaccatatagctgagggttctgagcttagggagacaggttccaattactggctgtaggtctttgggatgatgacttaactaagcctacttccttatttgtaaatgtgggaagcgcctactttatagaactgtaaagatcaaagaacagcatgcgtgccaaacctttagtactgtagctaacacagaagtgtttgataaaagttacccatggttattatttttactaaaaagacctttaaaagtactatgaagggtttctgtttctaaattctaagatatatagtagtcatgaacatttcagaaaggcaatgttattttcaaatcagtttcacagttttcttgaggcggataagcagttcttcccttagcaaaataagaacttttgattatgcaatgaaagagaatcaaagtcagtactgattccagctaccttttctttattttctgtgagaaattgagcaagttacttgccacagtgatgtttttcatttttatagagaataaaaaataaatgaattaggtttgaatttcagtgggaaataattaggttagatgtaagaacgctctgattgtaaggctgccaagcagatgagagggactcctttgtcaccattaggagactgtgccagaggagctttttcttttgggcctcttgaggctacttcaggcgtcctgggaacccatctagatgcaccttaaacctggacttcaaccctgactcctgtgatggcatcttcgccaggatgacatggtaaggtggtgataaggacggagataagactggctgccattcaacgttggttagtcttcctgttcatgtagaaagcattctgatacttttttcctatttagataagtaaatgaagacagcataagatagacaacacatattttaaatagtctgaaataattgcatagatttccaacagcttataaaactctttaaaaagcgtacagagctgtttgggcaagaagggcagtttgaatcaggcacagcaacacagccttgtctttgttagaaggttagacgagttgatccttttaagtttctttaaaacaaggaattataaaaccatttaagatttactaagaataaataaggtgatcatgtaagagaagaccagtaattatcttgagttgcctttaggaagctacagatttatttttggctttagctttgttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcgcgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccggctttagctttgtttaactgactctggttgtaaaaagtaggcatggtcattagaacaacagctctagagtgaacagggttcacatccctgctctgacgttttccagttgagaggcctctggtaaataacctctctgtgccctggtttccagtttctaaaatggagaaatagtacctacctcatagagttgttgtgaagattacataagataatgcacacagtactgcctggcacagagaaggtgttttataaatggtatccatgacaacaacagtggtgataaggatggagataaggataatgcttagttgatttccagataatcatgatctaagctgggaaattttctgtcaaagagtaaattgaggcgaggcacggtgcctcaggcctgtaatcccagcactttgggaggccgagacgggtggatcatctgaggtcaggagttggagaccaccctggccaacatggtggaaccccctgtctactaaaaatacaaaaaatcagccgggcgtgatggcgggcacctgtaatcccagctacttgggaggctgataccggagaattgctttaacccgggaggctgaggctgcagtgagccaagatcacgccattgcactccagcctgggtgacagagggagactgtctcaaaaacaaaacaccagagtaaactgacattaatttttaaaaagaaatgatatatgctggtccaaataaataaacaatgaagtattaatgtcacatctgaataacagaaaatcttagtttggaaaactgtttctacttacattctcaactttcgagtcaggtgacagtagttttgatttgatcctattgatttataggaaagtgtctacttctcatgtaataaatatagttcctgcatgagctaaagcacactctttttcttctgttgtataagtagaaattatgtaaatattggcattatggtatgatatcagctatttaaaatggcctgtgatagttacattgttcaattatagttggaatcaaagaatgaatttttcaatagaaaagtaggcaacagtcttaaatcatgcagcttacaaaagaaatagttacataaaatatataaaaatatgcttaagtagttgcaatcaaaggaatgtataagcaaaactaaagttttttttttaaccttatcaaactgacaaaaattaaaaagatggacattgcctagtgttggtgctgtcatataactattgatggtcaattggtactgtctctctggaaagcagtctggccgtgtatatcagaattttatatgcaaatgttctttgactcaacaattgcacatctggaagtatataataaggaaataagagaaagagtgcatagtctgagatccttgatgtttattacagcatagctaaaaataccccctaaaaatggaagccatttaaacatctgttagtgggcattagtttaaaactatggcgcttaacagaaggtacagtatgctgatcgcttagtttaagagaaaccagggttcaaaagctggcttcaccatgtctagctgtatgatcttgggtaaataacttaatccagttaagtctcacttttctcttctataaatcagaagagtgacacatggtttctaaggatgtcatgaggattaagtgaaatgatacacataaagcacagtgtctagcacaaaataactcagtatatgttagcaactattattaccatgtgcttcttaaaaaagatgaagtaggtccatttgtattaatattgaaaagtgtctacaagatcgtagacacctttcaaaaaagcagtttacacaatagcttatttgtattaaaactgtattaaaacttatttgtattaatagcccacttgtattgagactatgtgtgtgtgtttatgcattaaagttttggaaggacatagcaacagttaacatttaatgagtacttgactgagtcttaggcactattctaaggactttaacacatatcaatcagtcacttgattaaaattagttatatgttttaagtgcttggaacaatgcctatgctttataaaacactcgataaatattagttattaattttcatatgctgtcattatctctgttttatagataagaacactgacaccctgagagttctcacagttcataagtggcagagccagaatttaaatccagggggtgtaactccagtctctcactcaacagttaaaactggatattatgggaggtaggattgtgaggtcactttcactttgcaatttgtatacttatggatattttcacatttttacatgaaacattttatttttatatatggggcagaaaatatccagtttggaaagaaaatagtgcatttttatattttagaaatcttttttcccctctgttattcactacctatggcatattccagagatctgaatatatgtacacttaggttgccctcatgctaagggtcctgaacaaggagttcccatgacctcatacactgtataagattttgagaccctaactttggggcgcacagctaaatatacgtttagaagtagagtcccagactaaatctacattactgaatggtaatcaacttctgtaattgaaatcttaatagctttcaagaaacctttagtcataatattttagtttccagcaagtttgggataaaattgtcattctttggtcatccgaagaaagcaggcagaagccagttgtttgatccacagatcggtaattgtgagataggaagcaatgacttagtgttagatatggacatgagtgctagggctattagatgctacataatccaggactcagcgctggctatcagtgttctgatatccaactttgctgcaggggtagtacagtgtcctggagtggtcactgcactgtggactctcagctagaatgggagcttcacctgaaggttaggtgacatggactaatccaaggttttccaccaaatagctaaatgtctttgggcctcacttccataaaatgagggagatggactagataatatagtctctctcacttaatgacagataagatggtctgtatatcacttaatggtgaccaccttctgtaattgaaattgaattcaagttttgtgattttatcagccttgcctcttgatgaactaaatttgcaatcttagacctgtagtagagtctagaaaattgctaaatagaattgaacttataaactgatttatgggagtgtttgccagtgtgcttacttgaattacaggatatccttgatgacaaccaactatacaatttactttttattccattttaggtatttttcccctctcctagatttgttttcctaataatccggaattgtgttctaaagatcacaagtcaataaaatggtgtggtcctgttcattgcttaggtagtaagctgttcaggtattaatgataaaggtcattaccacataaaaatttccttcctgcctcaaagttttttgtattctggtatcttaatgggatggatgccttctgttttctcatggttgcggaagtcaagtggtctgtgtgtttaacacaatatctgagtctgatgagtcacatggtatgtctgcttttagttgggaacagttttttttggtcagttgtgatggtcaaaaaagtctcttgggagagtttaaatgactcaaaataaccaaacatagctcatagctacttaggtcttaaaattgtgagcttcgtgataccatattttaattttagtcttgtctaatttttgtacccccaaaggactgctgcttctggctcttaagttgttaaaacattagtctgatttctttcagggggtggtttttatttgaaaaggaacagcaaacaaaataacacagcaatttaaaaattaaaattaagaaataaaaaaggaattggtacaactgagaaatgcttacaactctctcctgaagctgttcagtgatgcagaagctttgaatgctttgaatgaatgggaaaattaaaatttgagtttatatttgaaatttttattttatatactcacttaaactcagtctatttttcaagttttgttgtgtgtgcaagtgtctgcttggtctgtctgcctcactctctatctctcattcctattcaaagtttacttttaagaaaatgaaaagcaagtgttcaaagctgcccaagctttgtataggtttatgtgttcaggctgcttcccaagcttgctcctccccttccctttgccagggtgtccctgcctctcaccactcatccttttcctgccttgtccattcatcagttgttctctggtcacaccaaaccttcactttttagctccaaatatgtattttggacataccgatgttttgaatcaggcattatctcccttaaaacaggcaaggaaagagtaaaggggagtgggcatcttccttaaagctagaacatttattttgtctctctcttctttgtatgattttgaaggagtatttcctttatcttaaataagacttgaagataatttagctaagattattgtgctgtcctgctttttggttttgatatggtcctttctagtcaccagtggaaaagctatttgagaagagagtgatagtttgagccctcgtaaatatgcccaggtaggtataagccaccaaaaaactgttgccctaaaagctcaagatatgactggaaaacttcttcaaaatttcctttattattctctgatttgtctttagttttgttccatgacatccaacttttttttgctgttctttgctgttctccactaaaccagaactaagaatttggtttataggaaaaaaaattcgagtactgtggtacctgaaaaaccacctctaagtgctgaaaagtgcaacttgattcccctttacccctgcccccaaacatccagcactctcccaggatcactcttaaatgttttctttctgcttataaaatggttgttttcctattattgaaaatttggaaaattcaaaaagtgataaaagacaaaatttaaatcatctgtaatttcacactgtttgttcatcacaatttaacttcctctcccatttttgtatagttgagttcatattgtacttgaaaatagaactttgtatcctgcttatttacttaacattatttttcatgttaaaatttgcagggagaattttcttcagtgctgtggtattttatactatcatcattccatcaatcatttcatttaattttaaacatttggtttaagtcgtttgctattttaaataatgctttgattaaaaaaaaatctttgtggcaattttggttatttgcataggatagactcctaaagttggaattatgtcaaaaaataaaaaatatctctatggttcttggtataaattaccgtattccctgttagaaagggtcacatctgtgccagctaacacaaatgcatagggtggacagaaaggcacctcataacagactggacctcactaagggggtgttttccccttatattgtgactactttcatatagggaacatactgcataattttaaattttctgtgtctttgattcactagtaaaattgaacatttttcatgtgttttaaactattcctgtttattatcaaacagtgttatgtatccatttattagggtctttattgtctcctttcgactttaacattaaaaaagctatgtatgagcttacttgataaatagacatgtattttaaatatatgcttttagatacacttttttttttttttttgagatggagtttcactctgtcgcccaggctggagtgcaatggtgcgtgtgacatcttggctcactgcaacctccgcctcccaggctcaagtgattctcctgcctcagcctcctgagtagctaggactacaggcgcatgcctcatgcctggctaattttttttgtatttttagtagagacagggtttcaccatgtgttgcccaggctggtctcaaactcctgacctcaagagatccacccgtctcagcctctcaaagtgctgggattacaggcatgagccaccacatctgggcgcttttagatataatggacattgttattttacagtgtttttctccaaattattcttttaatcttgtttgatatacagtatatacatatgtatattccatatttttgtagaatgaaatgtagcacaagttttcattgtactgatttcattttaagaaagctcattccttccaaagatccagtagttatccatctatattttcctctaatttttttgaagtttaattttttttaacttttatttcttcccctccttccttcattctttccttcctttagttttcatgtgtgtccttttgaaccatttgcaatttattttgcattttggagtgaaatgaatacttgacttgattttttcccctaaatggatacccagttgttccagtactattaattgaatgtcttctcctcttctcctcttcccataatctatgattatgttgcctcattctaagcgaagactttaaaatcaaggtttggtttggttttgtttgagacagagtctcgctctgtcatccaggcaggagcgcagtggtgcgatcttggctcactgcaacctctgcctcccgggttcaagtgattcttgtgcctcagtctcccgagtagctgggactacaggtgtgcaccaccatgcccagctaattctgtatttttagtagagatgagttttcgtcatgttggccaggctggtatcgaactcctgacctcaagtcatccacctgccttagccttccaaaggggttacagagacatgagccactgcgcccagccaagtttattcttacatattttatgaatgttgtactccatctcctcctccttgctacttttgtgaacaggattatttttccatttctaaatttatgtctttaaaattaacattttaaagcatacatttattttaaactttaaatttccctatttaaaaaatctttcgtcttacttttgacggacccatattctttataacaaaagtgaaaaatatagaagaaaactcatgatattgggttactggatgtattaatagatggaagcatggctcagctgacaaggcaaagggaaggatagatccttctgggtgcactagctatcatctcactcatccaaacccacaattcagagccatagtttaaacctgttggccccaaattctctagatcactgtaatatctgtctttcccccaaccatgctctcatgctctccaaaagtttccctaggccacttaattcatctttataaattctataaatttctgtatatattttataattaaatatgaataacataaagatatatcattttatatatatatttataaatttgttttttcccagttgttttcattttgttttacctctgaatatttcctcctttacaaataatgttgacatactcactctggtctcccctcaccttcgttacccatcatctccctcccccctgccatttactcccccttcttgcaaattgtggctttttttctcttttatatcaatcaagacaaatatttttctgtatgtgctcgtgtgtgtgccagtaatagaaactgatttaaaattcttttagggatgcccatactatctaaaagttggcattgatttttttttcccatcgaggtgctagattataagtatttgaagttatgtggcatttctgctgaggtaattttttaaagttaactatgacttgattcagctgaacatttttttgcagacaaaatctagtgcactaccagataggcatatagcaatagaacaattaaattttataaatattttaagaatagactgcttctttctgaatgtttttgagaaagacagggtgatagtttatctaaacattaagatcggtaaatagaattttaaataaaattgctgctttggtaaatttacctcttaattgtttgcatttggtttataaacactttccccttctcattgcaagttttaaaaaaaaatgaagttcagagggatttttagtaattatttggaccaataaactcaggtattctgccatgaacatcattactacagccaaataagctttcaggtactcaaccattgaactatatttttgtgcataggaaaactatttcgaaaacagttttgaaaatgaaaatgctaatgttgagttcagcaccactgtgccatcatcaccaaccttatgattcacagaaggagcaaagacaagggtgtctgtttatgaaatgcattcctctggtctagtgatcagggcatacgccacatggagagggccacgctaaataaaaacaaaagctattaacagcagatacagtaaagagattacaaataaattggtgtgtgttgcctcatgagaatcactcttttgtgagagaaagggttagctcttccctggaacacctctacctctagttctaccccaaatcactactaacttctagtaaggcttctaccaagagttctttttttactttaaatatttctttttgctacatttctctcccctctccattagaagtaatctaatttgtcaaagaagtaggctaagatcagaagagagagggaatgtctattagagattaaatttacaaactaactgacaatggcagcagcccaaggcaggagggatgagcaggaagattgagcagggaagggaagaaaattaataatttttgagcattaatatgtgctaggagatactttaaaaatattttttactgatttattgatttatcaaacacatgacgtatctcagtccttttacaagtactaacttttagaattatcttaagtcttatattatcataataagcatgcacacaaggtggctattattatatttatttaacaggaaactgacacacagaaagtttaaagtttaatttgcctaaagtgacacagctagtgaatggctgcaccaaaattcagacccaggcaatctggcctttcatcctgtgctctgccaccatcaaagcgtcatatcaaccttataaggttggcatttatgatctccattttagaaatgtggatcctgactcaggttaaataactcagacaggatcagccttaaactaactttcttaaactagccttaaactagcttttcttatactttctgtccttactgatcatttacccagtcatccacatctgaaacttagagataattagagactttagtctttccagctgactaactgaggcttcttcacttctgctactatcttaattagtccctcactattctgtaatctcaaatgtgctgtaaaggaagcaggtgggtaataaaatgtgggtaataaaaagtgaatgagtctgggcacgtgggaatggagagttggtggacgggtgggatgttgtattgtaaggggccggctgcagctctgctccagctgtcattgtggagctgacagagctcattgtggacagatcagacttttcaggagaaaccagaaacctggattttcatgtgaaaccttctactttctaaattgtagcacaagcctaacaaaatgattctgcaggctaccaggttgtaatctctgactattcattattaagcctcctgagcagatttacttcctctagtctgatctgtacttccagccttttggccatcctccctgtaccagcataatctatccgaagtgcaaatcagataggatttgagggctggttaggagaattaaatgcttctaagaatgtaatattcttagaagaattctgggtacttgggtaaaaactcaataaatattctttaatggctgttaggttttcactaaattaaaagccttgagtgattcccatttatgttcaggataatttttaacatgacaaaaaagttccttatttctaccttcatcttctgccatttaatcaaatatactcagtctatcggtatgcttaagtgtgtcagtgtatttcatgccttacagctcttcctcctctgagtccatctgactggtgaactcttactatagccccatcccctccaagattcagttcaggcatcaccttctgtattaaacctttgattatccttcctcttgaagcactgatttctccctactttgtgtctccataagatcatgaactccctaagggccggaactgtgttttatcagtcttattctcagcacttcatacagtcaacatggtatatatctgcaataaatgttggttgaaaataaaacaattagtgaaagttaatgctgggatttgaaacttcacctatgaatttcttgcattttagactgtgcctcagagaggaaagaagctgtagctgccctttcgttagggacccagtttatacagtgtacaatctgaggacttattgtagcctagggcattatgattgcaactagtgaattgaatttaggcgaatttttatactacaaggcaatatagtagcattaaggacactccttcctctgaaatgcagtatgtgaaaactaaggtgaaatcaccagttaaataatttgttttacagccaggtaaagcagttctattttcttcctttagaaatttgatggtaaatggttggagataccacatctatttataaatggcctgagtgccagatttgttatctcctttccccaggcttgataaaaaagaatgttggacttaactattggtagtgtctccattaatgaatagagcagtctggagaaaacacacgtgaacaggaaattcaagggcaccttgtgttgtttttatcagtccaggaattctagacttgcaaattgtatcctgttctttttctggccaaagaaagggctttaataaaacaaaaagaacagtgttaaatccattaaaggaatacatttgcaatacaataagtgccagtcatctagaccattctttgtaataatttgatcacttcttagttttgtataatttaaatttttaaaagtctgtctgtgtctggtaagaaggaaacaaatttttcttgtttttaaagctaatcttgtttttaaagctaatcttgtttttaaagctaatctttaaagctaaactatacaagatattgtataatcatgagtaagggtgggatttttgttttttctgcaaatgtgtttcttaagtaagatttatttctgaaggctaatagaataccaaatgattctgtatttcttaacccaaatgaaattattatatatgaaacacacatataatttaaaatctattacattagagttgagttaccatcacttacagactgcctactgtgtgctcatcactttgccaggtactgcgatgctttcattacaaagataaatagatggagattttgcccttatttggtttttaaacaagacatacatgtatgtgtaactacaatggaaagaacatcataatcattactaaattatatagagtctaaaagtaatatttcattacttgacatccacttccgattttggagtaaaactcattacaacttcctatgatggaagaaacctcatcttctatttaccttcttttttgaagacctcaggttcataaatatttatctaaaatgacctcatatgtatttctatactgttgggttttttgtttgtttttttagcctagatctcactctgttacccaggctggagtccagtggctatgcataggcgccaccatagtgcaccacagccttgaactcccaggctcagatgaccctcctgtctcagcctcccaagtagctggggctacagacatgtgccaccatgcctggctctatttttatacggttaatgcagacaatttctgttgtttggaattgttttgaattccctaacacttctttatgtttcacaaaaatttcctcaaaagttttgttccttaatgttcctcaaaagttttgtccacctctagccccccaatttggcttcattctgggaaggcctagtctgtagcagaccatctcctacagccactttccagtggacataggtgctctaggcaagatagccatcagccttgtgtgttttagattccaccttatcccaatcccattcaacatttaaattgaataacagttctctttgttttgatgccatgctcgccaagcaatcttctgaacctaatttcttgttactcagtgtcttactgtgtaaatcagtaaactgcattctgtcttgtatatttgtcttttgtgaactttgttaggataaagtgacttccagaatttgattgccctgagacactggcagctgagggccagaccttgccgcttggcagaccgagcagggcagcctgctcgacaaggccccttggcagacagtcagctccctccaaggccaaaccccaagttcaacatacatctttctctcccatttctgcaagcataactgtgaacagcataattctgtgagtcatgtgttatttctttgtgcttttttcaagaggcattataaaaggttttttatgtttttcaccattcactttttgaaaggaatatataaggccttggacaactagagttgggtctttaccttttgttaaggcaaacttgtaaagtggcaaaccactttataaatttttattggctacagatcttctggacattttctctgttcattagtatctgcttgctagaacaaatacaaggcaagtcagaaatcattctacaatcgtagggtgttgctctttaatggtacttttaaggttttcccaccccaaatatttgttgaaaaagtaacaggcagttgtttaccaaaaagcatttgaagagaactatctatgaactgcaattttatatgcctagggaaggttcactggaatactactgcaaattgtacacctgtcctccttttgaggattcaggatgcatgttagcatattaaagatgctgggaaggctaggcaaggtggcttgtacctgtaatcccagcactttgggaggccaaggcaggcagatcacttgaggtcaggagttcgagaccagcctggccaacttggtgaaaccccatctctactaaatatacaaacattagcgtgcacctgtaatctcagctactcgggaggctgaggtgggagaattgcttgaacccaggaggtggaggttgcagtgagccgagatcacgccactgcattccagcctgggcaacagagtgaaattctgtcaaaaaaaaaaaaaaaaaagatgctgggaagtcttatagtaagaaacttatttaactttgtgtagtctgggtttcttaaatttacttaaattcctcaatttccagtccatccttcctctcccatcccaagccccagttaacaaatgtgatttgatttcagagatgttttctatacacgatccctgtttcacttttccttctttgacctttttttttttttccagttagagacagggtcttgctccatcacccaggctgcagtgcagtggttcaatcgcagctcattgtaaccttgaacaagggttcaagcagtcttcctgcctcatcctccagagtagctgtgactacaggtgtgcactaccacacctagctaagtaaaaaaaaaaaaaaaattgtagagatgaggagatcccaggctgatctcaaactcttggcctcaaatgatcttggcctcacaaagtgccaggattagagtcatgagccactgtgcctggcattctttgacctttctgcatctgatcctgaaacatagaacatgagcccaatgattctgaaatttccaaaaatgatttggcagcattgttttagcaattcagtaagagcagcttaatccataaaaatcacttggccatgataattcttgagtttatttttcattatttattgttttaaaaaataatgctcattattattaaagcatttagcacaatacaaagattaaactaggtgcctagaatagtatcttacatttgtataagccattgtggctttcctgtgtattatctcagatggccttagaactaggcctgtgaaccaggcagagcaaatattttaagccctgttttgggaaaagtgacttgagttaagggtgttctggtgatttgaataagaccatatgatcagttagcaacaaggctgggattagatcttttaatttctgacttctaccttctgtaatttctttttccacagttgcttattagccaatctttacagagcactttactattggctaattctttcaactactgttactgcgccccctccctccccccaatcaataggttgtctcattcattcattcatgactactctgagtcagatgcagtgctgttgtgagttttgaaaaatgaatcagaaagagttcttacatggagatgttcctggtttggtggagtaactgttagggccgaatttttcttaggagtgataagccaccagtacctgactacaaatgttagagaacatgcaccaaaaaaatgagaaatgctttgcctcttctgcagagcatgttagagaagtcaccacagcagtaagacttcagctaaactgggccataaaggatcagcagattcctgcagagacatatcctgcagtggatataactgcttcagggataggtcatggaagagcttggaggcatgaaagagctaggtatgttgggaaaagaatgagtggtgaggaagagcatcagataaggatagaaaatataaaaagcaacagataaggatagcaagttggaatcctgactccacatcacactagctatgtgacttgccccaaacttcagttccctactttgcagggctgtcgtgaggatgaaatgcaatcatgcatggcaagtgcctctatcttaaatcctcaggagaaaaaaagggggaaatcagtgaataaaatatcataaagttcctgatatataaccatactcagtgtatgtgagttgttcttattgatcatatgtagctaatttgacttgcagtaggcaatgaggaaccatgactgattctaaacaagtgacacgatcagcttctcatttaaagtagtcagcagaggaacaaatttatgccaaaataatagatgcagttttagacatagtgattctgaggctcaagcagtacattgaggtataaacccctaataggacaacagtagaactgggagtttgccatagataattgtttgctttcaacctacacttgacttgcttgacatcttttggttcattccatcaaccctggaatctagtccacttcaggtccacatccagggctctgtatcttctttacttaaagcaagatggatgttgtggcataggtggcaggtttggggaacacttttcaactaagaatgctttggatggtcactcttggcaagctggatcttctttggactggtctgttacgatcttcatctagataagcaaagcctctttaatgtatgaactcttctagtctttttatccagatgtggctgtagtaggcaagtctcttagggtcagtggccacctgccgcagccatcggagttcagtcttccccccgtcaagtggccattttgccacactccttatctaatagtccagattattttctttgaaacggtactttgtttgcgtggcccagtgatctctaaaagttggcactggaatgcctttaagcagacatacattgtccacttaaggccacaaagcttccctgttgttacctggcttcattcatacatttctgtttccttcttggttcctataggcatctgaatttcatttgaaaatgaaatgggctgcacagtctggagaagtgtactataccttgttatagcacgttttggaatgacccagaattcagaatgaaatgggcagctatgagccccatccaaaggtgcctgtttctaaaagtagtttccccctacaatatacgtgaacgttgctttaggctggtgtttatatgcatatttgatacaacacttcatgtttcatagaattcataaggcagaagctacttcttactattaaactaaactgcattaactcttaggagactgacatttatcagggacatagctattagcactatcttatagattttatttagtaatgaaacaacaaaatagctggaacttttcttgttttgaatgcttgttgaatgtgacctttgtatataaatgtgtctatattatatatggatgccactggttcttctttgctgtcattaactcctggttttgccaccacaatatgaatttctcttgctttggaaatagtgcttttctttcttccctagctttgtattatttataatgtgaaatacttggatgtgttaactgttagggtcgaatttttcttagttgaaattgaacattttcagagtttattataaaagataggggttttttttcccactgaataatttgtttttctatgttgtttcagtttccgttactatggcaatgacggcagggactacaacaacctttcctatgagcaaccatacccgggaaagagtgactgtagccaagctcacattggagaatttttatagcaacctaattttacagcatgaagagagagaaaccaggtatagtaagggctaatcaaaactttttttagttaaataagctgttgtgctgtgagtggaatagaaacttgtttaccatgaatgatatgaatattatggatccctgcatgctgtttttgagtttcctgtactgacagtgcacatagacatgtgttttattttcacagagtagtttcctgaggtgccccaagtcttgtgcatctatatacccgtatgacatgccaattaacgttttaaacaaaccttttccaaacatgaaattatgatatgtctttacattttcttttaaagggatgcctggcttggtgtggtgtggctcatgcctataatcccagcactttgggaagccgaggtgggcagatcacctgaggtcaggagttcaagaccagcctggccaacatggtgaaaccccatctctactgaaaatacaaaaaattagccgggtgtggtggcgggtgcctgtaatcccagctactcaggaggctgaggcaggagaattgcttgaaggcagcagtgagccaaggctgcagtgagccaagatcacaccactgcactccagcctgggcaacagagtgagactttgtctcaaaaaaaaagatgctttatgaatgactgactttaatccaaaagcatttacagtgcatatcagggggaatagaagaataaaaaaaagaatgacatgttattttgactttagaaaacttatactaaaggagataacacacataaatatataaatgaaagagtgaagaatattaagtacaaggaagggagaatgtgcttttgtctaggcaactgggaaagctttgtaaatagtggtggcatttaaacagggctctaaaggagaagaactatttatacatgcataaaaggaaggagacagaggcaaaagagcaggagggaaggatattagagacagaagaaatcaccaggtcaggcagtgtccaatttcgctcaagcacaggatgtgctagattccaacatcctgggagccttggattctttgttaatgtagctcttttcatggtagtggagagccttggatgtttttgagcagaagaatcaaatgaaaacaagtgtttctctagaaaggaactttagttgtgatacagagaatggtttggggtcagggtggggaattagaaacaggaaagtctagtgatgtagtccaggtaaatggaaaggaggcttgaattagaattgtgacaacaacaacagagaactgacaagtaagaaagattgacaaaatgtggctactagcaaaatatgaaatgtgagggaaataagtcaatgttgcctctgaaatttcatgcctgggcaaactgagagtggtacagtttaaatgaaatagagaggaaaagtctcatttaattttggacggatttaactgcagattagatacaggtatggtgagaattagtgaactggaaaataattattcagaaatcaacttaaaataggaatatgtgaaagagagttgagaaacatggagaatcatgagaagacttgacatatctctaaaagttctgaaagggaggaaaggaatgaaaatagagcagaggcaaacaaacaaaaaaagagttagcatcagcagaaattccaaaaagttccatttaggcagaaggaaagtgaccacaaatagaagatttaaatggtaagtaggtggataaatctcaacaaaaattatataaagcaacagaaataatagcgataatatcttacacattaaaaaatagaacgataatattttccaacagcagaatataattcaggaaagaagtaattagaattaaggtgttcttaatgatcttagtagaaagggcatagagattagcttcagagtttgacaaattatgttgtaagttctagagtaaccataaaatgataaaaatagagtttgtaatttccagactagtagaaggaaaaaattggaatgagaaaaaaaaagtcagttcaaaaagaatgcaagagagaaagaaaaactgaaataccaaaaatggtaaaaatgaaataccaaaatagcacaaaataagttagaaataaaaatctaaatatatcaataattaaatgaattacaagggtaattaaagtctctggaagtgatcagaccatcctgggagagtgaataaagtagaagagaaccaaggaagaaaaagcaggcacttaaaaaaattcatcagaatttcgaaggttcattgtctttacttgctgcagtgttaaagtaattcagtttgctttctttttccaaataaaggaaagtaacaataaaattatctgtgttattgaaaaaaaaagtagtctcagcttggtgccactgtatgtcaagtcgaacaatctgctcatattttctaaaagcttatacttttaagaaaatgtgatgtatttttaaggcttaactaattggataaatgcataagcccaataaatttctaatcagagcaaagcataagagcattttaggtggaaaactatttttaaaaaaggtacaacagaaatcatggatcttcctgtttagatatggtagaaatggataaaagttactgtatctcttccagaatgaggaatgatttcatgaagtgttagtcttggcaataactgaggaaagggacagtggaaatttgacagaagaataaagttgtttatatgttatagctcctcccagaataatggtcctcttactctctggattctttctgcagaggagaaaactggaaatcattcaacaagcagcactgaagtgcctaggggtaggtgatggcagcacagaatctgatgttaggagattattcttgtctaagggttggggcctaggggaaataatgcataaacaaaagacaaaaatcagtgtaataagcaccaaggtaggtgcctatgacaagcactgaggaaacatgtgttggagaatatgctcttaggcctcatcctctccagtggggtgctgatgtatcaacaggctttaaatgttacaaatcttctataagaaggaaaactaagtgatcttaatgatggtttagtaaaaaagcttacctttggacatgtagccatgaataagaaatatcaaaaagttgtgggagggtttcaatccttaacccttatacccattcagttaaatcctgaaaagttactgttattctgacacactccagaactaattaggaggagttctgctaggtttatatttagggaaaaccaatacaatagaaataaaatactaatactcacttggaaatgagttgcaaaatgtgttccacaaccatctctctagttttagttacttcatccacactgcccttaccccagatgctcagcttaactaacttcaagggtgctgtttaaaaaaaatgaataactgaacctggctgtacctagaaaagcaaatgttctggtagctagtgggtttttaaaaaatatttatttatttagagacagagtctcactctgtcgcccatgctggagtgcagtggcacgatcttggctcactgcaacctccgcctcccaggttcaagcaattctcctgcctcagcctcccaagtaactgggactacaggcgccagccaccatgctcggctaattttttttgtatttttagtagacacggggtttcacagtgttagccaagatggtctcgatctcctgacctcgtgatccgcccacctcggcctcccaaagtgctaggattacaggcgtgagccaccgcacccggccgctggtgggtttttaaaaacacacatatatgactttccaattttcaaataattttaatacaataaaataaatgcaattgcattgaacatttttccttcataagttaaggaaaactgagcttagagtttcagtgagggacttagccaagctcatttagctaataagtgttagaaccagggatatttaccttaaaattttatacttttagtcagtatagttatctttttatatttctaatataagcattgggaaatattaatgatattggtagattgaacattaagtagcagagttttccatattagaacatcagtcattgccaacatttcatttaggcaggagcgtgaagtaagccttagaagtaaattattcatttggccagtatgagaaagcaaaatctgggtttgttttttgagaaagaaaactattcttagtgattatgttgatccaacttgaaagtttttttttttttagcctagcaagctgaagtggttaacctgaataaataaatgtatatttcttaagtggaaatagttaggaatgtatttaaaatttaatttttttttcctttgaaaaggcagaagaaattagaagtggccatggaagaagaaggattagcagatgaagaggtaatgtaattacctataattactgtacaaaagcacccccagtgacttttcattcatttgacatcaggtattttataacttaaataatgtggattttatcatttgaatatgggcttctttgttgctgtcatggatatcttttattgatatctttagaaggaggcagttttgtttttttcttaaattccaagaacacgtatttaagagaacattgccaagtgtattttaggtgtgtggaatgagaaaggcaagctccgggaggaattaatcaatcgttagcttttctaaaattttttctaaatattcttttaaagctatctatttctctagttcagtgctattaccctggtttaaactaccatatattttaacctgaaaaataactgtccccaactggtctccccatttcccacccccagtttttctgcatactgcagctagagtaattggtctaaaaatagatttgatcatcttactcttttgcttaataacccttcactggctcccttatctcgggatatgggcaagctctttaacattggtatacctgggccgggcgcggtagctcacacctgtaatcccagcactttgggaggctgaggcgggtggatcacgaggtcaggagatcgagaccacggtgaaaccccgtcactgctaaaaatacaaaaaaaaaaattagccaggagcggtggcaggcgcctgtagtcccagctactcaggaggctgaggcaggagaatggtgtgaacccgggaggcagagcttgcagtgagccgagatcgcgccactgcactccagcctgggcgacagagcaagactccgtcttaaaaaaaaaaaaaaaaaaaaaattggtataccttcactacttggcctctgcttatctctctctagcctcatctcttgtcacccgcccccgacgctgacaagtatgaatttctttgatgtcccctgtcttgcctgtggaccttttcacatgctctttctgctgcttggaactcttcctcactcctacccaactcccattattcttcaagaatctttagtagctgggcatggtggtacgtgcctgtagtcctagctacttggtaggattgaagtgggaggatcacctgagcctgagagtttgaggttgccatgagctatgatcatgtcacttcactccagcctgggcaaagcagcagctttaggcctcacttcaggcatcacttccactgggaaatcttccttaacctctcaaggtaccttctgtattctactgttcctgtccccatgggagccttaaaatacagtcttcccaaagactagacactgtaacatcttgttgagcattacatctccacagctgtctggcagagagctagaataaatatttggtgaataaacaaataatggcttttgccctcaaggagttttagattaggagagggagagtgagtgagtgtgtgtgtgtaaaaatatgtacgcatgatagaatgtggtgaacgttgaaaatatagagaagatttttcctctaattcagaggatcagaaaatgtttcatagaagaagtaataattgatttgaattgtaaagaatgggtagaatttacattagaggtaagggatgtatacaaaataatgaatacatgtacagaataatgagtttacatttgagctataaagggtgcaataaaaggaaatagtgaggtaagttgatagcacaccatggaaagctaggtttagaatagtttactaaaaaaggtatactttagtactaggcaatagggagtcacaacccagattaattagtttaacatgctgagtgcagtggcacacacctgtaatcccagcactttgggaggccaagatgggaggatcacttgagcccaggagttcaagatcagcctgggaaatatagtaagacctggtctctacaaaaaattttaaaaattaagcatggtgtcctgtgtgtgtagtcccagctactcaggaggctcaggtgggaggatcacttgagctcagaaggcagaggctgcagtgagctgagatcatgccattgcactccagcctgggtgacagggtgagagtctgtctcaaaaaaaaaaaaaaaaaaaaaagagtttctatatttaaagagtagaccatcatcaaatgattaattgaaatcaaatcagtatctaatcttccctgtacctttcctaggactgtagctgttccttatagttgcaatgtttaaatcaaatacaatattttatgacttatactaaaggtggtaactttgttaatcagttgactcaatctagaaaactcagatgtttttacatttaaaattatctatcattatttacatgtcattaatattttaaaagctcatttatgtcctttaaattttagtgagaaaggtagtgatttaaatctgtattccaatctatagagaaaaaataagactgagcatatctttcctcattttaaagttagaattataaatttcttataattaataaccatataattgcatttatatattatacatcattatattgatatagaaatcttaaacataagatcttaatttgaagtgtaggggaagagactgcaaaaacagatgcccaaacactaagcaggcaacggaagtgagataagctggccaggttggtttcatagtggcatctagggttatattcttttgatccagatatactttgtttacatattcaacttatatgattttttttttgcttccacaaagaaatagattaatatttttcctttttaaaaaatattattttcttaaatattgatccttacagtttatctgttggcaaagacatgccacttttcacattgctgtaataagagtcccagcccatgtggacatgcctcctagggactcgcatcagtggtggggactgacaaattagggaaccaaggctcatctaaagaggattgctaccattggcccctgtggccaaggccctgtttttccagagaagctagtaatctggactttttttgcagaataaccaatcacctgcttttgaaaaacaacttgcagtccaaatcaaatatatctgtaggttgaatatagtttgtagcttcctgtttgcaacttctggtctgcatcagcaagtactgactacatttacagctattttctctaatttttctgaataacttgtagaaaataggagatgatttttccataaaaaatagtcagtggcccataataccagtttataaaacttctaatgtttttctctaaaaaatgtttttaattccacaggtgcttattattaggctccatgctagagcctggattatatcaaattctgtaaaatagacaagctctctcaaccttaatataaagtatgttacagcatctttatatggggtgggtttgataaaaaataaaattgtctcataaaaataaaatagataaagttgctagctgaacccttttcatctgaaaaattttgtatgcactgtctgtcttatacaaatactggccaccctacagatggagagtttgaggaacacctatataaaaaggaatggagaaaggaagaaaagcactttctagtttcatctcacttaagaaaatcccatccaacatggaatgttatttactctaatgaaaaactaaataggcaagttcaagctataaaagagagtcgtgaaatgttaagctgtccacagatttttattgtcttctttgaagaggaaaggatgcaattaccacaaggatactgtttgtctttcaaggctacttaatctatacaggttgtgagtagatatatcaacaggctttttcaccaattttttttttaacatgaatttgattcagctacctctggactgcaacactgattctaagactaaaatcatggaatcaattttttttaactaatgtaacaatgttataggtgatgctcatttttatagaattatgtgttccatacacttgtgactctctctttttgctattaaatggctgggcccaaaaccacataaattgtgtgagtgctgcattatacaaactactagacaatttatgaaactgtgtatagtgatgtcatcttttccattcagattaagcaggatttctgcaactatatccaactgtactgttttataatctataaagggagagattcaaaatactttcaaaattcttattcttttatgtaattaaaaaaaaaccctcctcactacttccttaaaggacatgatactatagtgccaccaagtggccttttaaaaattagtcttaaaatttaaaatcagatactttttagagctctcttttgttttactagtaatttatttttttattattcaaaaggtatttttgaacacctatgtgcaaaaaagggtatttgtcattgcatttaggtaaaaagcagcaaaaaatagtcttcactattgtttcaggccacatttgttttcttaattatatcaatgtaattttagctccgttaaaactgatatttaagtagcttcccttaaagaaagcaggaatttgccagtgttggtatttcaggaattttataaacacacacacacacacacacacacacacacacacacacatatatttgagatggagtttcggtcttgtcacccaggctggagtgcaatgggatctcagctcactgcaacctctgcctcccgggttcaagtgattctcctgcctcagcctcctgagtacaggtgcatgccaccacgcccggctaatttttgtatttttagtagagacggggttttaccatgttggccaggatggtctcgatctcctgacttcatgatccatccacctcggcctcccaaagtgctgggattataggcgtgagccaccacacccggcttatcgcctcacttcttactgaaaaaaataatctttcattgttgtttgcttactttttccatagtaccattgtattttataatcaatatcagatgtggaaaaagacatttaaaaaaagacattaaagacattaaaaaaagacattaggcaaagcctgttaatttgtgtacttgatttttatcttcattactgtcataatttacaccattggtgtgccttagtgtataacttcatttagctgtttgaagacatttcttgatttcatcttcttagattaactttgttagaagtatcagaattccattgcattgataatacatgtttacatacatatttctaattaatagttcacctaacccttttaaaaacagatatatacaggagtagggagaggctataccatgagctgcatttagaagcaatgtttctaagctgttactttcattttgatttgtctgtccctccaaactgaaccactaaaagcttggcaggattcagttgaagatgaacaggagttaaattttttcactgatattgtttcttttccacttagtgtttcctctactaggagctaactatgtccaaaaacagaattttgattggtgagggtgaaaaatgaagtttagaacaataaaataaatacctgttccaaatgtaacctgcaggtatttcacagtattgcttattaatggaagttattttttgtggtctttgtagaatcagttatgaaattaccaacttggatattttaatgacttcttcttgtaattgtttttgcaattttatattttcaggaagttctatgccaggtctcaagcagtttattaaaatttgcccaagagtaaattctaccacaagtaaatctctttggaaacactaccattatgttgttattttattgtcacaagtctcagtagttgtgaaagagcaaccttggaaattaaggaattgaagcaaagcagatttcctgacagaataaaaatcagtatcagaataccattaacatttactaacatttaatttttatttatggaattgttaccatatagatgaaagaataagttatacatatatatatatatagacaaatatgatggactgaattacatatttaatggagtccacctcaaaagtaaagatttatcagttgttaaaaattttagaaagttttctttaaattgttttagcctaatagtatattacatattagtgctatcatttatttttacgtgtatcatcttttaatactagaagctccatcaaaacaacctaattataaaatcatccgtttaaattgtttttttttaatagaaaaagttacgtcgatcacaacacgctcgcaaagaaacagagttcttacggctcaaaaggaccagacttggcttggatgactttgagtctctgaaagttataggaagaggagcttttggagaggtgtgcttctttttaaaagtcactactgctgcaaatatatatcttaagataatttaaaatatgtgttaaaatataattcctggctgggtgcggtggctcacgcctgtaatcccaatactttgggaggccgaggcgggtggatcgcctgaggtcaggagttcgagaccagcctggccagtgaaaccccgtctctataaaaatacaaaaattagctgggcgtggtggtgggcacctgtaatcccagctacttgggaggctgaggcaggagaatcgcttgagcccaggaggcagaagttgcagtgagctgagatcccaccattgcactccagcctgggcaacatgagtgaaacgctctctcaaaaaaatatatatatgtgtttgtatgtatatataaaaaaatatatataaatataaatatatataaatgtaaatatataaatatatataaatatatattaatatatataaaatatatataaatatatatataacatatataaaaatatatagatataaaaatatatagatatatatatataaaattcctgaaataccaacactggcaaattcctgctttctttaagggaagttacttttctttcctgaacaaatagtagtgactgttttataatatatgttttttatcttttaggtgcggttggtccagaagaaagatacaggccatatctatgcaatgaagatattgagaaagtctgatatgcttgaaaaagagcaggtatgagttctttaacacatgtaatataaaggagcatccactgacgcagtgttaagagtgtttatattagaatttttaagaagcagtttacacatcttactacataagctattaattttttggtagcctgttttagtgtttctcagttcttttaaggtttcttctaaatttataatctatgtatgtctgcttagacttccataacagaacacaacaggctggttagcttaaacaacagaaacttattttctcatagttctggaggctacaagtcaaaaatgaaagtttgggcaggttttggtttctggtgaggcctctcttcctggcttgcagatggccaccttctcactaagttttcacatggcctttccttggtgtgtgcggggacacacactcctgtgagaactctctggtgtctcttcttataaggacattaattccacccttatgacctcattaattaaccttaattaattccctaagggtccatctccaaatacagcctcattggagattaaagctttactctatgaattttgtagatgcatgaacattcagtacataccttctgaaatacctccttttctgactacaatgaaaataaaggacagttctcagctcccagaatccctgtcacatatcagataatcaaaactagtctcctggaaatttgctgattttacatatttctaaaatctgtaaccttgtaaatattctgggctctctgcatgtttcctgtgccttaatgcagttacaaggggtggcttcgagtaaaggagggatggctttttgaatatttaaggagagaaattgtgaaatggtcattttcaggtgcgggaaagcagacctgctaaggaaatgcagttgaaggctcattgagatttgcagtcatgaatttaaagtgaaacccattggcatagctgggtgatttttcaccctagtttcagttaggttaagaaggtaataggaaccatcaggagacagggttataggggattttgttgatgacaggctatgattccccagagggaagaggtgtggaaggcaaggaaggttgagatactgagttggattagagaactatagataatgatgggaatatagcaagaccccattctccacaaaaaggaagaaaaaagaaagataatgatggcaataaggacgtgggtaaagatgcatagcctcagagacagggagggcaacaggaatctaacttagccataatgggattagtcctactagggtataataggaaggacagaaggaagcagttagttccagctgtagtgtagataccagccagccacatgtggctactgggcacaaattgggatatccagcaaataaggcttggtgcaaaaataaataaataaataaataaaatatttcaatgatttttatattgattacatactaaggtgataatattcggatatattaggttacataaactgtattattaaaaataatttcattctgtatgtggcttctagaaaatttaaaaattacatacatgacttgtgttacatctgtactggacagcccttggtctacaatattttgtgggaagttaaggagcctctggaccactgctctttcctgtggggaggtggggggcggaaatctctccgtagcctaacgtctagttgcctttgcattttggggttgttttttacccctgtataaattaatttgcatttgttaccactggattttgttttagaaagcttttttctactcaattctaatacatcaatattttaacttttatcacatttattttaatgcaaaccacccccacaaaattaaataccaactgatctcctcactgttgttctaccagattactataggtcatactttccaacctttggatcctgttttggaaagggatcctgtaatttggctttaaaccatttaaaaataatcaagccatgtttatgttgtagttgttttccttacacaccagatgcaacaccaaagtttagggcttttccttaccaccttaaattgcttcatgaaaggtaataggtaggcactcttgctaccacttttcacttaatgaaacagatccatagaaattataaagtattttcatgccagaagacaagttcttactcctcaactcttacgctttgatctcagaatatttactgcactaggagtaattccaaatatgacactttaagcagatcatattttattatcatagaaaggtttacaaatgtatgttctcatgtgctttggaccagagtttttaacgttgcacaatgaaaatagcaaaagcataaatcaaatcttattaatctttggaaaaagtgtataaatatattaatgcaaaagcatctgcaaactgaccagttataccaaccccataaattatccagtttataaaattttccagtctataacattttcacatgatagtatctctagtaattatgtgtccgagaaatcagtggcaaaatccccaaaagttacacaaatttgctttagctaacatttatagatatggtagaggttttatattataacaataatataacataaagttactataattgttactatttctttaaaaaacaccaaataatgatcaagctgggacctttgtttaacaattaaaaatagtttgctatttttagccaagcttaggtttgctgtaccaatttacagggcattgcttactctttttttttttgagatggagtctcgttctgtcaccaagctggagtgcagtgacgcaatctcggctcactgcaacctccgcctcccgggttcaagcgattctcctgcctcagcctcctgagtagccgggactactggtgtgtgccaccatgcctggctaattttttgtatgtttagtagagacggggtttcaccgttttagccaggatggtctcaatctcctgacctcgtgatccacctgccctggcctcccaaagtgctgggattacaggcgtgagccactgtgcccggccctgcttactacttttaactttaaaaatcacactagtgccctaaatttatgtgacaaagccaggatcctaggctgggtagagattctggttaaaaagttgttagactgattcttgctctacctcagaggcctcagcttcacgtaatatacctgttgacctcaccttttcagacctaaagatataagctaaaataaactatttcttgaggttctccatatttgatgagaatacgaacattcatacatgtatcaaatcttctgaaactccatctttccttcattaactgttatggatggataagtgtaagagatgagtttaacaaatgtgtgatgtatttacaattatttttttcaaaaatatattcatctaggtggcccatatccgagcagaaagagatattttggtagaagcagatggtgcctgggtggtgaagatgttttacagttttcaggataagaggaatctttatctaatcatggaatttctccctggaggtaaaagcaaacattgtatcaatgacagactgatacaagcacatctttatatgcaacaataattttattggtgaggtttacttttatattctttgctctgaggctttacatagtcacagtttaaaaatatttactaccatattgatgctcatttttaccacaaaacagattgttttgaaggaattataaagttagcacattttaaatattaccgttctgggttcactgtatataattaggttgttataagttgtgttagtttattttatgttgttacaaaaaatacctgagactggatgggcgcagtggctcacgcctgtaatcccagcactttgggaggccgaggcggatggatcacgaggtcaggagatcaagaccatcctggctaacaaggtgaaaccccgtctctactaaaaataaaaaaaattagctgggcgcagtggcgggcgcctgtagtcccagctacttgggaggctgaggcaggagaatggtgtgaacccgggaggcggagcttgcagtgagccgagatagcgccactgcagtccggcctgggcgaaaacagcgagactacgtctcaaaaaaaaaaaaaaaaaatacctgagactgtgtaatttataaaggaaagaggtttaatcattgctcagcaaagagggcaaggggaaaagaatggcaatggagggcaaagaattctgggttttgttttgttttgttttaatttttattttttgagatgaagtctcgctctgttgcctaggctggagtgcagtggtgtgatcttggctcactacaacctctgcctcccgggttcaagcgattctcctgtctcagcctcctgagtagctgggattacaggtgcccaccaccatgcccagctaattttttttgtatttagtagagacggggtttcaccatgttggtcaggctggtctcaaactcctgacctcaagtgatccacccacctcagcctcccagagtgttgggaatacaggcgtgaaccactgcccctggctccctattttttttaaagcctcaaaaaatatatgaaaaaaatgtaatcagttgtcaattctgtgttgtaagtgcaccagtgtttacaacagttaaaactgttaaaacttttaaaattccttgaaaataaaagaatgtctgcaggtgccttttttagtgggataatgtcccactaaactctaaaagaatatatttcgtttccaggtgcacttattctgatttttttgcagtttgacattttcctcagcagttaattctagaagttgagtggtagatattacttcattatcagctcttttgtgatttgatttcacatggtctctgccttaaaaccattaaaagtcatgaaacttctgctatgcaatagcacttttatttgtcccaagatgtggttagaaatatactgggtagatcataaaatgcaaactcaggaaagctagctgggcatggtggctcatgcctgtaatcccagtactttgggaggccaaggcaggcagatagcttgaaaccaggagtttgagaccagcctggccaacatggcaaaaccccatctctactaaaaatacaaaaattagctgggtgtggtggtgcacacctgtaatctcagctacttgggtggctgaggcatgaaaactgtttgaacccaggaggcggaggttgcagtgagccatgatcacaccactgcactccaacccaggcaacagagtgagactctgtctccaaaaaaaaaaaaaaaaaagtaaaaaaagcaggaaagcttttacaaggtattccacctttgaggcattttcaataataatatatttgactatcctttatttaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaaggcatgtgaataaactggtgaattactaggctgttgattattttttagagcagtagggctgattttgtgaatggaaatcagcaactgcaatttagaatattgctaaacaacattatatgataaggtactaggagaggacttgggaattaaatgacaacagggaatatggctctctttttatctccctccattttctacttttaaaaatcatcatcagatacttaaaattttacattttacgtgtataaatcccaagctaagaatttttattataattgccatttaatagaggagtttataacaaggctttttgttttcaaagttaatatgatctaattttactggatttttttttagggtcatgtaaaattatctgattttggtttatgtacgggattaaagaaagctcacaggactgaattttatagaaatctcacacacaacccaccaagtgacttctgtaagtttggttgttgtttttcttctttcccctggttaagatactgtagagaacagaaggttctttccctttccccactccttaatccactgtgttttagatgtatatgtattttctttttgtggagagcatttttccctcgtgattacaattccatattgttgaaattagcatttcagaacatgaactcaaagaggaaagcagaaacttggaagaagaacaggagacaactggtgagtcaaccagtttttaagagaattttatgccttggttctaaaatcttacctggttttaacttgattatttttatctttataataattagtatttacttcataacaatggtagcgcttgctctgggatcacacagttttcttagtttctctgttaagtttccttgcctgtaaagcaaagtgttggtttttactttgtaactttagagtagtttactgagcatacctacaagtaagctgtttactagtaattagcactttaaataaaactcactgaggtgaatgcaattgtaatgaatgccttgtgatttccatttttccatttttcataactgtgttacaaatcctgatacaacaaatatcaatcagcaagtaaggtggttgtgagtttctaaaaacttctttatagacaaagtaaacaggaagtttgggatgtaaacagtgttacaataaaacagataaaatttgaaaaagctggctttgccacagataaatttaattactcctttaatatagaattacattatttttaaccccatactatttcctttctataactgagcaaatagaagaattgcttcccctttctcctctttccctttgtcctgttaacatggtccatcaacagtctacaggttaagaatgtgccttaggattttctttttctcatttcttataaaatgcctggcacatacggacactctataaatacttgttcaaccaaatgatgaaaggaaaactaattcagcattccctcaggaaagtaaacagactgaaaaataataggctaataccctctaaaaccaaataaaatgacctttgcattattgagcttattatctcattaacctaagtaactgcaaaaacttgtaaaacatttcagtatttttaaatgtattgagttacacattaaggagaaaaactttgttctacttttaaaatgtgtccattttagatcaggttttgcaattgagaataattgcaatattccctatttttaaaggggaaaaactgaatactgctcaaaattatggtgggggaattctgtacccccctatttacaaaatattcatgggtgattactcaggtgtgtgttttattattctcatggccagtagttgccaagccttagatcgagtgtttcccaagggagaagtagagaggactcagtgtttggggcaggaaatttctttagcacctggatcccctgccctgtaaatgccagttatgtcactgagatgacaaaatctgtggtcctacattttgccatggccccaagagtactacccctggttgagaattactgccttgtagaaatcatttttgtaagattttatatgaattaagaattaaaaactgcatagcttcctaaaggataagcagtaccctggaattacatttataatgaaaatacctcatgcttatttttgtagtttgtagtttacaaaacacatgccgtttattgtttcatcttcatatcaactctattagggcaggtattattattctagttttatgtaagcagaagctgagcctcagagaaattgaataatttgcccaagaacacattagtagtgagtggggaagccaggtcttctaggttcaactttttcattctttttgaaatagactgaaggctatatatataaataacttaactgagcttcttgtgggggcagaaatgatatattcttataaaatgcctggcacatatggacactctataaatatttgttcaactaagtgatgaaaggaaaactaattcagcattccctcaggaaagtaaatagactgaaaaatagtagtctataacatattatctgactcactacctaccactaagccttgcacatgataaacatgcaaaataaatacaagtgaaaatttaactcctctatatattgctttttccagtagtaagccatcctcagatagatattttttaaatgttaagaatgctggtttgacgagttgctcctttgtaggcatattccacagttgggacaccagattacattgctccagaagtattcatgcagactggttacaacaaattgtgtgactggtggtctttgggagtgattatgtatgaaatgctaataggtatgttttatcattcatttatgtacaaaatatatacatttccttgagtgccattgtttgaacatattacagatatcattgactaaaatatttgaagtcttttaagcttaattctgatgttcccccaatgttaaatacatactgatcaataccagtgagctccccacggatcctgtttcaggaaggtgggtatttaacccaaactcccacgtataaaagtggttatctacatagcttttcaggtaaaaggggaggcagtgctttcaatcctttattttattgactttattagcaacgtgattgtaaattgatgaatggtggcatttttgactgttaaatagagcactcagggttgtttggtttcttgtcgcacatgtttggtgggtataaacttcactgctcacaaagctgatgaaacatttttgatttatttgatacataggatatccacctttctgctctgaaacacctcaagaaacgtacagaaaagtgatgaactggaaagaaactctggtatttcctccagaggtacctatatctgagaaagccaaggacttaattctcaggttagtggttaaattcctagaggagttcatagtgtcttaaaacttcctaagaacctaaaagactcatttcacttttgtgggggaagaggggataccactgatgtatacagtcaaagagatcaataaaggtgtttttaaaaatgtaaactcttaaaaggaagtatgcagaaaaaaacgtaggaattaaaaagagggaggaagtcttgtattgcttctgttactgatatatataaaagcaaaaggtcacttctgttagaatgcaatgacctgattccattaaagagaaaaaggaaaatgttaatagcagattcctgtcatgaaaagtatatatgtaaaatcttctaagcaaaaaattccatgtgttcctcaactaatatgaagtgttttggtactgctgtgaatggctggaaggaatataaattgggacaacttgtgggaatagccagttggcagcatattatttttttaaaatccctaaactatgtatgacctttgacccagaagttctacttctagggatttcgcttatgcagataatcagatacgtataaagatttaggtacactatgattttcatggtatttaatagtgaaaattgaaaactatttaaatgttcaacagtagtggactggctcaatagtagactgtctataatacctctatatgtaaattttagaaaacaaatttattggctgggcacagcagctcatgcctggaatcccaacactctgggaggccgagttgggcagatcacaaggtcaggaaatcaaaaccatcctggctaacatggtgaaaccccgtctctactaaaaatacaaaaaattagccgggcgaggtggcgggcgcctgtagtcccagctacttgggaggctgaggcaggagaatgacatgaacccgggaggtggagcttgcagtgagctgagatcacgccactgcactccagcctgtgtgacagagcgagactccgtctcacaaacaaacgaaaaaaaaatttattgaaaaatatttaatgactttggcaaattttctcagtatatcaagtgaaaaaaagcagacctaacatagtaactatggtagcaacacagtatttttaatattgtaaaagattagcatatttacagtagttatctctaaacagtgcgcttacagatgatttttattttcttccacatttcctacaataaacatagttaacatcaataaaagaaaaacattatatttctttaaaaaagaaatatttgaagtaatgcagctagaatactttagatgtaacttgtgtatgataatttctctgtttccatgttgtagattttgtattgattctgaaaacagaattggaaatagtggagtagaagaaataaaaggtcatcccttttttgaaggtgtcgactgggagcacataaggtatgttcctaggctttgaatgggaaaggtctgagtaaaaacaaatttctagagttggcaattaatttacctctgattctgctagattaaatacaaaagtaacatataatgtcattaagtgcagtgttttctggattatgtaagtgagtgggactattgtggctacagcttgatgactcattttaggctaacatccactttcagggaagaacattgggaagctgtttaaattcttatattcatattcacagtgaaggctgttagcacatgaaacatgtatttacatttcacacagtgacccctcatttttgtccttgctgtaatataccacatactgtctccttaattaatttataataaggtacagtccctctttaaacggtggttgggcattaaataatacaagtaacttttaagaatttgcttacagttgttaattgtgagcattggcttttttcagtttatggccaaactaccattggtagttctgatctgttctccacacagcaacagtttagaagcataaatctggccatgccactttcctgtggccttttgcacttggaatacagttaagaagccttcactgctttcttaggactgcaggatatggcgattgcctcatctgcaggagttgcgtcttggatggcctctcctactcctcttcccacctctaagttttgctatttgctatccatcctgactgaaatgccctctccctgctgcctctacccctaccctgcctagctggctcctttgcatcttccaagatagcttatgtgtcatttccttggtacagctcttcactggtgaacctgctgtgtgctaggcactctgcctattattattacttatttttttgagacagggtctcactctgtcgcccaggctggagtgctgtggcatgatcatggctcaccgcagcctcgacctccaggcctcaaatgatccccccacctcatccccgcaagtagctggaactataggcatgtgccaccacacccagctaattttgttgattttttttttttttttttttttgtagagatggggtttcaccatgttgcccaattgcccaggctggtcttgaactcctgagctcaagcgatccacctgcctcggcctcccaaagtgctgggattacaggcgcctagcccactctgcctgttgtaataatagctaatttttaaaaatcatttattgtgtccagcactgttttaagtactttacttgcgtttctcatcttatcctcatataagctctataaaataggaactgttattatccctgtcttacaagtgaggaaactaaggcacagagaagttaagtaatgtgactatagtgctgcagctagtaatttttttttttttttttttgagatggagtctcactctgtcgcccaggctggagtgcagtggcgtgatctcggctcactgcaagctccacctcccgggttcacgccattctcctggtggaggcctaactcttaaccactatgctgtataatactatacacacataacttaattgaatagaactagaataccctcccttttacagtgggaaggatgcttagagactgccagttcttttggttttataatgagggaacagtcatggagcagggatttggctgcctaaggtcatactgctagttaataacaaggaaggttagctctcaggcctccagggttctttcctctaaactaggtttattaaagtagtatactaagtataaatgagttggaataattctggtaaaaaatatatatggttttaaataatttggtaaacttagcacctaataaatccaataaatatttgttgaaaaaacagaagcaataaaaactgatagcttcttttaaccatttgtatagctaaactttttagcatgataagaaggcattttcatgactggtttctttttaactgagtatctttgattctcttaaaatttgtatgacagaagtttttgcatgcagatttcatcacaaatatatagtcccttcacctatgtgccccttattttcccaaatgacttttaatttatggattgtctactagtagaattctattcctaaatcaattaagaaggatcctgtcctcataatatctcaaatactttatacaattatacaatcttttaaataaaacctcttcttttacttttcattagctcatttttccacttaaaaaaataggatgagaaagccttgggtacagagatataaaaatggcaagtaggtggagatgcttaatggatacaaaaaaaatagaatgaataagacctattacttgatagcacaagagggtgactatagtcaataataattgtacattttaaaataacttagaatgtaattggattgtaactcaaaggataaatgcttgagggaatggacaccccattctgcacgatgtgcttattacccatttcatgccagtattaaaacctctcatggaccctataaatatatatacctaccacataaccccaaaaattaaaaaaatatttaaaattctaagtaaatgaaaacattttaataaaaaattatactcaactattttgaactccctttaactaatctcaaatccacaataaatttccttggattttctagtatctgtagaatagtatgcagaatttacaagtagaattatttgttggaaattgagagttcaagaaaagttaccatgcatacttaatacctttttatagggaaaggccagcagcaatccctatagaaatcaaaagcattgatgatacttcaaattttgatgacttccctgaatctgatattttacaaccaggtaagacaatctgtaatgtaactaaccctattaaaagtctttgaagatgatggcatttcactaatgaaattcctttattttttctctttctagtgccaaataccacagaaccggactacaaatccaaagactgggtttttctcaattatacctataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatatgaaggtactggaataaaaggaacagacatccctttctaactgcactgcctacatgcgtattaaggtccattctgcctgtgtgtgctgtggctttgaactgtaacacctctaatcaattcaggagaaacacatatcatttaaagcaacataggctaacctgtaggtaacactgcagtattgatgttttactgcaaatcttatgggtctagataatcagtaaaagccatcttccatagttggtgttagaacattgccctattggtttggacatctgtagaatatatatgaagacaatttctgtaatggttttaagagatttaaaaagaaattcactggttctttacaaaatagaatttatcatcaagttattacacaaacttcacagtaaggagtgacaagtttataataaggaagacaaagtttaacaccttcactcaagcactccactaatatatttacgttgcattcagaaatactgatgaccttcatatacgtagtctgtatactcatagggagatgtactgtattatataacatgtaaagttgattttcttgtgacaagagaacttctttttttaacaagaggacatggcattattttaatttgattatggtgagttgaatttaagacatgaccatgaaggctgcttgtagaattagtgtatttttattaaactatttttttaaatgtcaaacttctatcatgtaaatggacttatagagaacaaaaagctatttactttggttttctagaaagttgttacatatcatggctggttaacttttatttcttttgatgaaaatttttcctttgatagtacttgtattattgtgccattattttcttatgctccaaatgtaccaaagatcttgaacagagtggatgttcacaactgagtagaattttcctttcctgtgggcatgctgtattcagacctgacagatctttgatagaggtcagcttattaaagggcaatattgttcttgtttagctacatcactgtggtgaatatagatggaattaaggaagtaaatgcaggccagggggttgtgatgagaggataggggagataatatcagcatcaaattctttgggtatctctctaagaattaaataatcttttctagcttaatattttaattctaattcaaacaactctgaggttttggtttcattagtaatagttgaggaataatatactagcaaagaatggcctaatgtttgtcataactgttaatggatgaaattttttaaagatacaaccatgataaccattataaatgatctatgatcaaaatctaaagtgatgaattatttgtaggaatgtcttcctaatggggaagaattgcataggagcattatgcaaatctacacaagcttttataaatgttgctgctgggtagctccacagtgtttcataaggccatcctgtttcccccaactcccccatttttggtttgtttctttttaaatatttgttgagtacttacgtgtttatctaacagttcacttccatttttctagtctggattttttgagtatttaggaaagagagctattaaaaactggggatttctcaatgtgactaactctaatttttctaattataactgcctttaattaacataatattaacttttgctgaggtttatgagattttctcaccccacatcgctcccctttttttaaaaaggactgttttgctagtgtgataatgaataggtaagatatgagataattgcaacattgtctagttctagtatggtaactattcttgaaatggtattgaaaaataccgttaattcaaattgacagagattgataaaaagaaactgatttacctaagtttactttttaattgcataatagagcattttttgttttgagttccctcattcttattaccagaaagagcttgcaaatagttttactttcttggcactggaagggtagttctggaaagctactttgttgagagtctcattcttccctggagttaatagagtgattcacaatctttggggttttctcctcatcaaaagcatttcttaagtgcctatctaaaagcaattaaagactgtgtctgccctttagaagctaagaatttgattcatgatgcaaattaactagataatttgcaaagtacccttgagattgaattttctctattatatatttcccatatttcaggtgaataatttaatttaaatgacaaaaccctatctagtcaactgggcataatgacattttctttaaattagactctattttgaattaaaagagttttattataaaccgtgtgtttttggtttttctaagtatatagaaagcttgtataattcagatttatcaatttcctgatttaatgtagactttgacttttttattaaaaacctttgtattaaagcaagttatgttatttttcttttatgcatttattactaacatagctttaaatctttaaatgtattgaagcattgtgctgtctgaaaataaggaattgcttataaaccagccacttctgaatacaatatgtagctgatttaataagctagttagtgaatggaaaataagtgtggagtattaaaaatgttctttggttggtaaggcctaagatagggtttcatttatttctatactttttctgttttttaaacacctgcatatttttatgtaaatctctaaatttaaaatattttaagtacatttatttttggtgttttattgtataaaaccttagacaatcaatcagtcagtctttactgacaggagcagcagctatctgtcttttgctgatctacaaataaatgaattgagaatttagtccatagaggtccctggctaccaaacacattctcctttgaattgttaaaattcagaacattcaaaataactgttttgctacaacccatgattattttcctgttgtgtttatttaaatttactttctctttagaagtgcacttatttctgaaaaatcttaatgaaacaaacgcttagaacaaatataaatatgagacacttgggactactagagatattttagatttttatgaaaaaaatgtgaggggatattgctgctttaaaaaggaataaagtaataaaaatatatctcagctatttttttaaagcaatataattcagcaattgtctagaaaagtaatcatgaggctactgagtttggtgttcagttactgagtttcaaaaatgttttggtggcatgaggacaaaatttcattgaaggtaagataagaataaaaactatgtttac

SEQ ID NO: 37739 - DNA, 238526 bp, Homo sapiens
tccgggcgcccagactctgagagagagcgacggccatcatagaacagcgaaggcagtcgatcggcctgcggtccgcttcggcattcgcaggccgcaggcgggaggctagagcccccaggcgcacctcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcgggtaggtgcagccgcaggcggggtccgattggaggggcggcctcctcactgtcccggggctgcccgagccttgccctgcggcagctgggtaccccacggggcccgcccgaggcgtggaagggcggtggccgccggcctgcgagacgcgggggcgtccgagggagggggccaggcggggggctggcggctttgaccttcggagtctttgaggcgcgatctaggggggtctttggagtgaggggggctgagaggtccagcttttgagggtcggggcggtggggccgagcgacatgccttgggctctggatggggctgagccgcggagcgagggtcggccgcagtctggggccctgggtggggttcggaggtgtaggagaactcaggggtcgttttctgaggctttgtgggggtcagttgatgtgaggctgaggtgagccttagtatgtccagtcagggattatgggtggggctgaggggtggtctggagaaccgggccctaggcggggctcttcccccttgcaaaggccccgacactgtgtggggactaaagcgtgtgtctggcagtgggagtgcgaaagggtcacattagggtgggggtggggagggtacagggactaggagaggcagttggaaacattacccagaacagagattgtgatttagcacatggaacaagttctccgccggtgtgagttagatccctttggtgaaattgtcctgtggaggagttgtgagggttttgctcacttccaggaacgggtaaattaaatgcatttgctgctttggggaagaggcagtgattgattacctttaggtttgtgctttaggacccaagctcggatgaaatacgtgttcctcgcgaaggttagtgttacccagctttctactggaaacccccttttctcctttgccttctctggtcctgttacagtattgctccccagggcctctcgattctctctccctggttgcatagcattgcagtgtttcttgcagtgtgtgtgtgtgtgtgtgtgtgtgtgtgtgtgcgcgtgcgtgtgtgtgcgcgtgcgtgtgtatgtgtgtgtgcgcgcgcgcgcgtctcccgcccatttccctgctgctgtgcttttggcaactgcctctgctctttcccagggatggttgtggcattgcatcaggggatatttgtgcttgtaatttgctcactcagcccaggaggagggtgaatagtatgctgtagagatggggggcgggggcagggtgccgtcagcttggctgggtagacagagaaatgggtgtggtgagggaatacagctgctctaggcctttggggtaacactgcccagtcatcagcccaaagagattcaaagagcaccaccagcagctatttttataaatcaatcctgaatccaagctgagcacatggatttagagtgaacagttgtcatgctctattacaagctgggtgtttggtagacaacattaaagttgctaagcaggagactcccatctgtactgtgcagtgtgtactttacttgcaacttttaaactttgcttttctcaactccaaagattgggacatctctcttcaggctgtgtcttttaaattaacgtagtttgctgatccgtactactacttttcaaatgaaatgttttcacctcagttacacacttcctttcaaatttagcttcaaaataataaagctgtcactttttgagcacttgccatctcccaggcactagctatgtttgttaacagatgaggaaattgagactgatgggaagaagaggtcacacagatagttaagtggcaaaaatggtatccaaccaaaccaaggtctctccaacccccacatagtagttcagaaacttcagaattttggtttacattgggatgattcaagtgcttgagaatttattcatgcaaagtaaacaaactcaccagagactgataaaccagataccagttaatgcatgttggaagtattaagtgccatgtgcacaattggatttaattgtccactgaccaggacacctccattgttctgggctgcctaatcagtaataaaaaggtagttgattatggaattggaaaggcactagatattcttagtgggtattttttaaatttaaattttatttatttatttatttttgagacagggtcttgctctgtcgcccaggctggacagtggcaggatctcggctcactgcagactctacctccggagttcaagcagttctcctgccacagcctccggagtagctgggattataggcatgtgccaccacactcggctgatttttgtatttttagtagagacggggtttcgccacgttggacagactggtctcaaactcctgacctcaagtgatccgcctgctttggcctcccaaagtgccctgggattacaggtgcaagccaccatgcccggccatttatttttattttattctattttattttttaagatggagtctcgctgtgtcatccaggctggagtgcagtggcatgatcttggctcactgcaacctctgcctcccaggttcaagtgattctcctgcctcagcttcctgatagctgggattataggcacccaccaccacacctggctaatttgtgtgtgtgtgtgtgtgtgagtgtgtgtatatacgtgcacacacatacatatatacatacacatatacatatatatacacacatacatacatatacacacacatatatatatatttttttgagatggagtcttactctgttgcccaggctggagtgcagtggcacgatctcagctcactgcaaccttcgcctcctgggttcaagtgattctcctgcctcagcctccctagtggctggaactacaggcacgtgccaccacgcctggctaattttttgtatttttagtagagacagggtttcactgtgttagggtggtctctatctcctgacctcgtgttccgcctgcctcggcctcccaaagtcctgggattacaggcgtgagccaccgcgcctggctaatttttgaatttttagtaaagatggggtttcaccatgttggccaggctggtcttgaactcctgacctcagatgatccacctacctcggcctcccagagtgttgggattacaggcatgagccatcacgcctggccttacgggtattttaatcaaggaacaaaagtctagtgagtctccctttccccagtgtaaaaacacatacagtgctggaggatgtcttaacacattttcctactctgtctcacttgttttttaagtagtctcttcaaatatttgtcattccagcatccctttgttaaaattttcaaatttacaaatacatttatattacctattaaaaagtcattttccattgtttgctgacagtgaaggaagcacctggattttcttatatataggcggcttagctttagtcagagagtagattcttcctaatctcatagtgtcttgttcttcctaatctcatagtgtcttgttctttcctaatcttgtttctgaatttggtgatcaatcctttggctctgtaaacttttgctcttgacagtttttggaatcactttgcttttttttttttttttttttaaagattaagcgtgagtagttgctatgtagcttttagatttccttaagatgtgagaaaatctgagaggaacattttgacccagtggaaggcatcttggcagttcatgtatatagtcaatttgaaaaggaaaccaagtaagtatcagtgatttcactttgtctttctaaacagcacttttagaaccaggttattgtagacttattgctaggagtgagtgggttgagaacaattaaggttaagaagggggattgtagggctgggtggctcatgcctgtaattccagcactttgggagcctgaggcggaggattgcttgaggccagaagtttgataccagcctggataacatagtgagaccctgtctccattaaaaaaaaaacaaaaacaacttagtcggtccccagataattttagtgtacagcaaaacaacaaaaacaacaacaacaaacttagctaggtgtggtggcatgtgtctatagtcccagctactctggaggctggggtgggaggatcactggagcccaggagttcaaggctccagtgatatgattgtgccactgcacttcagccttgctgaaagagccagacctgctcacccctgcaaaaaaaaaaaaaaggggtaataaagcacactgatacatataggggatcatattcatcatactcatctaccattttagagctcctaggccagtctttaaatgcagaccttatggtgaactattttggatgtcattaacattttaaggttgaaagtcaacacaattactttcgtgattctttttccttttttttttttttttttagagatgagatcatgttctgtcagcagtgggggagatcatagctcactgcagccttgaacttctggcctcaagtgatcctcctgcctcagcctccccagtagttcagactgtgtatgtgcaccatcacacctggctaacttttgtgattcttgttcttattcttttttttttttttttgagactgagtctcgctgtattcccaggctggagtacagtggcgcgatctcagctcaccacaacctccacctcccgggttcaagcaattctcctgcctcagcctcctgagtagctgggattacaggcactcccgctgcgaccagctattgtgattatttataggttaaaaaagttaatcttcttggcttgggcatgatggctcatgcctgtaatcccagcactttgggaggccgaggcagggggatcacttgaggtcaggagttcgagaccagcctggccaacatggtgaaaccctgtctctactaaaatacaaaaattagctggcatggtggcaagcgcctgtaatcccagctactcgcgaggctgagacaggagaatcacttgaatctgggaggcacaggttgcagggagccaagatcacgccactgcactccagcctgggcaacaagagtggaactccatctcaaaaaaaaaaagttaatcttactgtaaactaatattttattagtttgcatatatttaaatatgtttaaaaatttatttatgctgggtgcggtggctcatgcctgtaatcccagcactttgggaggctgaggtgggcagatcaagaggtcaggagttcgagaccagcctggccaacatggtaaaaaccccgtctctactaaaaatacaaaaattagctgggcctggtggcgggcgcctgtaatcccagctactcgggaagctgaggcaggagaatcacttgaacccgggaggcagaggttgcagtgagccgagactgcaccattgcactccagcctgggctacagcgagactgtctcaaaaaataaatttttttatttataactttcctcacttctttttatatggaaaatagtttaaaactccttttaaataatttcaggtttacagaagagttgtaaaggtagtacagactttctatatacattctgtattcattccatttctcttagcgttaacattttatataacctgatacccttatcaaaattaagaaattagcattagtggaatattattgagcaaactacagactttcctctgattttcctgtgttttccactgatgtccttttcctgttacaggatccaatccaggataccacattgcatttagatgtcacaattctttagtttcttccaataggtgacagtttcttagtctctccttccctatctttccttgacacctttaaagatgagtggtcatgcatttgtagaatggttctcattttgggttttctggtgctttctcatgattagcccgaggttatgcattttggggaaaaataccatagagatggtttacccttcttgtcacatcatatctgggaatacctgatatcaacatgactcgttactgattaacttttttttttttttttttttttgagacaaagtcttgctctgttgcccaggctggagtgcagtagcatgatcttggctcacggcaacctctgcctacccaattcaagtgatttttgtgccttagcctcccaagtagctgggaccacaggcacgtgccaccacacctaatttttgtatttttagtaaaggcagggttttgccatgttgcccaggctggtcttgaactcctggcctcatgcagtccaccggcctcatcctccgaaaatgctaggatagcaggcatgagccattgtgccttgttaactttgataacttgattaaagtgatgttctgcactgtaaagtgactgttgttctgctttttaattttacttgatagaacctagaaatgagtcaccaagtcatatccatattctgggggaagggaattaagctccaacccctgaagggaggagtatcaaagaatttgtgggcatgttaaaattcctaaagtaattagttaatattttggggaagataactgtgaggttatacagaatctgatttctccttaaaaatttcctctacttattttagcattcattagtgaatcttgcctgcggcagcgttgattatattattctgttggttttctatttttctaattctttctacttttatgatttggaatccttttgtaaggaagatttatgcctcccccatttatttattaaatcatttatgtcaacatggacccatgaatatttttttctttgcttataatccagtactgtattttgttgctcaagttgttccagctttggccattctaacattggcacctatgttcttttgaaatacctttccctacctttctttgtcttttagcacttttgtacttcctggcactgtaagatgccccagtctcatcttgtactttacctgccccaaccctaaaatcagccatttctccaaggtgtcctggttccttctgttggagaagagtatttggaaaccactatctggtttctaaatgagcttgatgcactcattactgctagggtatcactgcttctaggccctctcaggggatagttaggaagtaatatatatatatactgacccacacatatcttcgtttacttccgtatctgtctgtatataaatataaacatgagtttatactgatatctctgatgctgatccagcaccacagagttcattctagcattctcttccttgcttctttctctgaaagtgagaaatttggctgatttaatgaataatacatgctaattttttcaactctaatatatatatgaagtaaaaaatagtcttaattgtcatataaagtaaatttccaaagcattttgcagttgttaactaatttaaattatactcctataatattggtattttaaattactgtttttcagctcaggtagagagatgaaatcatttacccttggccaaacaggaagtgagtgattgtatctagaattgaagatttattatttatttatttatttatttattttatttatttattttttttgagatggagtctcgctgtttcccaggctggagttcagtggcgcaatctcggctcactgcaagctgcgcctccggggttcacaccattctcctgcctcagcctcctgagtagctgggactacaggcgcctgccaccactcccggctaatgttttttctgttttttgagatggagtctcgctctgtcgcctgggctggagtgcagtggcatgatctcggctcactgaaagctctgcctcccgggttcacgccattctcctgcctcagcctctttagtagctgggaatacaggagcccgccaccacgcctggctaattttttgtatttttagtagagacggggtttcaccgtgttagccaggatggtctctatctcctgacttcgtgatctgcccaccttggcctcccaaagtgctcggattacaggcgtgagccagggcgcccggccaactggctaattttttgtatttttttagtagagacagagtttccccatgttagccaggatggtctcgatctcctgacctcgtgatccgcctgcctcagcctcccaaagtgctgggattacaggcttgagccactgcacccggcctatttatttattttttaagagacagagtcttgctatgttgctcaggccggtcttgaattcctggcctcaagcaatcctcctacctcagcctcccaaagttctgggattataggtgtgagccactgttcctggccaaatgacctattctcactcccagtgctatacttgatcctaaggaaagcagtctcattatcttgactaacaaatcaacctttgtcttcttgatgggattgttccttttaattaaagaagttcctggtatttagcttttttaaaaaaaatactttcagcagtattgagagcaaaaacaattctttttctggacttcttcctcctcgtagaatcatagaagagatttagagataatctagacaaatgtttcacataataggtgattcctccagttctctatgcaggtatttcccaagataagtacttcacagctggttgctaccaattccaggtttgcagatttgtcattttagaaagattttccggataatgattgtagatctgcctccctgcagtttctcttcagtggtcctaatttttctgtctacagttattccctgtagctctaatctcaactttgcacctattcaatgacagttattttgtcccacctttttcttttccacactagtggcttttcccccagctacctctcgtgaaatgtgctttctaagccttttattattgtcagaagacaaagttacaacaaatttatttatagatttttttttttttttgagacggagtctcactcttttgcccaggccggagtgtagtggcactatctcggctcactgcaagctccgcctcccgggttcacgccatgctcctgcctcagcctcccgagtagctgggactacaagtacctgccaccgtgcccagctaattttttgtattattagtagagacggtgtttcactttgttagccaggatgctctcgatctcctgacctcttgatccgcccgccttggcctcccaaagtgctgggattacaggtgtgagccaccgcacccggctttttttttctttttaagatggagtcttgctgtgtcacccaggctggaatgcagtggtgtgatctcggctcactgcaacctctgcctcctgggttcaggcgatcctcctgcctcagcctcccaagtagttgggagtacaggtgcacaccaccaggccccagctaatttttgtatttttagtagagatggggttttgccatattgaccaggctggtcttgaactcctgacctcaagtgatgcgcccaccttggcctgccaaagtgctgggattacagacgtgagccactgcacccagctccagccttgaaattcttaatcagatataggttgagtatccattatttgaaatatgagaccagaattgttcatattttggattttttggattttggaatatctgtagtatacagatattccaaaatgctctctagtgagcatttcctttgacatcaaaaagtattagattttggagcatttcagatttcggatttttgtgtgttttttgagacagggtctcgctctgttgccagagtttagtggcataatcacagctcacttcagccttgaacttctgggctcaggtgatcctcctgcctcagcctcttgagtagctggaattataggcacgtgccaccatgcccagccaatttttgtattgtttgtagagacagcgtttcaccatgttgcccaggctggtctcaaactcctaggctcaagtgatcttttcacctcagcctcctaacatgctgaggatttcatgcatgagccactacacccagcccaggattgagatttttggatttgggatgctcagcatataattcacttgggttagcccactttctcttttaggaatagaaatccactagtaggactctggagagctctcagtcattttcttatgggaagaacatatttttattgaaataatttgaatttgggtagtgagtgtgttgctttgggtgacaagtgatttctcagtttaggaaggattgggagcagagaaagtgggggataaggcagatttacaggcttagttctctacatatcagctcaagtttcacctttagaaggtcattcacggcccctttctaccctactctttgatgttttccccaatgtatatctttgggcatatgtcattccacatttaaaaaagttgatacataattcacatatcgtaaaactcaccattttaaagcatacaatttggggtaggcatggtagctcatgcctgtaatcccagcagtttgggaggctgaggtgggaggattgcttgagcccaggagtttgagaccagcatgggcaacatagcatggcaaccctgtctctaccaaaaaaaaaaaaaaaaaaaaaattagccaggcatggtggtgcacacctgtagtcccagactcttgggaggctgaggtgggaggatcattcacttgagccaaagaatttgagattgcagtgagccatgatcgtgcactctagcctgggccacagagcaagaccctgtcaaaacaaaacaaaacaaaatcatagaattcagtggtttttggtgtattcacaatgttgtgcaactaccaccattatctaagtccagaacattttcattacccccaaaagaaacctcatacccgttagcagtctcttccattcccttcattcacccagcctctggcaaccactaatcatcttcctgtctgttctggacattccatattaatggaatcatacaataaatggcctttctgtgtttggcttctttcatttagcataatgcttttaggttcatccatgttgtagcatgtatcatttcattcatttttatggctgaataatattacattacatggatataatgcattttgtttatgcattcatccattgatgaacatttgggttgcattttttagctattatgaataatgctctgtgaagattgatatgcttttatatggacatttatttttgtctaaatacctagaaggagaattgcttggttatgtgttaattatgtttaaccttttaaaaaattatttatcgccaggcgtggtggcacatgcctgtaatcctagcattttgggaggctgaggagggtggactgcttgagcccagcaattcaagaccagcctggggcaggcaatatggtgagaccctgtctctataaaaaaaaaaaaattaaaaccagaaaattatttttttcttctctttctttctttcttttttttttttttgagactgagtttcgttcttgttgcccaggctggagtgcaatggcacgatctcagctcatggcaacctccgcctcccgggttcaagtgattcgattctcctgcctcagcctcctgagtagctgggattacaggcatgtgccaccatgcccggctaattttgtatttttagtagagtggggtttctccatgttggtgaggctgggctcgaactcccaacctcaggtgatctgcccacctccgcctcccaaagtgctgggattacaggcgtgagccaccgtgcctggctttcttttcttttttgagacaagatcttgctctgtcactcaggctagagtgcagtgatgcgatcatgattcactgcagccttgacctccagggctcaggtgattcttccacctcagccttctggatagctggcattgtaggtgtgtgccaccacacctggataattaaaaaaaacaattttaattagagatggggtctccttatattgcccagtgaactcctgggctgaagcaatcctcttgcttggccacccaaagtgctgggattacaggtgtgagccaccatgcctgactgatagtatcttttgaaacacaaaagttttaaattttgatgaagtccagtttatctagttttttcttggttgcttgtgctataggtgtcacatctaagaaacgattgcctaatttaaggtgataaagatttctcttttgtttgtttttttcattcgtttgttctttcgttcgttcgttctttcttctttccgagacagggtctctgtcttttgtccaggctggagtgcagtggcatgatatctgcccactgcagcctccacctctcaggctcaagctatccttccacctcagtctcctgagtaggtaggactacaggtgtgcaccatgatgcttggctaattttggtaacctttttttttttttttttaagatgtagtctcgttctgtcacccaggctggagtgcagtggtgcgatctctgctcactgtaagctccacctcccgggttcatgccattctcctgcctcagcctcccaagtagctgggactacaggtgcccaccaccatgcccggctaattttttttttttgtatttttagtagagatgaagtttcaccatgttagccagaatggtcttgatctcctgacctcatgatctgcccacctcgggctcccaaagtgctaggattacaggcgtgagccactgcgcccggctgagatgtggtcttactatgttgtccaggctgatctcgaactcctgggctcaagtgatccgctttccttgcctcccaaaatgctgggattataggtgtaatttatgtttctttaaataattttatagttttagctgttgtatttagttttttttttatcaatttcaaattaatttttatacatgatgtgtgaggtaggaatccaaaatctttttctttgtttcttttttttttttttttttgagatggagtttcactctgtcgcccaggctgaagtgcaatgacgtgatctcggctcactgcagcctccacctcccgggttcaagcgattctcctgcctcagcctcccaagtagctgggattacaggtgcccgctaccacacccagctaatttttgtatttttagtagagactggggtttcaccatgttggccaggctggtctcgaactcctgacctcgggtgattcacctgctttagcctcccaaagtgctgggattacaggcgtgaaccactgcgcccggcccaaaatctttttcatttgttttttttggtgtgtggatatctagttgtccttgaaccagttgttgaaaagacttctttttccattgaattgtgtatcatcttagcatccatgttttgagtcaattgaccacagaggtgtgggcttatttctggactttctttttttttgagacagtcttgctccgttgcccaggctggagtgcagtggcgtgatcgcagctcactgtaacctctctgccttccaggttcaagcaattctcctgcctctgcgtcttgagtagctgggattacaggcatgcaccaccacacccagctaatttttatatttttggtagagacggggtttcaccattttggtcagacgggtcttgaactcctgacctcaagtgatccgcctgactcggcctcccaaagttctgggattacaggtgtgagccaccgtgcccggcctggactttcaattctattgcattggtgtacgtctatgccagtaccatcatgcttgctttcttgtattttcaccctgtggtactactatctgctactatctgcataaatatgctgtcttgattaatgtacttttgtaatatgttttgaaattaggaagtgtgagttttctaattttgtttttttgaagattgttttggctattctggatccttggcatttccatttgagctttaggattaacttggcaacttttgcagaaaaggcagttggaattttgatagggaatgccttaaatctgtagatcaatttagagagtgctgccatcttaacaatgtcagatcttccacttcatgaacgtgggatgcctttccatttgtttatgtctttaatttctttcaagaatattttttaagctgagtgtggtggtggctgacacctgtaatcccagcactttgggaggctgaggtgagaagattgcttgagcccaggagttcgagaccagtctggccgacatatcacacacacacacacacacacacacacacacacacacacacacacacacaattagctggatgtggtggcttgcccctgtaatcctagctactcatcagggtgaggataaggtgggaggatcccttcagcccaggacgtcgatctgtgatcctgccattgcaatccagcatgggcaacagagtgagcctctgtctcaaaaaaaaaaaaaaaaaaaaaagtgtgtgtatatatatatataatgtattttgtagtttttttttcttttattattatacttacaagttctagggtacatgggcacaatgtgcaggtttgttacatatgtatacatgtgccatgttggtgtgctgcacccattaactcatcatttacattaggtataactcctaatgctttccctcccccctccccccaccccatgacaggccctagtgtgtgacgttccccaccctgtgtccaggtgttctcattgttcaattcccacctatgagtgagaacatgcggtgtttggttttctgtccttgtgatagtttgctcagaatgatggtttccagcttcatccatgtccctacaaaggacatgaactcatccttttttatggctgcatagtgttccatggtgtatatgtgccacattttcttagtccagtctatcattgatggacatttgggttggttccaagtctttgctattgtgaatagtgccgcagtaaacatacatgtgcatgtgtctttaaaagacacatgatttataatcttttgggtatatgcccagtaatgggatcgctgggtcaaatggtatttctagttctagatccttgaggaatcgccacactgtagtccacaatggttgaactagttttacagtcccaccaacagtgtaaaagagttcctatttctccacatcctctccagctattttgtagtttttagtgtacaagtcttttactttaaatttattccttagtattttattccttttgatgctattgaaaatggaattattttcttatttcattttgtgttgttgattgctggtatagagaaataaaagatttttatagatctggtattctgtggccttgctgaactttttttttcttcttttttttttttgaaatggagttttgcttttatcacccaaactggagtgcaatggagcgatctcggctctccgcaacctccgcctcctgggttcaagcgattctcctgcctcagcctcccaagtagctgtgattacaggcatgtgccaccatgcctggctaattttgtatttttagtagagtcggggtttctccatcttggtcaggctgatctcatactcccgacctcaggtgatcccacccgcctcagcttccctaagtgctgggattacaggtgtgagccaccgcacccggctgaacttgtttactaatgctaatttgtgtgtgtgtgtgtgtgtgtgtgtgtgtgtgtgtgtgtgtgtgtgtgtgtgtattcctttggatttccatattgttttaaaattatgattattttttgagatggagcctctctgttgcccaggctggagtgcagtggcacaatctctgctcactgtaacctctgcttcccaggttcaaatgattctcctgcctcagcctcctgagtaggtgggattacgggcatgtgccaccatttttagtagacagggtttcaccatgttggccaggctcgtctccaactcctgacctcaagtgatccaccagcttcagcctcccaaagtgctgggattacaggcgtgagccactgcacttggcctaaaattaaatatatcttgtcactggcctgagagtcccttgaagtcagagaccatacttcatttcttgtttctctttctctactggcaaatgtatgttcaattgatgctgcagtcaggtgctacagtagtgggacttagcggagcataatgccactaatgacttggaaaatggcacagaagggaagtgggatattgtaaaactatttttacctattataaaatgcttcctgaggtccaggaaaggcaattctcacgtttgtctctgctcttctataccttttgcccctaattatcctttgtttctggaactcagaatactaaggatcataaagttaggcatttaagaataggaacattaatttgattttatatattatttccctagggaaatgtgttctggcctcattaaaaaaatagttttttcatgaatttataatttatttttttgggacagagtctcactctgttgcccaggctggagtgcagtggcgccttcttggctcactgcagcctctgcttcctgggttcaagtgattctcctgtctcaccctcccaagtagctgggactacaggcacacgctgccacacccaggtaatttttgtagagacgcagttttgccatgttggccaggctggtcttgtgaatgcctgacctcaagtgatccgcccacctcggcctcccaaagtgctgggattacaggcatgagccagcgtgcctggccaaatttattattagtagtagtagtagtatttttgagatggagtttccatcccaggctggagtgaagtgacatgatcttggctcactgcaacttccgcctcctgggttcaagtgattctcctgcatcagcctcccgagtagctgggattataggcgcatgtcaccatgcctggctaatgtttatgtttttagtagccaggctggtctcgaactcctgacctcaagcgatccacctgcctgggcctcccaaaatgctagggttacagacgtgagccactgctcctggcctcattaatttatttatttttattttttatttttttgagaccaagtctaactctgttgcctaggctggagtgaagtggcgcgatcttggctcgctgcaacctctgcctcctgggttcaagcaattctcctgctttagcctcccgagtatctgggactacaggtacgcaccaccacaccctgctaatggggtttcaccacattagcccagccagtctcgagctcctgacctctagtgatctacctgccttggcctcccaaagtgctggagttacaggtgtgagcgactgcacccggctacttttttcatgaatttagaagtatttatcgtaatgattggctatgttcattgttaattctgtgttcagattttttctcttttctttttttcttgagatgggtctcagtccattgcccaggctctggagtgtggtttggcatcatggctcattgcagccttgaccttctggtttcaggtgatcctcccaacttcagccttatgggtatctgggactgcaggcgtgtgccaccacacctggctgattttttttggtattttttttgtagagacagggtttcactatgttgcccaggctggtctcgaactcctgagctcgagcgatctgcccatcttggcctcccagagttctgggattacagctgtgagccaccgtgcctggccctcagatttcttcttgagtaaactcaagcttacttattttcctttccctcttattcactaagttacagagacatgggggtaacaaaccatttgcagttaaagggcagtatctgacccatttgtttgttatatttttgtctgccctttattacgagacatggagaaatgctttttaaaagcacactgtacttcaaaaaggggtagttcctttttacttcattttatttatttttttgagacaaggtcccactctgtcacccaggctggagtgcagtggtgtgatcactgctccctgtagccttgacctcccaggctccagtgatcctcctgccttagcctaccaagttgataggactacaggcgctcaccaccatatggacctggacctggctaagtttttgcttttttttttttttttcctgtagagacgagatctcactatgttgcccaggctggtctcttaactcctggcctcaagtgatcctcctgtctctgcctcccaaagtgctgggattacaggtgtgagccaccacacctggcccacagttcccttttaataagaaaatactaaaaatttttttaaaagaatgtattggtgggtccacacttccaacctgttctacaaaaacacaaaatagggccaggtacagtggtttacacctggaatcccagcacttcggataccaaggatgggaggattgcttgaggccaggagttcaagaccagcctaagcagcatagtgagaccccatttgtacaaaaagtaaaaaattaaaaaaaactcagaacagataaagaagatgaaattaccacaaagaaagcaaaaaaggccaagagtaaaattaaaattgaagaagatggagaagaaggaaaagtagtagtggtagaagaagaggtctctgtgaagaagaagaaggataaaaagaaaccgtggttgggcatggtggctcacacttgtaatcccagcactttgggaggctgaggtgggaggatcacttgaggccaggagttcaaaacaagcctggttaagtagcacctgaggagggagaaaaaaaaagaaaaaagagactatcctggccaacatagcaagaccccatctctgaaaaaaaaaaagttaaaaaaaattatctagccatggtggtgtctgtagtcccagctactcagcaggctaaggcaggaggcttacttgagcccaggagtttgaggttacagtgagctatgatcgtgccactacattctagcctgggtaatggagtgagaccctgtctcagaaaaaaaattttttttcactaatattgctagtttaataggttaaaaaaagggataatctcacacttttaatcacatctgattttcttaaaacaataacatcagtattgcatggtcatatatctgataattaaaggtaagtttgggtcaccgataatgaggttctctgatatagccagttgctttagtactcaaccaatttagtatgttccattttagcaagttctcttgggctgagtatattttaagagtgtcagtggctacccagacagttgttctttatcaagctaaaataagataacaataatagggacaaaaaaatgtttgaaagatattctgaataactttgtgtgctcagtatagctgagacttgctgagatgcttcagaggcaaaccagtcagcctatttcatcagccagaggtggggtgcctttcaacagtgtgttgtctaaaagtctaaggtagacttgcccaaattaacaaactttgcaattatcagtgacaggcaactatagtatggcagtaatagcactggactgagtgtcaaaagaccaaggttcaggtttcatctgtaccacataataactgtgaggtctggggcagatcagtctatctgtttccttatttataaaatcaaggttgtgagaattaagggcttcgtgactgggatgggtgaccttcagaatgctagtaagacactgtctagtgatacaaatcagaaaataatttttgtgtatatggaattggtgaagcattgatgttttcaatggaaattacattccctgtaagtttcattgggttatatagatggcaaattggctgtgaaatatgaaactcatggacttactggaaccactttgagtcccagaataattctgccttctcctaaggtcatttactaagttgtagctgagtcagaatttgaactttaatctctagcattctttctactgtgttcaatttaataccacggatatttatataccttctaggtgcatacactgtggtaagtgctgtaggtgattttttaaaaagtaaaatagaagaaacaatacacactgactttaaaacactgactttattattaaaagtgtcatgatacacactgtaaatgctatacatattgtgcataggtatgaatgactaagtggatttaaatgaatgtcttaggagcctggcatggtgaactgtacccatagtcccagcttctttgagacggacgctctgttgcccaggctggagtgcagtggtgcgatcttggctcactgcaacctccacttcctgggttcaagcgattctcctgcctctgccttccgagtagctgggattacaggcgcctgccaccacacctggctaattttttgtatttttagtagagatgggatttcaccgtgttggccgggctggtctggaactcctcgtgatccgcccgccttggcctccctaagggctgggattacaggcgtgagccaccacacctggccagtcccagcttcttgagaagcagaggcgggagaatcacttgagccttggagttcaagtacaacctggacaacatagtgagatcctacctctaaaatataaataaataaaataaatgccttaaggagatcatggtgctttgttgaattgactcacagccaaggattcagttaattttcattagtttttaattagtagagctggatgtttattacttaaatattcctttttttttttttttttttgagacagaatcttgctctgttacccaggttggagtgcagtggcacgatcttggctcattgcagcctctgcctcctgggctcaaatgatcttcccacctcagcctcctgagtagctgggattacaggtgtgtggcaccatgcctggctaatttttgtattttttgtatagatggggtttcaccatgttgtccaggctagtcttgaactcctgagctcaagtgatctgcctacctcagcctcccaaagtgctgggattacaggtatgagccatcacacctggtccttaaatattatttaaaatagtttttaaaaaaatgcttctctgggccagttgcagtggctcacgcctgtaatcccagcactttgggaggccaaggcaggtggattgcttgaggccaggagttcaaaaccagccttgccaacagggcaaaaccccatctctactaaaaatacagaaatcagccggccatggtggtgcatgcctataatcccagctactcgggaggctaaggcaggagaatcgcttgaacccaggaagcagaggttgcagtgagccgagattgtgccaccgcactccagcctgggtggcagagtgagactctgtctggggatttaaaaaaaaaaaaaaaaaaggtttctcttgttaactttgagacagtaacggggaggtggtattattcaggtagtcagaagcataaatgcccagaccgcctctatatttttaaacctaagaaagtgaaacccctgtctctacaaaacatgtaaaaattagctgtgcactgtggcttgtgcctgtagtcctagctactctgggaggctcaggtggtagaattacatgagcccagcagatagaggctgcagtaagccatgattgcaccactgcaatccagcttggcgcaatcacgccaaaaaaaatttaaaaatataaatgaaaatacaggggaacataatattccagacctttagtattgtgttgaggtttttttttcccctctactgtaaaatgagagtgttcagttttaagaggcacattttcggagcatggatagagtctttccaggagaaaacagtctgtctggtgatggagtaattaaaatgatttgagacattatttaaggaattagaggctgggcgcggtggctcacgcttgtgatctcagcactttgggaggctaaggtgggcggattaccaggtcagaagatcgagaccatcctggctagcatggtgaaaccccatctctactgaaaatacaaaaaattagccgggcgtggtgatgggcgcttgtggtcccagctgctcaggaggctgaggcaggagaatggtgtgaacctgggaggcggagcttgcagtgagccgagatcgtaccactgctctccagcctgggcgacagagcgagactccgtctcaaaaaaaaaaaaaaaaaaaaaaaaaaaaaaaaaaaaggaattagagatgtttcatttagagaataaagaggtggggacagctattttcaaatacagttgtccctcggtattcatgggagattggttctcagacctcctgcagataagaaaatctgaggatgataaggtcccatatataaaatgatgtacctctgcatgtcctgcgatatacttggcgcacgcctgtaatcccagctacttaggaggttcaggcacgagaatcacttgaacccgggtagcagaggttgcagtgagcggagattgcgcctctgcactccagcctgggaggcagagtgaaactgtgtctcaaaaaataaaataaaataaaaaatatatatatgtgatggctgaatccaaggatgtggaacctgtggctttggagggctaactatatatcaaagatctggcaagtggaataggcattagatttagtattttgttgctttgacaaaagaacaaggaccatcaagtagaagttaaagagaaaaatggaatgtaactttcttataagatagtgagtttcctcatgttaaagtaagatactgagtttaacttatgttaaaacagagccagggtatttagagatactggggaggaagttaagttgaatgacctttaatgtttttgtaaataaatggttcttaatttcatgagtatatatccccttgagaatctaaccaacagcaaagaccctgtccccagaaaacttctacggatatactatataggtatatattttctttcatccttgaaaactacttttttggggggcatagtattgtatgtttgtttgtatgtttattagtattgcattttattttctttcagtttattgaatttatcgtttctttttttgttgtttttgtagagatggggtcttactatgttgcccatgcttgtctcaaactcctggactcaagcaatcctcccacctcagccttccaaagtgctggaattacaggtgtgagccaccctgtccagccttgaacttatcattccattatcttctggcttacattgttgcttgagaagttagccttggtgttaatatctgtcaggtactctgtggcatcactagttttttatttcctcaaactgcatgacttgacagtcattggcttatccagattataagaaactaagatgccagtgcatacagggattcctcgtggctatgatttctcaggaattttttattcttttgatttgctcaacaccaaggcaggcttctatatagtccgctagggatagtgaaaaatttggggcttggtttagattggagaggtatatggtggggtgtcttataaggcttaactttgggagggcccagggccttgatttctgtcccccttgccttgtgtggcctttgaattgaaagctttggattaggccttcatagattttagtgtgcatacaaatcacatgatctttttataaggcagattctgattctgaaggtttagtgtgggacccaagattttgcatttctgatctataaggtgatgctaatcctgttggtctacagatgacactttaagttgtaaggagttagattgctatgtttgagatgtgagtggtattagtaatgttagtcatggttatgaggtggtacagtagtatataaagaatgaagatcattccattgtgcagaggttcttttttaaaattaatagacttttcttttttttaagagacagtgtcttgctttgttacccaagttggagtgcagtggcacgatcataactcactgcagcctggaacttctgggttcaagcagtcctcctgcctcagcctccacagtagatgggactacacgtgcacactaccaaggctggcaattttttttctttttttgtagagatgggtactttctatatagtggagctgaaaatttttcattgcctagtgatgtaatgcttggcataacaccttagtttttctgtttttagatatgtttagatacacagatgcttaccattgtgttacaactgcctgcagtattcagtagttacatgctgtacaggtttgtagcctaggagcaacagattataccatatagcctagatgtgtagcaggctgtaccatctaggtttgtttagtacactctatgacagttgcacaatgatgaagtcacctaacacatttcttagaatgtattcccattgttaagtgatgcatgactgtctaattgtaaccacccaacggggtcaccttgcccgctggctcaacagaacctatttatcaagatgggaattacagtagagaaagagtaattcaagcagaactgactgtgtgggagaccagagttttattattacttaaatcagtctgtccgagaatttgtgaattggagttttaaaggataattttgtgggtaggggaccagtgagtcaggagttctgattgattgggttggagatgaaatcataggtagttgaagctgtcctcttgtgctgagtcagttcctgggtgggggccacaagacaagataggccagtttatatcagtctgggtggtgccagctaatccattgaatatagggtctgcaaaatatctcaaacacgatcttgggttttacaataatgatgttatccccaggagtaatttagggaggtttagaatcttgcagcctctagctgcatgactcctaaaccatgatttctaatcttgttagaatttgttagtcctgcaaaggcagtctagtccccagccaggaagggggtttgttctgggaaaactaacctaaactgtaaactaagttcctcccaaacaaagttagtttgggctaagtctaggaatgaacaaggacagctgggaggttagaagcaggatggagttggttagatcagatctctttcactgtaataattgtctcagttataatttttgcaaagatggtttcataataatatgtatatggaatagtttcactgccctaaaaatcccctgtactccacctatttatccctacttcttccccttaactactgtaaccactaatatctttctgtcttcatagttttgcctttttcacaatgtcgtatagttagaattatacagtatatagcctttcagattggcttttttttcacctagcaatatgcatttgaggtttctcaatgtctttttgtggcttgatggctcatttctttttattgctgaatagtattccattgtctgggtacactacaatttgcttatccattcacctattaaaggcatcctagttggttccaagttttggcaattgtgaataaagctactataaatgtccacatgtaggtttttgtgttgacatgagttttcatctttgggtaaatatcaaggagtgcaattgctggattgtgtggtgagagagtatgtttagtattgtaagaacctcccaaactgggtataactttttttttttttttttaagacacaggtctcgctatgttgttcaggctagactcatctcctgggctcaagcaatcctcttggcttagcgtcctgagtagctgggactataggtgattccagctcaccttgctggctgtaccattttgcatttccactagcaatgaatgagatttcctattgtttgacatccttgtcagcacttggtgttgtgctttggattttggccattctgatacggacacggtggcatctcattgttgtcttttttttttttaatgaatttgaagtctttttttcttattaataatttcttttaaccacggttgtcagaattattgttgtcttaattggcaattctctgatgacatatgttattgaacatcttttcgttcatatgcttatttgccattcgtatatcgttggtgaagtgtctgttcagatcttttgcctatttttaaaatggggttgttcattttctttcttttttttttttttgagacagagtttcactcttgttgcctaggctggagtgcaatggcacgatcttggctcacaacaacctcccgcctcccaggttcaagtgattctccttcctcagcctcccgagtagctgggattacaggcatgtgccaccacgcctggctaattttttgtatttttagtagagatggggtttcttcatgttggtcaggctggtctcgaactcccaacctcaggtgatctgcccgcctcagcctcccaaagtgctgggattacaggcgtgaaccaccacgcccagccacattgttcattttcttttttttaatttatttttaattttttaaatttttttattttttaaacattattttatttttaattgacagataacaattgtacatagtcatggggtacatagtgatgtttttttttttttttttttttttattgatcattcttgggtgtttctcgcagaaggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgctccgcccttaatccatttaaccctgagtggacacagcacatgtttcagagagcaccgggttgggggtaaggtcatagatcaacagcatcccaaggcagaagaatttttcttagtacagaacaaaatggagtctcctatgcccacttctctccacacagacacagcaacaatctgatttctccatcttctccccacatttcccccctttctactcgacaaaaccgccatcctcatcatggcccgttcccagtgagctgttgggtacacctcccagacggggtggcggtcaggcagaggggctcctcacttcccagaaggggcggctgggcagaggtgccccccacctcccggacggggtggcggccgggcggaggcgccccccacctcccggacggggtggctggccgggcgggggctgccccccacctccctcccggatggggcggctggccgggtgggggctgccccccacctccctcccggacggggcggctggccgggcgggggctgccccccacctcccggactgggcggctgccgggtggagacgctcctcacttcccagacggggcggctgccgggcagaggggctcctcacatcccagacgatgggcggccaggcagagacgctcctcacttcccagacggggtggcggccgggcagaggctgcaatcttggcactttgggaggccaaggcaggcggctgggaggtggaggttgtagctagctgagatcacgccactgcactccagcctgggcaacattgagcactgagtgaacgagactccatctgcaatcccggcacctcaggaggcctaggctggcagatcactcgcagttaggagctggagaccagcccggccaacaggcgaaaccccgtctccaccaaaaaaatacgaaaaccggtcaggcgtggcggcgcgtgcctgcaatcgcaggcactcggcaggctgagggaggagaatcaggcagggaggttgcagtgagcagagatggcagcagtacagtccagcttcggctcggcatcagagggagaccgtggaaagagagggagagggagagggggagggggagggggaggtgttcattttcatattaaattttaagagctctttgggtccaggcgcggtggctcacgcctgtaatcccagcactttggaaggccgaggtgggtggattacgaggtcaggagattgaaaccatcctggctaatgtggtaaaaccccatctctactaaaaatacaaaaaaattagccgggcgtggtggcgggtacctgtagtcccagctacttgggaggctgaggcaggagaatggcgtgtacttgggagacggagcttgcagtgagccgagatcgcaccactgtcctccagcctgggcgacagtgagactccgtctcaaaaataaaaaaagttatttgtatattttgtttcgtttttaattttttatttattttgagattgggttgtaagactggctacattttttttgtattattattatttttttttttgtagagacagggtttcgacacgttgcccaggctggtcttgaactcctgggctcctgtgatccatctccctcggcctcccaaagtgctgggattataggcgtgagccactgcgcctggcctctgtatattttggataccagttctttgtcagagatgtgttttgcaaatattttctcccaatctgttgagtttctattctcttagcagtgtattttgcagatcagaatttttaacttcagtaaagtccagcttatcagttttttctttcctacatcatgtttttggggttgtatctaagaagtcattgccaaaccctaggtcacctagattttcttctatgttatcctctaggagttttatagtttcgtatcttacatttaggtctataatccatttttttttaatgatccatcaatcttttaatcttccacagttttggtgggttctcttggactttattctgtagcagttcatgaccatgtaccatttacaggcatgagtgataaacttcatagtggctgagaaagatcaacagaatgagttgccttgtccaaaggaaatatgtcagtgacatatgagtgactgagtttttactaattgagattacatccaggtaccttttggtgatgaaactgtttattgtttgttgcagagttctactgcagactaacaattcctgaacccatttaataacccatgtatattaaatgtgatatgattgggattttaaaggccagaggtttaagagagagatgttcaaaagtttttttttttttttgagacagagtctcactctgtggcccaggccagagtgcagtggcacaatctcagcccactgcatcctccaggttcaagcaattctcctgcctcagcctcctgagttgctgggattacaggtgtgtaccaccaagccggctaattttttgtattttagtagagatggggtttcaccatgttgcccccagggtggtctcgaactcccgagctcaggcaatccgcctgcctcagcatcccaaagtgctaggattacaggcgtgagccacccgcttcagcctcccaaaatgctaggattacaggtgtgagccactgcacccagcccaaaagttgttgaattctcaaataattaagatttcatgtgttcatatggaccataaaggatcaaaataagtatggcttgccattattgtaatgttgctatcctgagtaggtcttttttttttttttttttttttttttgagatggagtcttgctctgttgcccaagctggagtgcagtggcacgatctcggctcactgtaacctccacctcccaggctcaagtgattctcatgcctcagcctcccaggtagctgggactacaggcgcacgccaccatgcctggctaattttttgtattttagtagaaacggggtttcaccatgttgcccagggtggtctcgaaccactgagctcaggcaatctccccaccttggcctcccaaagtgttgggattaaggtgtgagccactgtgcctggccctgattgggtttttatcattatctgttcagttcatgtagttttggctgttaattctgtacttgaattattcaatcacaaagtgtttttactgactgctgactctactttcactttcattacttaatgatgaaggctgtttaaaataatgttgtaatgccgggcacggtggctcacacctgtaatctcagcactttgggaggccaaggagggcagatcacctgaggtcaggagttcaagagcagcctggcccacatgatgaaacccatctctactaaaaatacaaaaattagccgggcgtggtggtgcacgcctgtaatctcagctactcggaggctgaggcagggagaatcacttgaacccaggaggtggaggttgcagtgagccgagatagtgccattgcactccagcctgggcgacagagcaagacctcatctcaaaaataaataaaataaaataaaataatattgtatctagattttcaaatcaggtgtttatgcaggaaaagacaattgttttattggttttagaaaaccaacaaaccaaagcaacaataaagattcctgtatacatttttttctttaattaatgaattacttgggtcattctggtaaaataagatgctttcttgttaccgaatgccagttttatcagatgaaaaggactgtgttcatagatgatggagataatcaccagttctgatagttactctaaaagataagacataatcctgttcagccagacctagtgaaaatcagaaataccgatgaaacttggacacgtagagtaagatttttggcttaaaacacctttgcaagtgggtgggtatgtgtagtatttatgtgtgctacttggtttctaaagactccctactatatgctaatttttaaattatgtacatggtactttttaagcctcgcaggctggccagccggcctactggcctccctccctctctccgtacaataaattagccaaaataatgaggtaatatctaagtcattgtagtctaggactgagtcatttttctctttgaaaaaattccagaatactttatattttcttgaaggtaacttttttgcacttgttttaaggtattgttactttatttacagccaacgaaatggaactgttaggtttgtaagcatcttatatttttgaagtgctgattgtatgttcaatctaattcaataaatatttattgtctaatatgttctaggctttggtgtaggtgcttgggatataaggatatgtaactcatagttcagccttaagtctaaatatttagtatatttgtgttttttaatttagtttttaaacacagttttttaaaataattttgagataattatagatttacattcaattgtaagaaacaataatacagagatatcccttgtacactttacccagtttcccctggtggaaatttcttgcagaatcatggtacaatatcacaaccagggtattgacattgaaacagttaacagtaaagtggtacagccactctgaaaaatagttcggcagtttgcctaggagtacagttgctaggccatatggtagtcgcatgcttacttttttttttttttcttttttttcttttttatttatttatttatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctggttacttgagattagggattggtgatgactcttaacgagcatgctgccttcaagcatctgtttaacaaagcacatcttgcaccgcccttaatccatttaactctgagtggacacagcacatgtttcagagagcacagggttgggggtaaggtcacagatcaacaggatcccaaggcagaggaatttttcttagtgcagaacaaaatgaaaagtctcccatgtctacttccttccacacagacacggcaaccatccgatctctcaatcttttccccacctttcccgcctttctattccacaaagccgccattgtcatcctggcccgttctcaatgagctagtgggcacacctcccagacggggtggtggccgggcagaggggctcctcacttcccagtaggggcggccgggcagaggcgcccctcacctcccggacggggcggctggccgggcaggggggctgaccccccccacctccctcccggacggggcggctggccgggcggggggctgaaccccccacctccctcccggacggggcggctggccgggcagaggcgcccctcacctcccggacggggtggctggccgggcaggggggctgaccccccccccacctccctcccggacgggtcggctggccgggcggggggctgacccccccacctccctcccggacggggcggctggccgggcagaggggctcctcacttcccagtaggggcggccgggcagaggcgcccctcacctcccagacggggcggctggccgggcggagggctgacccccccacctccctcccagacagggcggctggccgggcggggggctgacccccccacctccctcccggatggggcggctggcggggctgaggggctcctcacttcccagtaggggcggccgggcagaggcgcccctcacctcccagacggggcggctggccggggggagggctgaccccccccacctccctcccggacggggcggctggccaggcggggggctgacccccccacctccctcccggacggggcggctggccgggtgggggggctgacccccccatctccctcccggacggggtggctggccgggctgaggggctcctcacttcccagtaggggcggccgggcagaggcgcccctcacctcccggacggggcggctggccgggcggggggctgacccccccacctccctcccggacggcacggctggccaggcggggggctgacccccccacctccctcccggacggcatggctggcggggcgggggggctgaccccccacctccctcccggatggggcggctggccgggcggggggctgacccccccccacctccctcccggacggggtggctgccgggcggagacgctcctcacttcccagatggggtggctgctgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacgtctcagactatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcggatcactcgcggttaggggctggagaccggcccggccaacacagcgaaaccccgtctccaccaaaaccaatcaggcgtggcggcgcgggcctgcaatcgcaggcattcggcagactgaggcaggagaatcaggcagggaggttgcagtgagccgagatggcagcagtacagtccagcttcggctccgcatgagagggagaccatggggagacggagacggagacggagacggagacggagacggagacggagagggagagggagagggagactttttaaagaaactgccatttgtattgatataatatggtggaggcccaggttccccacgtggtccccgctgatcttgttactggtctgcagggatgaaattcctggataccctacttggctttctgtctccaccttggaaggggtattgagtgcttaattacagctttgagaggttggaaatctaggctccccacttggcctttgctagaacgggtaggttttaaaccacagtattttcttggtgtttggctggggtagattggttattgtctaaaacttttctgtcttgctagactgctactttcttggtcttttagctaaagaagactgacttttgttggggcttttcttttcttttttttttttggagacagagtcttgctttgtcgcccaggctggagtgcagtggtatgatcttggctcactgcaacctctgctttcaggtttcaagtgattctcgtgtctcagcctcctgagtagctgggattacaggagcccgccaccatggccagctaatttttttttttttttttttttttttttttgagatggagtcttacactgtcgcccaggttggcgtgcagtggcatgatctcggctcactgcaacctctgcctctcgagttcaagtgattctcctgcctcagcctcctgagtagctaggattacaggcgcccgccaccacacctgtaatcctagctactttattgtatttttggtagagacggggtttcactatgttggccaggctggtcttgaacttctgacctcatgatccacccaccttggcctcccaaagtgggattacaggcgtgagccaccgtgcctggcctgctccagctgattttttgtttttgttttttgttttttttgttttttgaggtagagtcttgctctctcgccaggctggagtgcaatggcgcgatctcggctcactgcgatctccgcctcctgggttcaagtgattctccttcctcagcctcctgacttgctgagactacaggtgcgtgccaccacacctaatttttgtatttttagtagagatggggtttcaccatgttggccaggatggtcttggtctcttaacctcatgatctgcctgcctcggccttccaaagttttgggatcacaggtgtgagccaccatgcctggctgggtatgtttttaaaatgacatttattttttctttttgcaaaagttttatttaatgtagataatttagaaacacaaaaattataaaagagaataacattttcatatatattcttctagacatttcctgtgaatatatatacatatttttcttgtgaaaataagaactatatatactactcatgaactttttgctcgatataagcatcattccttgttaataaatgcatgaatatagcaccaatttggtatcaatcaggttgtaatgtgcacattctggagatcatcaatatgtgttactcccctaggtcgagtgcctgagagacagatcatgtacaaataaacgacgtacattttcacatgaatctcatagttcagacatcacttatatactagagagagttagaagtaaatcagatttagtcattagttttagaaacactgggtatttgggtaggtatttagattttaaagtttaaaaataaaaaaaataaaagtgttcatgtggctttacgaatgctattttgattaaaattcttgttcatattttccataatattataagaagggtcattatacttttcagaagaacatttgagataataatggctttcttgtttgttcttggaggaaataggagatactagcagtgttgtttcaatgaaccctagcattagttttctgctggaacttgcaaaacagaaaccagaacgacttaaatcttttccatagtacagttttttctaattgctatgtggtatacttgcagatgttcagatttattgggaaatttagatttcatagcttaggatttttggtattagctattcagattgatgcatcaggtctaattaaaaattatactcaagtttattcttgtactttatgttgtctttttcttatgatgtgagtagctgcagtataactcaaaaccagtaattataaaaccacttaatgaatgaatgtagatgtaaaagcatataatatttggagttgttttagtttctgtttctttaaaggtgaaggtacatatgtcataatttgggaagctatcctttcaacttaacatggagttgaaattgaaatgtgttcttagacataaatttgagatgtgttattgaacatatttaacacgttatcagtttccatatttttccaagcagttaaccattgggtagtgcacagcaagctcattttcctcttagccgttctgtgcatcttgtggtttgagatgttcatcactgtctggctgtgaaccccaaatgtcctcctagtgatcctggaaggtattttagaatagttttggctttctgcttttgattctaatttatgagatctggagtggagtccagaatctgaattttaaaaagaatagctctattgagatacaatttataaaacatacagttcagccacttaaaatgtacagttcagtggttttcagtattttcacagttgtgcatccattaccacaatcagttttagaacattttcattactcaggcaggacgcggtggctcacaccagtaatcccagcactttgggatgctgaggcgggtagatcacttgaggccaggagttcaagaccagcccgaccgatatagcgaaaccctgtctttcctaagaatacaaaaagttagctgggtgtgatagtgcacgcctataatcccagctactcgggaggctgaggcacgagaatagcttgaaccaggacgtggaggttgcagtgagccaagatcgcgccaccgcactccagcctgggcgacagagcgagactctgtctcaaaaaacaaaaacaaaaaaacccaccctgttctccttagctactcttccacctaatccttccatttccctgcactcacaactcctagatttttatggtgtatggctctcagttggcgtaggggtagagttgtgattttgccctttaggggacatttgacagtgtctggaaacattctcatgggtcacaactgggaaggtgctattggcatgctattaaacatcttccagtttagaggacaacctctcataacaattttcttgtccaaaatttcagtagtgaaggtgttaagaaactctggaagagagttagactaaacaaattgcaagatcaaatttttagccctcacattggcagtaggatattatcttacatggtcgatttataatttatgtaaaattgttaaatgtattggggttatacagatgatagaaaaaagagtcttagggacctaagggactcagtttagtctagtctggaatagtatgatgtcctcgctgggagccatgaaccctagtctagagcctgggatgtagttgttgaatgaacatgattatgtggtggtagtttgaactaaaatgattcttagttatttcataattgatggatatctagattggtagacttcacatagctgtatagactattccctcttttaatcctcctatcttgccaaaatcaataaccataaaaaagaatgtgtagaagagtctgatttttatagtttatttcaaagaaatttaagagtctcaatggtgctataaagaaattaaagactggctgtggtttggttgacttgaaaaggatatgtgggtctgagtgtgtgtgtttaattttttaaattttcttttgtttttgttttcagagagagtcttgctctgtctcactgcagcctctgcctcccgggttcaagcagttctcctgcctcagcctcctggtagctgggattacaggtgcacaccaccacacccagctaatttttgtatttttagtagagacggggttttgccatgttgcccaggctggtcttgaactcctgacctcagatgatccatccaccttggcctcccaaagtgctgggattacaggcatgagccaccacagccagcctaagtgtgtgtgtgtgtgtgtgtgtgtgtgtgtgtgtggaaattgaatggttttcaaaggtgatttgattagcatttgcatagactgtgaatccaagatgtttgtgttcccttccctcattcttccattcttttctctgtttgtcaatttttgtaccgcgatatatgagggattaaagaaaaatcttttagaatagttttggctttctgccttttttttttttttgagatggagtttcactcttgttgcccaggctggagtgcaatggcgcgatctcagctcaccgcaacctctgcctcctgggttcaagcgattctcttgcctcagcctcccgagtagctgggattacaggcatgcgccaccatgcccagctaagttttgtagtttcagtagagatggatttcaccatgttggccaggatggtctcgatctcttgacctgtgatccgcctgcctcagcctcccaaagtgttgggattacagttgtgggccaccgcgcacgtcctctatagtttttttttttttttaagtttatgataaattgaaacaacactaagaaaatcagataatacaggaatattaaatgaaaaccgaatctttctgagaaatgaaaaatagtatctcattgtttaatttgtatttctttttagatgaaagaggctgaatttttttttcacatttattatttggatttctatgaagagtttgtgtcctggactcatttttctgttgggttgttgatagttgttctgtttgtttgtgagagcacttagtatattataaaaattaatccattgtgtagtacatgtaacacaaatattttcttctactccgttatttgccttttgactttactattttttttttttttttgagatggagtctcgctcttttgccaggctggagtgcagtagtgtcatctcggctcacttcaatctctggctcccgggttcaagcgattctcctgcctcaacctcccgagtagctgggattacaggtgtgtgccaccacgcccagctactttttgtatttttagtagagacggggtttcaccatgttggccaggctggtctcaaactcttgacctccggtgatccacccgccttggcctcccaaattgctgggattacaggtatgggccactgcacccggccaaaaatttttaatttaatttaattaatttattttttttcccagacgaagtctcactctgttgcccaagctggagtgcagtggtgcgatctcggctcactgcaacctccacctcctgggttcaagcaattctactacctcagcctcccgagtagctgggactacaggcacgcgccaccatgcccagctatttttttgtgtgtgtgtttttagtagagacagggtttcactatgttggccaggctggtctcaaactcctgacgtcgcgatccgcctgccttggcctcccaaagtgctgggattacaggcatgagccaccacacctggccttaatttaatttttactagtcaatttttttagtagacctggtctcactctgttaccctggctggagtgcagtggtgccatcattgctcactgcaacctgaactcctgggctcaagtgatcttcccacttcatcctcccaagtagctgggtctataggtatgcactatcatgcccggctgatttttgcattttttgtagagacagggtacggttatgttactcagactggtctcagactcctaggctcaaacgatcctcctgccttggcctcccaaagtgctaggattacaggtgctggatccagctggcagtttctttaaaaattaaacatgtacttaccatactacccagaaatcactcctttggttatttactccaaataaaataaaatttatgttcacttaaaaacttgtacgtaactgttcatagcagacttattcaaaacagcaaaatgtgaaccaatccaaatgttgtgtcaacaagtgtaaagcaaaacatatgacatccatagcatggaatactactgagtaatcaaaaggaacaagcaagctatagataacctgcaacaccttgaatagactacaagggtaatgtgcttagtggaaaagcttatctcaagaggtcacatattatatagttccatttatatgacattctcaaagtgacaaaactgtaaagatgaagaatagattagtgattgccaggggacaggggggtagtaggtggaggggctataaatacagagaggtagcagaacagttctgtatcttgattgcagttgtggttataaaaatctatacatgagacaaaactgcttagaaatacacacacaaatgcaggttaaaaaaaatagtgaaaactgaataaggtctgtagtctagttaacagttatgtatcagtgtcataatgtttgagaccagcctgggcaacatagtgagatcctgtctctacaaaaaaatttaaaaaattagcccagtgtggcggcatgcacctgtggtctcagctactctggaggctgaggtgggagatcacttgagtcctggaggttgaggatgcagtgagccttggcgctgccactgcactctagcctgagtgacagagtgaagactttgtctcaaaaaaaaaaaaaaaaaaaaaaaaaaaagataattgagatctggatctacctgatgataaagtgtgtgttccttgcacagtaccatccagtcttgcctggtaattcctttcaggcctttacttggttcttaaatactagatgttgccaaataagtgatgctacttttactaggtgtggttaggaggcacagcatccaaagcaaggacatgagattgtaatacaaggaaggtgatgacttgctccattgtctgtggctttcttatgttgtaatgggagcttatcagtgtgcaccatgatcaggttacagcatcaggaggagctctacaacctattttagattcacagttaatattgtctgcttttttctttgttcttgtcattttcttttctcttttgtactttctctttctctctctctttttaaaagatgggagtctagatacattgcccagtacagtggctgttcacaggcataatcatagctcattgcagccttgaactcctggactcaagcaatcctttctgtctcagccttccaagtagatggaactataggctgtgtgtcactgtgccaaacatctctctctgtctctttattttttaagtgatagagaaccacaaatgtgttttttaaagaaccagcattttttcaaataccaaatatttgtgtagctgatgatgaggcatcactaggagtttccttttgttgacaaattcaagagagacatcattccaaatgaaattttattccgaaagtgaattttgtgaaaaccagtgctaagaaaataacaaaatgaacgaacaccaaaacacccatgtgtttacaaggaaacaagaaaacatggagttaaagtaagtaattgtgtctacttgacagatgttgggttttctttccctcttggactattgtgtttcctcaatttgtaggtttcatgtcatctttttaaaatagtagccgtcttttgactccttataagttatgttgggccaggccaccttaccacatgaattccctccccactttgcttggtatttgataccctgctttcagccaccatggcttcctccccacccctaaacgaagactctgattttgctctgcttgctctaccctacctgatggctttaggctaaattgtttatgctgaccggagtcagattttatttttagagagataattctggtgaccatatggagaactgggtgagagactgtcagtgttcagttgagtctagtgcagaatctaggtgaggggtttgaaccaaagtacatggggatggataaggaagactaagcactctacagacgatgatgataatatgataaattatataggttataatttactgaacacttgccatccctcataacaacttcatgattgaaggccttaacatttttatttatttatttatttatttatttatttatttatttttgagacggagtctcactctgttgcccaggctggagtgcagtggtgtggtctcggcttactgcaagctccgcctcctgggttcacgccattctcctgcctcagcctcccgagtagctgggactacaggcgcctgccaccacgcccggctcattttttgtatttttagtagagacggggtttaaccgtgttaaccaggatggtctcgatctcctgacctcgtgatccacccgcctcagcctcccaaagtgctgggattacaggcgtgagccaccgcgcccggctaacatttttattttatagatgagtaaacagtcatggagagattacataccttgcccaaatttacctagctcaacagaggaaaagaaaggataggaattcaggtggtctgattttagaacctgtgcttttgaccattatactagctgggggctttatttttctaactgttagaagtgttcaacaatgaaagagccaccctgtgaagtaatgtgggcatcacttgaaatggtcaggcaggaagtagacgggtcattaatactacatcaagggtccacatacacactgtggctagattactgtgaagaaggcttttaagttctgtgattttgtgatgtgatatacagggagttgttgctttatgtggttctcatatacactttcacttaccatggtttggttaaataataccaattccctaataacatggtttaaattttacacagcatattaactgtgaataatcgtataaagtacaaaattcgctgccagctcttctgtcactacataagtaacaactgtgcaaagcatgggtttgtgttacctccttgtctcccagtgataaatctatgtgatagttaagaaaaatcgataaccgatagagagaattggccgaaaaagatgaaagttcaggaaaaaaccaaaaagtaacaacagtggaagtgaaattcaaattgaactcaaatggagttatagaagaaatagatcactgagggaatgctgatgctctcattcaaaacactctggatatgtagccgaaataacttagtgaaggtgagcttatctacataagtgaagaaagtggtttggtaaaaaaaaaaaaaaaaaaaagaagtgatgcaagaaattttgtagtgaaagaactctcgaaggtattctgtgatattgaaatatgaaacataaagtatttgatgctattccagactcagacaggagtgtgacaattggctaaggcatagaaaagatgtctattgcagccgggcgcggtggcttacgcctgtaatcccagcactttgggaggccgaggcaggcggatcacaaggtcaggagatcgagaccatcctggctaacagggtgaaaccccgtctctattgtatgatgagaagaatgtaagcactatttaaactacccctaataaattttttcaaagaacttaaacattataattttcaatatttctatgttctctagtgcagtggtcctcaacctttttagcactgatttagtggaagacagtttttccatggaaggggacgctgggggaggggatgttttcgggataaaactcttccacctcagaagatcatcaggcattggattctcataaagagtgcacagtctagagccctcgcatgcacagttcacagtagggtttgtgctcttatgagaatctaatgccacgactgatgtgacaggaggcagagatgctcgcctgcccttcgctcacctcctgctttagtgcattaatgattagttttcctgttctttcaattttcctataattataactgacagagtttttaatgtttcaatgaaattttttttttttttttttttgagactgagtctcactcttgtcacccaggctggaacacagtggtgcgatctcggctcactgcaacctccgcctcctgggttcaagcgattctcctgcctcaggctccctagcagctgggattataggcatgcaccaccatgcctgactaattttttgtatttttagtagagatgggttttcaccatgttgtccaggctggtcttgaactcctgacctcaggtgatttgcctgcctcagcttcccaaagtgctgggatctcaggtgtgagacactgtgcctggcctcaacaaaaaaaaaattcttttttttgagataggatcttgctctgttgcccaggctggagtgcagtagtgtgatctcggctcactgcaacctctacctcctggattcaagcaattctcctgcctcagcctcccgagtagctgggattacaggtgctcaccaccacccctgggtaatatttattttattttttaaattattttttgagatggagtctcactgtgtcacttaggctggagtacagtggtgcagtctcagctcacgcaacctctgtagtgaacccgtcctaggttcaaacaattctcctgcctcagcctcccaagtagctgggattacaggcgtgtgccactacccctggctaatttttgtatttttagtagacatgaggtttcgccatgttggccagggtggtctcgaactcctgacctcaagtgatctgcccacctcggcctcccagtgctgggattacaggcatgagccactgtgcctggcccaaaattttttaaaaattacagagtggcggccgggcactgtggcttacgcctgtaatcccagcactttgggaggctgatgcgggtggatcacgaggtcaggagatcgagaccatcctggctaacatggtgaaaccccgtctctactaaaaatacaaaaaaattagccgggcgtggtggcgggtgcctgtagtcccagctactcgggaggctgaggcaggagaatggcatgaacctgggaggtggagcttacagtgaaccgagattgcgccactgcactccagcctgggcaacagagtgagactgtctcaaaaaacaaaaacaaaaaaaaattacagagcggctgggtgcagtggctcacgcctgtactcccagcactttgggaggcttaggtgggcagatcacgaggtcaggagatcgagaccatcctggccaacatggtgaaaccccatctctactaaaaatacaaacattagctgggtgtggtggcacgtgcctgtagtcccagctactcaggaggctgaggcaggagaatcgcttgaccccaggaagtggagattgcagtgagccaaggtcgcgccactgcaccctagactggacacagagcgagactccgtctcaattttaaaaaaaaaaagattacagagcaattgcagtttttctcattaattattatgatcactttgcatggtttcagcgtgcattcttacttttacggttttgcactattgtgtaaaatgaaagctgcctgtttgtaaactgtggaaagtttaatttttcttcttagtttttaggggtaccccctaactagccttttctttgcagagtttgtatatgcatctctaacaaagtatgtttcctttgacaagttttgcttttaaaaaacttggactgactgaaaataatatttgtagaaaatattctaaaagtaatgcaaaaaggaaatatccttaaagctagtattaagaataatctcataggaaggaagtttcatgtgtttggtgttatctctctttttggtaacagttttgttgagatatattttatataccataccattcacccacttaaagtgtagaattcaggccaggcacagtggctcatgcctgtaatcacagcactttggaaggccgaggcaggtagatcacttgaggccaggagttcgagaccagcctgaccaacatggcaaaaccccgtctctactaaacatacaaaaattagccgggcatggcgacacgtgcctgtaatcccggctacttgggaggctgaggcacaagaatcgcttgaactcaggaggcggaggttgcagtgagccaagatcatgccattgtactccagcctgggtgacagagcaagactccatcacaaaaaataaataaataaataaaatgtacaattcattgttttttggtatattcacagacatgtgcaccattagtgcagtaaagtctagaacattttcatgacccccaaaagaaatcccatgttctttatcactccctaatacaataaaccccaagccccaggcaaccatgaatctactttctgtataaatttacctactctggatattttatatacacagattaatatagtaggtggtcttttgtgatgttttcagggttcacccatcttgtagcatgtattaggactttattcccttttatggctgaataatattccattgtatgtatgtacctcattttatttatcatttatttgttgaggaacatttgggttatttctgctttcatatggtaactctgtttaatcttttgaggagctcccagactttttcaaggtggctgcaccattttatgttctcattagcagtatatgagggttccagttcttgccacatctaaaacacttgccattcattacctgtttttttttattttagtcatgctactgggtgtaggatctcattgtggttttgactttcatttttctggtgactaatgtgtttattggccatttgtatattatctttggagaaatgtacagattctttgttcatttttaaattaatttgcctttttattattaagttgccagagtttttggtattttagatacaggtgtgtgtggaaaaaacaaactccgtttctcctactgctgatattcttatagcaccctactgaaagcagatgtgtggggatttctccccaccagcaggcaagcaagcagtcatttctgcagctgacagccactcaattctgacataatcaacctggagatagcatcaagattccacaggttgagggctcagtttccaagactgcctctccccacacttcacatgccagttgtaagctcccgcttattttacctgtgcttctgactgactggctataaattggtgttcccatttatagccatgggcttaacttgctagagcagctcgcacaactcgaaaacacatgtttaccagtttattacaaaggatattttaaaggatacacataaatagccagctgaagagatatataagacaaggtctggaaaggtcctgagagcaggagcatctctcctggtggaattcgggtgtgctaccctcccaggactttgtctgtgcttatactagtaccacattgtcttgactattatagctttctgtagtatgttatgaaagtggaaagtatgtgtccgtcaaccttgtttttatttcagggttgttttagctattctgggtcccttgaatttccatatgaattttaggattgattgtcaatttctacaaagaagcttggtgtgattttcatgtatttttttggacacagggtcgcaccgcatcacccagactgagatggggttttgccatgttgcccaggctggtcttgaactcctgggctcaagtaataatgcccagtttggcctaccaaagtgttgggattacaggagtgagccactgtgcctgaatctgtagatcagtttgggaagcattgccatcttagcaatgttaaatcttctgatccatgaacttaaatgtctttccatttatttaaatcttccttaatttctttcaggaattttttttttttaatttttcagagtataaattgttcacttcagccgggcacggtggcttatgcctgttatctcagcactttgggaggccaaggcaggtggattacctgaggtcaggagtttgagactagcctgaccaacattatgaaaccccatttctactaaaaatacaaaaattagccgggcatggtggcatgtgcctgtaatctctgttactcaggaggctgaggcaggagaatcgcttgaacccgggaggcggaggttgcagtgagccaagattgtgccactgcactccagcctgggcagcaggagcaaaactccatctcaaaataaataaataaattgttcacttcttttaagtatttttttatgctattttaagcagaattgttttcttaatatcatttttggattgttgacgcaggtacttggtgcatttaaaatacaattttattggctgggcatggtggcttatacctgtaatcccagcactttgggaggccaaggcttgcagatacctgaggtcaggggttcaagaccagcctggctaacaacggcaaaaccccgtctctatcaaaaatacaaaaattggctggatgtggtggcgcacgcacgcctttaatcccagcactttgggaggctgaggcgggcagatcataaggtcagcagttcaagaccagcctgaccaattggtgaaaccccgtctctactaaaaatacaaaaattagctgggtgtggtggcgcatgcctatagtcccagctactcaggaggctgaggcaggagaattgcttgaacctgggaggcagaggctgcagtgagccgaggttgcggcactgcactccagctgggtgacagtgagactctgtcttacaaaataaataaataggctgggcgcggtggctcacgcctgtaatcccagcactttgggaggccgaggcgggcggatcacaaggtcaggagatcgagaccgtcctggctaacatggtgaaaccccatctctactaacaataaaaaaaaattagttgggcatggctgcaggcgcctgtagtctcagctactcgggaggctgaggcaggagaatggcctgaacccaggaggcggagcttgcagtgagccgagatcacgccactgaactctagcctgggggacagagcaagatgccgtctcaaaaaaaaataaaaaaataaaaataaataatatgattttgtcaaatttaaaaccttaagatcctattggcttgtaatagcaaggagtagaagcgtggattgtagaatgttcttatgaaggctttatttcatcaatggcttttaagcactttggggtcagactttgagctgttagtgattgtttttgagctgtagtccttagagattccaaactgatgactgcatatgtcacttgtatagtcaatgtgactggttttcaaaagccctttcagttatagagccaatgactgggcaacagaaatgcctttcatttatatcattcttctgttttcttggtgcaaagggctgtagttaagaggaacagttagattttagtggcttaccaagttgctttagaggaagtctatgaaaggactgttgagccaaacaatgttcagattaaaaaccagtctgttagcaggacagaatcctcttgcagatactttgtttaacctttaacttagtgcaagaagagttcaagctatgacttttgagattaaatcttaaattatgtaagcatgtttctgataaggattgttttatcatctgcatcagaaccatttggactgctttaaaatacagatttctggactcctacccagatttactaaatcaaattctgggaatagaacttcataatctcttttaaaccacctttccatgggatgtccacgttaaagtttgaaaactacttttatttatttttggcatccatatgtgtttattgatatagtttcccactcatcttgattcagggttctttcagtgctgtctctatctgaaggagagccttcctgtaggctggcagaggacagcagagcagccagacacacaactactattgtgcatgactgacgaccatggtgattttatagcatcctgggcatttcacgttcaggaagtaagaattggggctctgcaccaggcacttcttgtgcttgctctttttttctggagagggagggagattctttgtgagaggcctgttctcgtgaggggatcgtcagcactggaaaactgaaaaccagttttaatagtacctctttctgttaagagattggtttttaccaggactgaaatttttcaaattatgactcactgccaactattttttctgttgctgtttttgtttgtttgttttttttgagacagagtttccctctgtctcccaggctggagtgcagtggtatgatctcggctcactgcagcctttacctccccaggcttaggtaattctcctatcttagccctcccaaataggtgggactataggcgtgcatcaccatgcctggctaatttttgtattttttgtagagactggatctcaccatgttgcccaggctgatcttgaactcctgggctcgtgtgatctgcctacctcagcctcccaaaatgctgggattacaggcatgagccatcgcccttggcctacagccaactcttaaaagcaaaacaacactagaagataatggaatagaagatttcagtaggccgggcacagtggctcacgcctgtaatcccagcactctgggaggccgaggcgggcggatcacgaggtcaggagctcaagaccatcctggctaacacggtgaaaccccgtccctgctaaaaatacaaaaaattagctgggcgtggtggcaggcgcctgtagtccccgctgcttgggaggctgaggcgggagaatggcatgaacctggaaggcagagcttgcagtgagccaagatcgtgccactgcactccagcctgggcaacagagtgggactccatctcaaaaaaaaaaaaaaaaaaagtttcagtgcattgtacatagtatggatgagtattgatttataaaacttctgtttcatttatatatgtgtatgtgaatatggatcataatataaatttttttttgccatggatggtgataaaaagaaaaaaatgaagacttgagaattagaaaaacacatatttttctttccttcactctttcatacgttcttttgcatctgccatgctcctggaactgggataggtgctgggtgagcatccaaatattccgaaaatcctcactcttttttttttttttttttctttttttggagatggagtcttgctctgatgcccaggctggaatgcaatggcgtgatctcggctcactgcaaactccacctgctgggttgaagcgattctcttgcctcagcctcctgagtagctgggattatagacgcctgccaccaatgcttggctaatttttgtatatttagtagagatggcattttgccatgttggccaggctggtttcaaactcctgacctcaggtgatccacccaccttggcctcccaaagtgctgggattacaggcgtgagccactgtgcctggccgaaaatcctcactcttgagctcacagtttatagagggtaataggcacataaataataaagtggtatagtagaagcacatgtcatacattaactgtgtactagaagtacatatcatatagagtgctcctgaagtcatggcgactttcatagggatggaggtaggttgaggggtaggtactgaaaatattgaagctgggtgctgtggttcacacctgtaatcctagcactttgggaggccaaggtgacaggatcgcttgggcccaggagtttgagaccagcctgggcaacatggagaagccctgtctctacaaaaaatacaaaaattagccaggcatggtggcatgtgcttggagttccagctacttgggaggctgaggtgggaggatcacctgagcctcaggagatcgaggctgcagtaagccaagattgtgtcactgcacgccagcctgagtaacagaatgagaccctgtctcataaataaataaagtgaaaaggtggagaagaagaatagcattttaattattaagcgtgaaagaattattttagtattgaagatggacaataattgatataaatcatttttgatttagtattcttatccactcttattcatatgttactcattctgatgcagcttttgagtatataggatcaatccagcacatgaagagctaaagggaggttctgtacctcttgtgacagcttttcctattcttggagggacccttttttactttcctcagaactttatttactagagtttatttcctttttagattttatttcatgttgatgctagtattcttactgaatgtattctgacccactaagaatcaatgacagggtagggaggtgtagttgagatttggggagagccttatgcatttcataggggtccaaattctgtatctgatttttggcttcagaatacttttcaggctgtaagccagtaacctcattttagtctttatctctcagccttatagtcatcttttgttttatcttactgtaggctaacattcaccattagaaagtcagacagctggtctacacaccagaagatactatattagctttcattgcttatgtttgcctgttgcaggctcttttgtttacatcagccgccttcactcatttggttttcatatgcatactgattgatacatataaacttagggagattcactctaaacagtgctcttgatctattttgtgtttcttaagtgttttagctcagagactggtactgtttacatagaaagaacagcctcgtcaagagtctggaggggcataccctatgtcacagcatttggccatagctctatacatgacgatatcaagaaggcgcccccttggacctacgaagacagaaggcacattcatgtactttgagtacacagaaatatgataaatgatgaataacaactgtttttaagaattaaaaaacaggaggcataaagttaataggagatgaatgcttaatgtgtggcagtttcacgtgttacatttgagggtcaggtcggtagtggtgttggtgaagggagctaactggttacccagcctggatgggattgggtggctgtgggtggaaaaggtgggaggtagcgttataaacaattaaactagtgttcaattgttaaaggctattatcatagcctttgacttttcagtctgttgaatgatcattttgctttgcatagagcttgctataaagattgctgtgagagacaatatttggtagtaaattaagagttgtgccactttactagctgagcaatcttaggcaagttatttaacctctaagtgccctggtgtcctcattttaaatggggttatctatgtcctagagttgttcaacatattaagcaaagtaatttatgtaaagtgattagaatggtctctggaatataagtctgcaataactgctgtttttttttgagagggggggatggagtctcgctctgtcgcccaggctggaatgcagtggtgggatctcggctcactgcaacctccaccacccaggttcaagcaattctcatgcctcagcctcccgagtagctgggattacaggtgtgtgccaccacacctggctaatttttgtaattttagtagaggcggggtttcatcatgttggccaggctgatctcgaactcctgacctcatgtgctcctcctgccttggcctcccaaagtgctgggattacaagtgtgagccacaatgcccagctggctcttcttatttttatttttagtctattgagacaggatctcactctgttgagtgagtgcagtggtgccatcacgactcactgcagcctcaacctcctgggttccagcaatcctcccacctcagcctcctgagtagctgggaccacaggcacataccaccatgcctggctaatttttaaattttttgttgagacgggatctccctatgtttcccaggctgatctggaacacctgtgctgaagcagtcctccctcatcggcctcccaaagtgctgggattgcaggtgtcagccactgcatctggtctagttcttatttttttatatgggttggagtttcttttttttttttcctttttcttcttcaattttaatattttgtcattttattatattgcatctcccactgaagacttgtatatttcttggggtcttattggagagaaatccttttttttttttttttttcatacaaatcagacccaaggtaggtttagtgtttggactgtaatatgaagtttgctttttaattgttaaaataatgatttttttcttgcattaaacaattctgaaagtttttctttttgttcacttgtagtcagacaccaaagaaagggggaaaactgtagaataagttattttttttgacagtgtctcactctctgtctcccaggctggagtgcagtggtgcagtcacagctcactgtagactcaacctcctggtctcaagcaaatctttcacctcagcctcccaaggagctgggattacaggcatgtgccaccatgcctggctaatttttgtatattttgtagagacaaggtctcagtatgttgcctaggctggtcttgaactcctggactcaagcaatcctcccacctcagcctcacaaagtgctgggattacaggtgtgagccactgcacctggcctaagtgaaaaaaaattttttattttttggatacagagtctctctctgtcgcccagggtggagtgtggtggcatgatctcagctcactgcaacctccccctccaggttcaagcgattctcatgcctcatactcccaagtagctgggattacaggtgtgtgccacaatgcttagctctttttttgtatttttagtagagacggggtttcactatgttggccaggctggtctcgaactcctgacctcaagtaattcacctgtcttgggctcccaaagtgctgggattacaggtatgagccactgtgctgggcccctaagtgatttttttaaatggtcaatgtgtgagctgttttttccttatggttttctctgttccttttccttgccataaaagtaaaaatagatctggtttcctgggttatcacagcttttaacaaaaagctttttgataaaattagctgttgggtcagtgggatgagatcattcctttctaagtagtgtgaaatgtcctctaagcatttgtgagacaaaggcatgccagataggctaaccacacaataagcctaactctgtggttatgtttagggcaggagtgtgagttttctgtgaaatagaatactactgatatgtagaaaaaggtgaaaggtacttggcacaatatgtatgcactctggttggccacgtgtagaaagagattagaatgataaaagggctcaggatacacttgatatgagggcataggccatcattatcttcagatgtgattaattaactgaaaattgagtagctcatctacatttggattagtgcatctttaattaaaaattcttggctggacacggtggcttacacctgtaatcccagcactttgggaggttgaggcgggcagatcacctaggatcaggagttcgaaaccagcctggccaacatagtgaaaaaatccgtctttactaaaaatacaaaaactagctggctgtggtggcgtgcacctataatcccagctactctggaggctgaggcaggagaatcacttgaacctcggaggcggaggttgcagtgagctgagatcctaccactgcactcaagcctgggtgacagagcgagactcccgtttcaaaaaaattaaaaataaaaataaaaaaattcttaaggacagtttgaaactggagagaaatcataatgtactttaaaatggttaattgtatgttatgtaaacttcacttcaattaaaaaaattaaggacagctggaaagaaaactaatatacttttctgtttgtacaaaataaaatggtagatttaagaagctttaaccagggcttcaactttcacatcatagatactaactgtagaagcatagtgcgataactgatagttaaatagaagataaaaatccacatgaggagggcatgccattttaaaaaggagagctatgtgatgctatttccaatacatagatatagctggacttaccttctttatccctgagaaacgaaagcattctaagttagcagaggaaatgatgatcagaatgataatacctcctaccttttccccttgcttcctgatttgggatataggacagaaaagaaattctacttttagttgagaactcagggatgactttgaacaaatatatttgttaatctccttggacttttctcacttttaaaataaggaggttggattcaaatgccctttctaaagttttgtgatttggttggaaatattagatgtgcacatcaccaagttactttgttttgtttctgtgtacatgaataagcttttattagacttggtcactgttgtctctctgtgatcaacaagggtaagttagcttctaagagtaccagtggtagaactttaagatttgaagctttaacgagagtcagctagtttgcagtgattagagacttgtaagttaattgatatacacacttttgtctatatttattaagtttctcaggggaattgtagattatttcagagtgcagttttaggtcgtggatcagatttaagttggaagtaaataatggttattactagaattttttgtttttgtttgtttttgagaaggagtctttctctgtcacccaggctggagtgcagtgccacaatctcagctcactgcaacctctgtctcctgggttcaagcgattctcctgcctcagcctcctgagtagctgggattacaggtgcctgccaccacacctggctaatttttttttttttgagacggagtcttgctctcttgcccaggctggagtgtagtggtgcgatcttgggctaactgcaacctccgcctccgagattcaagtaattctcctgcctgagtctccctagtagctgggattacaggcgcacaccaccatgcccatctaatttttttattatttttttttagtagaaatgcagtttcaccatgttggccaggccgctcgcgaactcctgacctcaattttcatacattattattaactaaagttcatagtttatttagatttccttaatttttacctaaatacctttttctgttctaggatctcatctaggataccacattatgtttagttatcatacttagctttctcttggctatgacagtttcttacacctcccttgtttttgatgactttgacagttttgaggagtactggtctgatattttgtagagtgtccttcagttgggagttgtctgatctttttctcatgattagacagaggttatgctttttagaaggaagatcacagaggtaaagtgccactcttatcacattatatcaagggtgcatactatcaaatcatgtcagcatgatttatgtctgtgtgtgtgtgtgtgtgtatgtgtgtgtgtatgtgtgtgttttgctttatcactcaagctggagtacagtgctgtgatcacagttcactggaacctcctggactcgactcaagcttcctctcaactcagcttcccaaatagctgggaccataggcacatgccaccaagcccagctaatttttttttgagaaagagtcttgctctgttgcccaggctgggttgcagtggcacgatcgtggcttaccgcaaccctggcctccagggcccaagtgatcctcccacctcagcctcccgggtagttgggactacaggcacgtaccaccatgcctggctaatttttttgtttttttgtttttttttgagatggagtcttgctctgtcgcccaggctggagtgcagtggcgcgaccttggctcactgtaacttccgtctcctgggttcaagtgattctcctgcctcggcctcccaagtaggtgggactacaggcatgtgccaccacacccagctaactttttgtatttttagtagagacagggtttcaccatgttagccaggatgatctcaatctcctgaccttgagatccccctactttggcttcccaaagtgctgggattacaggtgtgagccaccgcacccagcctaatttttgtatttttcatagagatggggtttcgccatgttgcttgcctaagttggtgtcagaactcctggcctcaagtgaacctcctgccttggcctgccaaagtgctgggattacagatgtaagccattgcacccagctgatttatcactattgatattagtcttgatcacttggcttaggtagtatttgtcatatttctcttacccccccctcccattttcatattgtactctttagaaggaggtcactatgtgctatgcacatgtaaaggatgaagggttatgttctacctcttggaagtggagtatcttgtttggaattcttcactgaagacttgcttattctctctcatttatttattcagtctattgtttatattgttccagctttggtcattgggaacttttttagttgactcctgtgtaattgagttacccctatcttttttttttttttttttttttttttgagatggagtcttactctgtcgcccaggctggagtgcagtggtacaatctcggctcagtgctacctacacttcctgggttcaagcaattctcctgtctcagcctcccgagtagctgggattacaggcacccaccatcatgcctggttaatatttgggttttttatagagacgggttttaatcatgttggtcaggctggtcttgaactcctgacttcaggtgatctgcctgccttggcctcccaaagtgctggcattacaggcctgagccacctcgtccggccaacttacccctatcgttgtttttttttttttatttttatttttagcacttcctaactttctggaaatacaaggtacttcaggctcatcttgaatattttgttctcagtcctagaattagtcatttctccaaagagtcttggtttctttatcagagaatggtattagaaaccagcatctgggtgtgaggtatgctgttgctttactggggtgtcccctgaagattttaattaaacttcatctgagtttgaaaggactggaaatgctgtgtttaaatttttttttattttctaattgagacagggtctcactgtgttgccaagactgaaatcaaattcttagccttagatgatcctcccacctcagcctttcaaagtggtgggattacagacgtgagccaccacacctggccagaaatgccatatatataaaatatataatatatattacatgtgaatatgtaatatataatacataatattacatatgaatatataatacatatattatatatatatatttttttttttgagatggaatcttgctcagttgctctgtgcagtagggatctcggctcactgcaacctctgcctcctgggttcaagcgatttccctacctcagcctcctgagtagctgggactacaggtgcatgccaccacgcccagctaattttttgtattttaatagagacggggtttcaccgtgttagccagaatggccttgatcccctgacctcgtgatcctcccacctcggcctcccaaagtgctgggattacaggcgtaagccaccgtgcccgacctacctctttttactacgattttattactactggaactagatcttaaaatatcatgtaagatctctgccattatactagttgtctgtagctacatgtatggaattttaaaccgttcagattactaccttaggaatcagtatgcattcttgccttttccataaagcagaggtgtcaggaccaagcttttcaggtcattgacaaaactgaaaaaggagttagtgattattgcttcctagggaagtaagacttaaaaaaatatgcatttacttatttatttatttagagacagagtctcgctctgtcacccatgctggagttcagtggcgccatctcggctcactgcagcctccgcctcctgggttttaagcattctcatgccagcctcccgagtagctgggattatgggtgtgcaccaccacgcctggctaatttttgtatttttagtagagacagggttttaccatgtcggccaggctggtcttgaactcctgacctcaagtgatctgcccgctttggcctcacaaagtgctgggattacaggtgtgagccaccccacctggcttatttaattttgagacagagtctcactctgttgcccaggctggagtgcagtggcacaatttcgactcactcatcctcaacttcccagactccagtgatcctcacacctcagcctcccaagtagctgggactacaggtgtgtgccaccacaaccagctaaccttttttgtattttttatcgaggcaggggttcaccatgttgcccaggctggtcttgaactcctgggctcaagcgatctgcccgcctcggcctcccagtatgctgggattacagacctttgccacggtgcctgaccagaagtaagacattttggatgtgtgaatgaagttctgattatgttctaaaggaattaccactagttttgtggtacctttttttttttttgagaaggagtctcactctgttgcctaggctggagtgcagtggcgcaatcttggctcactgccacctccgcctcctgggttcaagcagttctctgcctcagcctcctgagtaattgggactacaggcgccggccaccatgcccagctaattttcgtatttttagtagagacggggtttcaccatcttggccaggctggtctggaactcctgaccttgtgatccacctgcctcaccctcccaaagtgctgggattacaggtgtgagccaccgtgcccagccattttgtggtacttttgttttccatttctctccctctcacacctttcctgtctactgactttgtgatttagttaaaccaagccactaaaacccagccaaaattctactaccaataagaaatgtttagagttgatgttgatttaaatagctttagtgcagctgtgtcgtacttaaactcctgcaaatttccctccccccccagagatggtgtcttgctttgttgcccatgctagagtacagtggtgcgattttggctcgctacaacctccgcctcctgggtttgagtgattctcctgcgtcagcctcccaagtagttgggactataggcgtgtgctaccacacctggctaatttttgtgtttttagtagagatgaggtttcactatgttggccaggctgatctcaaactcctggcctcaggtgatctgcccaccttggcctcccaaagtactgggattacaggcgtgagccacagtgcctggcccctgcaacgttcttgaagttaaagtgagtgaagttggtcttgattaagaacttatgctgcagatattgtgtgaatgggtatctacagaggcagttatttctcagctccagtatattgttgctaagtggaaatacatagtcatggcctgatcttcggattttttatttttttgagacagggtcttacactatcacccaaggctgaggtgcagttccgcaatcatggctcactgcagccttgacctcccgggctcaaacgatcctcccattttagtctcctgagtagctggaaccacaggtgcatgctcggctaattttttttattttttgtagacacggagtttcactgtgctgcccaggctggtctcgagcccctgggcttaagggatcctcccatttcagcctcctaaagttctgggattacaggactgagccaacgcgcctggccctgttttttaaaaaagctgtaaaactgtattttcattcaaagattactgattttggagatattggccatttttcaaaacactatatgggccactgcaccaaggggcctgtttgacctaggtttgcactctgaactggtgcttctcttgtgggttcagtgagtattcattttggggagggaactctgggcttggtgggagttgggagatgtttgtcctaattgtagctttgtctctagttttctagatggcttttggcaaagggaaaccactttggatctctcttttctgagttttaaaatttgagagtaaactggagaatttaaggttctcccttactcttttttattttacatgttcatacatgtatttacttgagctgtgaaacaatgaccatttatgagttggagacttcaggaagtcttactagtcttaagtgctttgggaatagaggagactattatgttttctctagatacacttttttctaggctacagaagattctcacctgctttttggactcttggcatacttgccgcctctaatcattatctggcagatgtgtacatagtaatgggtgatgcatatgtttctgttttttcaagcaaattgattctaatttgatgaaagctgtattgatatgtagggtttttggggggtagtcgtggtgatgggtagaaatagtaaagctgacagtgacagtattttcttagttatggagaacattttaatactttatttcattatttttagtttgaactaattaattgttggtggttctatatggaaataatgatgtaggtgggtgttcatcacttaaaatcaactgcataagataatggcataacttaattactgtaacagcaaaaatgaaatctgagaaacttctgaaatttagtcttttattaatttgagataagatttatttggagataagatttcagacttccttttatcagacaggtggttttataggaagattaagattcttctagaaaaatcttaaagacaagggaaataagtttttcttacactctaaccatatattcacttgacatatagtgtttttgtaaaaatatattcgtttcttacatcttcagaataaagcatcttgatgtaatgtgatttactaagaatcatacctctctgtcctgaaggccaatctaaattgctgttttgtatagattgccaatttttaaaagagaaactgttgtatttgagtgggatgtaataaatatgagcgtttatgatgtagtctcttgtgggaatgtttatttacaagtaatttaagcctctgtgagcctgacaaggcaaactcaatcttaaatccttgattaagtggaagtataaactgatggaataataggcaagcaggatttatgtttacatggtaattgcaacaattttggccaaaacatttggcctaatagtcactaattttgatcctttatgttcattagctgaaattgtatatgtagtagtttctttgtaaggtaatacaaagcagtaaggacacaggagaagagtatatttaaaagaaatttctcttcagatgtatagactttgctttatagttctaatgacaatagtccaggagcctctaagtcagcatattattattattgttattattattattattattattattattattatttttgaggcagagtttcgcacttgtagcccaggctggagtgcagtggtacgatctcggctcactgcaacctccgccttccaggttcaagtaattctcctgcctcagcctcctgagtagctgggattatgggtgtgcaccaccacgcctggctaatttttgtatttttagtagagacagggtttttaccacgtcggccaggctggtcttgaactcctgacctcaggtgagctgcccgccttgaccgcccaaagtgctgggattataggtgtgagccaccacacctggccaagtcagcatattatttcttcttgtaaaaagatgtcatggtggctcatgcctgtaatctcagcactttgggaggctgaggtgtgcagatcacctgaggtcaggagttggagatcagcctgcccggtgtggtgaaaacccgtctctactaataatacaaaaattagctgggcatggtgatgcacgcctgtactgcccgctacttgggaggctgaggcatgagaattacttgaacccaggaggcagaggtggcagtgagccgagatcgcaccattgcactctagcctgcatgacagagactctgtctcaaaaaaaaaaaaaaaaaagtgtgtaggtatgtatacctaataaaattagcgctttctaaaaatgcagtgcttgtcatttactattaagtcaagccatatgaaatcacattttgtcagtaaataaatgttcagatatccacaatcttatacagttctaatagatactcaagaaattttgtcgacatgaagagagtcaaatcataaaatggtagactgaaaaagaacttcgtggagaattcttttctttttgcaaacagaggtgactgggaggtcgaggctgcagtaagtcatggtcatgccactgcactcgagcctggacaccagagtgagaccctgcttcaaaaaaaaaaagaaaaagaaatgattgcactgcctttttttggttttggaacaaatattgtgataataacttttacttataaatgtagcacagaaatcttttactttgtaaaagtccctgaatagaaagtcaggagacctgtttctcctaccaactagtataatttttggaaagctcattgttcatcagtttccttatttgtaaaatgaggatgttagatatgtaagatctctgtattaattaggatagttgatgctaactctttaacataactagcatttcagtgacttaacacaataatggtttatttcttgctcacgtcatagtgtgagtgtttagcctgtggctgtcatgtaattgaggaatttcaactccttccatctggtgtcttggagtctcctgctggattctttgtatttagttggttgatagcaaagagcaccagcaagcagaatttcatcaagtgctttgtagtgaagcataattcttcagctcacattgcactgtctagaacccactcacatggtctcaacttctaactccaagggaaataggaaatgtctttctgagcacccagggagaagaaacagaatccccatctttgccacggtccctttcattttgtacatttttaaaatttttttatttattattttttttaaagacagagtcaaactctgttgcccaggctggagtgcagtggtgtgatctcagctcactgcaacctctgcctcccaggttcaagcgattctcctgcctcagcctcccgagtagctgggactacaggcacgctccaccacgcccagctaatttttgtatttttagtagagacaggatttcaccatgttggcctggatggtctcgatctcttgacctcatgatccacctgcctcggcctccccaagtgctgggattactggcgtgagccactgcacctggcccattttttgattctttattcacacccaaatactttctcctgttgcatattgctttttgtatctttggttactctgaatttacttccaaatttcttggaaggagtttagtattgcaagtcaaagcagccctttggtgcttgctatgtttaggagagggtctccccccaacccctgccatccccagatgagtatatttgttatttttgttagtagtttcatttgtggtgtaagtttgtcttttatattgtcatggcttgcttagttttaaatgattaaaaatacatcaattgcaaaaatctcccagtgcttgtataagaaaaacaatagaatattgaacacagccaacttcagagggaaagtcattgtctaccatgttcagtctagcagcctgctagcagaagggaaaacagacaaaccttatactgtcttttaaaggtcagcacatgcagacttagagaccaatagagaaacacattccagtgagcaggcaaagttctctttgacttctgcccacttaagagtaaactcagagagtcagcaaaagtctttcagttgatttcagctgctgttttggagtcatctccatctttccgaagcctccttctcttttctccttttttgttctttcttgatacattatattgtacatgttcatttgtatgtaaatacaaaatatccttctttatggatccatcttatgttggtaagtttgatgagagtgttctaattctaagccttgtctccttaaaatatataattatctcagaataatgccatagttcagtttgccttatgtttggattagtactttcttgtgtagttctctttcagtaaactgctcccctcccctgtttttaattgcaccttttttcatataccatttgcaccacatgtctaagtcattggtctttttaaattacactatggaaaggttaattttggacagagttgtttctagatcctagtgcattatcgtcatcctaggattgcatttcatttctcttgtaggctaatggtactattttttggatattgcagctttaataggatgctgtgttcatttttcatttcctggagtctgtgctgaagttcattttcagaaagaatgcctggaaaataaatttttttttttcccccctgagatggagtgtcactctgttgcccaggctggagtgccgtggcgcaatcttggctcactgcaacctctgcctcccgggttcaagtgattcttctgcctcagccccctgagtagctgggactataggcgcatgccaccacgcacagctaattttgttgtgtttttcgtagagacggggtttcaccatgttggctaggatggtctccatctcttgaccttgtgatccgctcgcctcagcctcgcaaagtgctgggattacaggcatgagccaccacgcccagccaataattttttttaaattgtgtgtttgaatttcccattttagccttcacttaatggatgagttggctgtaaaaatctagcttcaaaatagtttttctcagttttaaaggcatcacttcattttttaaaaaaaatcatttagtgttacaattagaaataagcccatctgtttcttgtaagttggtaagtactgctgaggggaatttccctccctcccttcttgccaccttgccgaggctgtattcaaattcctgggctcaaatgatcctcccacctcatcatcttctttttgcttttcttttttccttcttttgtccctgtctctctactctctccattgtctgttcgttttcttcatctgcctctgtgatcatgaaaatattcgccatgttattgtttaccgttcacatttagggctgccatccacctggaattactttttgtatatactgtgaggtagagctcaaaatatccagttgacccagcaccacttattgaaaagacagttaattcccccactattttgcagtgtcacatttgtcagatattaagtatccatatgcatgtggttccgtttcaaaaccatttttttgcattggcctcttgttttgttttgttttgtttttccatatgttcagcacaccaagtacattggcctctttcttggtgattgtgcaggtaccacaatgttttcattactatatttatgtatttttagtttcaaacatatgacattgccataggttagaaactcatcagttttcagcattttcacatggttcaatccatcagtaagttttgatatccagtagtttaagttcctctaagtttgttctcaaagattatcttagctgttcttgactttttaaattactatgtaaaacttaggatcaacttttcagtttgatttgaaaagaaaaaacctactggactttgcttggggttatgttaaatctatagattaggccgggcgtggtgtctcacgcctgtaatcccaacactttaggaggccaagacaggtggatcacaaggtcaggagtttgagaacagcctggccaacatggtgaaaccctgtctctactaaaaatacaaaaattagccggatgtggtggcgcacgcctgtggtcccagctattcaggaggctgaggcaggagaattgcttgaacctgggaggcggaggttgcagtgagccaagatcatgtgccactgcactccagcctgggcaacagagtgagactctgtctaaaaaaaaaaacaaaaacaaacaaaaactatagattagtttggggatagttgatacctttaaaatatcataaaaccttaaaataaaataaaaccttataggtttttcctaaaagcactcccttagtaaatcacttgtacaaaaatccgtgcctcagattctacatctagtaaactgattctaaaacaccttcctaacaagggggagtgtgatgtctttctattgttaagttgtattaatcctgtgttgcatttcatttcagtgaattttatcttgaatggattaggtagattgttgattaattcagtgaccctcaattgtgggtgcctctcggactcaactttaatgagatttctctgtgtcatgattacccttactgcaagaaaaccaacaacactgagatttttggtgcagtagcacatgcttctagtctcagctacctgggaggttgaggctggaggatcgcttgagcccaggagcttgaagctgtagtgtacaatgagcacacctgtgactagccaatgcactccagcctgggcaacatagtgtgacttgtctctaaaaaaaacaaaacaacaacaacaaataatactcatattgcttaaccctgtccctgaacaattctgatccagcgtgttttttttgtttttttaatacttttaattcagatttttacttgtatttcaggtaaaatattaaaagttatgttactaataacttgaaagatctcttcaacttttgctgttcaattttcatttaataatgatattccccccctcctttttgaaagcatctgtaagatattaggtcaaagtaaggcctttgccacgactacaaaatgcttgttaagtactcccatagagtttgtatcttctccttcttgctcagaaaagctgagctactctacccttagtcgtgcctagaaccaatacttagaagaactatgagggtgcttccagctgtgcaaacatcaaccccagcaagagaaggctggtatggtatggagcagagcgcacctagcaggacaaatgtgcatttaatgagagcctgtgaggtttcaagtttattatatttagatgtccaggataaaaggtgagaaagatgctatcctagccatcgaggaactcaagcgttaaggggaactctgggtgggacacacattgtaaataaacaattacaagggtgggcatggtggctcacacctgtaatcccaacactttgggaggctgaggcaggcgaatcacttgaggtcaggagttcaagaccagcctgactaacatggtgaaaccctgtctctactaaaaatacaaaaatctccgtctcaaaaaccccacaaaaaacaaaacaaaacaaaaattatagaattggcagcacaaattcctatgtcctcttctaccttccacttttctttattttcactgatataaaatagagtgaaacttcactttgcttaatgggagaagtttttcttttgttatctattattttcaagacagggcctcactctgtagcccaggctggagtgcagtggtgctatcacggctcactgcagccttgaacttcctctgctgaagtgatccgtccacctcagcctcccaagagctgggaccacaggtgtgcaggctaattttaaaatgttttctgtggagacgcagtctcaactgtgttgcccaggctggtcttgtactcttgggctcaagcagttttcctgcctcagccttccagaatgttgggattataggcatgaaccaccatgcccagccaaaagagagttttttctttaataaaatagttctcaaaagctaagagctgatcaagtatgaatattcttcctttcttccaatctcctcagcactaagtcatcctaaagttacatgatatgcttattactttctgacagatatatgagctgataactatagagatttaatattttaataattataaagttttaatatttatatgatcatattaacatgatggtagtggctgatatctttctctctttctctctctgtccctcagagatgtggtctcactttctcgcccagactggagtacagtgttgtaatcatagctcactgcatcctcaagctcctgggctcaaggaatcctactgcctcagcctcctgagaggctggcactacaggcacacaccaccatgcccagctaattaaaaacatttttttttgtagagatggtgtcttgccatcttgcccaggctagtcttgaattcctgggctcaagtggtcttcctgctttggcctcccagagttctgggattacaggtgtgagtcaccatgccaggccagtaactggtcgaccatcttgaatatttgtttttgccacattgcatcatgtcatgcttttctaaaagcagagagagctatttttattgctatgcctaataatgataagatgaccagcatggagagctggttcgtacggttactccttactggctttctttctataattccagacaacatgcttgctcttgtacaaactgtgtttagaaagtggaagaaaataggtgaatattcttttttatttttatttttttgagacagagtctcactctgtcacccaggctggagtgcagtgacacgatcttggctcactgcaacctccacctcccaggttcaagtgattctcctgcctcagcctctcgagtagctgggactacaggtgcacaccaccacgcccggctaatttttgtatttttagtagagaggggtttcaccttgttggccaggatggtctcaatctcttgacctcataatccacccacctcagcctcccaaagtgctgagtgctgggattacaagcatgagccaccacacctagccaaggtgaatatttgtaattggtgataacctttcagccttgaatctgtttattctttttctagttgtgaagagtttttgtaattttggaacttctgattaatttcaaattagattcaatttctaataactttcatcgtgtcattttagaaatgtgtttttagccccttgttttgttggtttttatcattttggcctgtctcctctgtagtctactaggaacagagaaggtgtgcacatcactttgatgtggtcctctcttctgggacccagcagtttacaggagctggtatatacaactaactacagtggggggtccccaaccctcggtctgtagattggtaccagtccatggccagttaggaactgggctgcacggcaggaggtgagcagcaggtgaacagcattacattaactttgcgataagtgtgcctgagttctgccttctgtcagatcagcagtggttttagattatcataggagcgcaaaccctattgtgaactgcacatgcgatggatctaggttgcatgctcctgtgagaatctaatgactgatgatcggaggtggaagagtttcatcccgaaaccatctcctccctctcacccctcctgctatctgtggaaaaattgttttccacgaaacctgtccctggtgccaaaaggtttggggaccactgaactacagtatagatcagactctactgttacaagtacagatgatgtattagttctgaatactactgggagaaagattctaaaaagcagtcacagaaaaggtggtaagacaatttatgtggaccttgatttcaagactttcacaaatgaggagggagagaagataacttcaagtttggagagcaaatgagcatagggtgtacagtgataatgtaagatggtagatggtcccatgtgactaaattgtagggagaccctacatggaaagctgctgatgattatggtgggtgataggactgagtcttgtcagtcagccttgatattacacgtaagagtttggatttacaaaaaaaaaaaaaaagaaaaaagaaaaagacatctaggcattggggtccctttaaagatcaggtggaatgttttcctgatgttcaggattcttcctgcctgcctccctccttgcagaagaaaagataggtaggtataagtagtaggtaggtaaaggtatgtataagcaggtataattcaaaaggtatatgaagtacagcgaagtcattgtgttagataaaagcagaaactacaaaactgtaaggttttgcttattttgtcacgctctgcttctgtttttggtgttctgtggctcttttcgccgatcctttgtctcagcctcatttgtaagtgacttgttttttccatttctcatttttttttccatctattaaagtgaggggattggatcctagatcagttcaactggtgtaagcctttagagccaggcatggtggctcatgcctgtaatcccagcactttgggaggccaagatgggtggatcacttgaggccaggagtttgagaccagtctggccaacatgatgaaacctcgtctctactgaagatacaaaaattagccaggcatggtggtgtgcatgcctgcaatcgcagctactcaggaggctgagttaggagaatcacttgaacccaggaggcggaggttgtagtgagctgagatcatgccactgcattctccagcctgggcaacaggccaagaccctgtctcaaaaaaaaaaaaaatgcctttagaatgtggttagaaataatttttggattggtatagattaactctgaatgttttcctgtgttagaggaaggaagtgggataaatgtaaagtttaaaaaaaatgctcctttttcaaaattttgaggggttaggtattaagaatcttttaaagttttactcatttaaaaaatttagataaaatggaagattcattcttaaggttggtgatatcagaaatgtaagtgctgtgtcattgtcatttcttattttggcctacataaccgtaaccagacttcagacatcatgctgcctgtatcacatggctaacagtgggaggtatctggtgtgttcttcctggagaaatagattgaaattcatttggacagaaatgttgaaggcaggtgcctgatccaaaatgcatttagtcaggactgaacacaagctgcctggatagttcctgtaagtaagcaaggtagccttttaactttgtgatgcaaggttttatgtatgtgagtatgtgtgtgcaagtgtatacagtatttttatatccagagaacagggctcccttaaatggggggtgggggggactctggtaactacatgaaagtaaaatataacttctttaaacctatatcagtgtgttctttcatgtaggaatgtagctgtgtgatggcctcagctattctagtaatcaagggctctctgctgttgctaatcctatgatgaacaggacaaatggtggttacgaacagaaccctgtcaagcctggaaattccatcagtttgtaatagcacagctgttgtccttgaactgtgtagggaggaacctaggggtggacagttaatatattcttcaggggggttgtagtttattgctcaggatagtcaagatcttcctcagttgtctgttgctatctgcaagtctggtttggaggagaagcaggagaaattcagatttgtctgaggaatcatatgtgtctgtgaactgtgtaagttggtagttgattcctgtagacatccttgctaaagatttatttttaagtaaaatatcattttgcttgaaagtataaatcaaggttttgtggttaaataaattaaaaacagcacagctgccagacaaagttcagcttgatgtataacaggcctctgaaagaagttcagtaagaaacaaatctgggtaataaagttaattagtaactaaaaacctgctaggcatactaaaaaaaaatctgatgttgaatattaaattattatgaagcaggctatacctgtatccatcaagattataaatgatctcccacactggcgacgtggggttcctttcaagcctgaggaatgagcactatattttggccacagcattctcactaatgtcctaggatagcagcttagtgttggctttagaattctctgtcatttaaatgtcatgcaaaaacaaacgtataaaagaaaacattaacccagatatctttatggttccttgtcttgtccataaccgcccccgcccccacccacccaaaaaggacaggctatcagttatagagaaaatataagtgagcattataagcagtatcctacctttagtaataattatttaaagtttattaaatgggttgtttggaactcaaaatgatttgcctcaaagtagcctaggtcactgagaagaaagtttatttctttctgctgaaactgacaggaggcgatattttgaaagatagcaagcttgtctttggcatggtattaactccctttcttttgcctcctagggctcctgggcctgtataccctttccctactttgataccatatctatatctgctttattccctgaaagttcccatgttgccataatatttttcttcctttttcacaccagaaccaagaactcagacatcttcaatagaaccatctctgggatgaacaatggtctttccagggatgtacattttcttacccacttttaaattaagaaataggattctatacttttaaaaagagaatgctggctactgcaaatgaatgtcggtagaaatttggctaatgtgacacagtaaaatgaaggtttcctaacacagtggttaggaaaagtgagtatgatggtgggaatcaggcttctgttcttgctttttttttttgagtcagggtttcactctgttgcccacgccggagtgcagtggtgcaatagtggctcactgcagcctcaacctcctgggctcaatcagtcctcccacctcagcctcctgagtagcagggactacaggcatgtgccaccatgcctggctaatttttacatgtttttgtagagatggggttttgccattttgcccaagctctgttctagcttttcatgagttttttccctgcattttagctcccatagtagcacctttcaaggggtgaatagaagaggacagagacagcaacaggccattggtaaaccagattgccaatttctcatcagacagaatgagcacagaccccgagtgagtggctctagatgcgaatgacctaaaattttcaggaggacttcatggagcttaaaaggttcttcagaacttctgtgtaattaagttagatattaacactgtttaatctgtatagacctgtaaaatatttttagtacagtaattaattccagagtttgtgaactatccaaagtaaagcatacaacaaagtactgtggcctcatcatatatccttatttcctgtttatgagcacctagctcttaatagtgagattgtagtcaagagagtattttatcatcatgccatgtagttgcctcttgccttagtttacctattttaaaaaacccggctcactaatagtttcacttcaggcatgtcatcagaatgaaagatcagatatacaaagtgctgtgcttgaaaactgtgtgttcccttagtgcctggttagataatacagggcttattttctggcagagtggtgttgagtctcctttgatgttagccagaactgggtggagtttcttaagctccagtcagattggctcaagcagggcaccatgcagtggtgaatttgttttcagtccctccctttgccaaaaagcttttttttttttttttaataaacctcaacccaattataaatgagaatacttgatatatgaaataatatgaaatgatagttgttcatattcacactgagggtcttagggggtttatttatagctaactgaaatgatgcagctgaattacaagtagctgatagaataatcaacctcagtaaacatttaacataacactctcattttacagattagagaactcagccctgaaaggtgactcattcaaggccacagtgagtgtcagattaaactggtgcttcagtaaagcatacagacttctgtacccagctttcaaattctcttgactcttactcacaaatctatttaaagttaactttattatctgtatggatagaagaggaatagtataaatggtcaattggtcagtgagaggttttttttttagagtaaatgcttctcattcacaagggttcattttttgatcctcctgaacatccagatttgaaaataatagtgtcatatccttttatccataaaatatgtaactaagcatttaaggcataaccgaatagtaagtaacttcaagtgattctgtgtgagatgaaattcatacatgaatttattaaaattaattttggaatacttgaaccagtttaacatctatagagcatttaaagagtgtattgtacttatacatgtttcagaataaaataactataaaattggataatcgctttaatttattgaaaactggggatttctgggaaaaaaaaaacaacagtactttaacttgaaagatgacactagcattacctttctaggatcattttccataagggggtgtgtgtgtgtattttaaaatcatattctatttatgtggtgacaagtaaagaatagcttaactgttgatgaaatacagatgctaagtggctagctagatgtgctcatagcttcatgaccttcccactttccaattgtataattttctatcagttttaccctcttaggctgaatttcagctactgttcatattccatgaaccacatgcagcccaggaagtcatctgagagtgtgtggctgggggcggggtgggggtgctgagggttggataggggaaagattacaatggataaaagctgccctttgataatctgcattctgataaatgatatttaaaatgtattggtgtttttgactgtatttttaccctgtgccttaaatgaggaaaagatttgagtagattgcatcttatgtcattatgtatttctggggaaaattaaattttggatttttatggtatgttgttaaggatggcacagatgtccttttaagttctctttgaccatgaaactgatgcaggatttttgctccttagctcaactaggtccaggttcttatctcaggagcggaagaattaggcacgtggacatcaaagagtgagtggagtagaatctattaatcgaaaggaaagctcttagcaaaaagagagaacatggtaggtggttctactacctgaagacaggaaagttccgtaatatggctgagcctggggctctttattggttcagaatgggagtgtgtggtcattggtttgtgagtatgcaaaaaaggtcaaagcgaagacaccactccaaggtgggcaggacagtgtagaaaaccaattaggaaagggtaggtacaggttaaataggtgaaggatggggatcaatcatgccaaacgggaaggcaggttcttaatccgatctcaggatttacccaggacagtttccggattaaagttcgggtttcactgaggacccgcccctgtctgcctagacatttgtttgcctcttgcctctatcaaaactagttacagacgtcctttttagtttttggttcataacagctcccaaaggataactactaataatagttgtcagagatagaatagggaaatggcataaccgaatagtaaaagcaactgaatagttgcttttcatggaaccctttgacattataatctgttaggcttttaaaagctctttaatgaactcatttctcagcattttccctgtcatgatctggagttacaataatactttatatgtaaagtaggctggacgagcatagaatagggcttcccacccacattcgtctgttgtaaatgggtcacaggtgtgccactactactataggaacttttttttttttttttgagacggagtcttgctctgttacgtaggctggagtgcagtggcgtgatcttggctcactgcagcctccacctcctgggttcaagcaattttcctgcctcagcctcctgagtagctgggattacaggtgcataccatctaaataataaaaatcagtgcccagctagttattctgtttttgtatttttagtagagatagggttttactgtgttggccaggctggtctcaatctcctggcttcaagtgatccacccgccttggcctcccaaagtgctgggagattacaggctgggattaccaagtccagttcctactataggaaccattgaattcctatttatggttccttcagaaaagctgctaaatcctgaattcggcagtggttattcaaatagtggaatttataattccagtagtgtgagatggcatttgctgtggacaacagctctgtcatgccacaggagcccctttggcagcaaagctatcagtttttgtcacgagccccacactacttgttttagtcaggattctcttagagggacagaactaataggatatatctccaaaggagagtttattaagtattgatttacgtgatcacaaggtcccacagtaggctgtctgcaagctgagaagcaaggagagccaatccgagtccccaaaatgaagaacttggagtccgatgttcgagggcaggaagcatccagcacgggagaaagatataggctgggaggctaggcccatctcttcatgtttttcttcctgctctatattcgctggtggctgattagatggtgcccacccagttaagggtgggtctgccttccccagcccactgactcaaatgttaatctcctttggcaacaccctcacagatacacccaggatcaatattgcatccttcagtccaatcaagttgacagtattaacattacaagtccactccttgtcaacttgaacccatatacatctgagatcgtatgtaatcttaaaataaagacaataataaggtcataattacacctaatgtaataaaactatccttcatacaaccagaaacacaccaatccccaacccaaatactattacataaagttaataatacttaaatgctgttatgaaatcaataaatcttatgtcacatgataaaggaaaaggaaatataaagtgaagatattagtacatgtgtatacatacacaaacatgtttttaacaaatgaaggaggaaatactcatggcagttacagtcctcatttctgcagctggtcacgtggtcatagctggtattgatgactaccttcttctacccattctgtattaactttgccttccccaaatacctcagcaggtcatgggtttttttcctggtggagtgatccaaaccttcattcctgaatggtccggatcatttgtagtcctgcctggatttggctgttgtggttttgcattgacagtaatcacagggcatggtaatacgaagagatgccctaatgggtctcatgtattccatgcatactcttccttacttccgttgtgaagttgtagactgatttcatcttgatagtctgggtcagtcaccttagccaacactgtaactccccctctgagcctgttgacttaaagggaggaggagcccaaagtgtccaggtgacaatcttaacttccagtttaatggaatcattgttgtgtctcctggtggcagcattcttccctctggaattaagacctctaggccagcagaacataatgttgcaggagaggaagcaaaaattttgctagtggatcactaggggtgatggtgagtggtgccacttccagttccacccctcgattcctggacctgtgaatcctggctatgggagaaacagtaccttatattggacgctgattcagaggatacacggccttctggaggactttcccacagttctgcaaagtattgtcacctagttggcgttgtaattgtgacttcaataggccattccactgttctgtcaatccagctgctttaggatgatggagagcatggtaagaccagtgaattccatgagcatgagcctactgccgcacttctttagctgtaaagtgagtgccttggtcagaggcaatgctgcgtggcataccatgatggtggataaggcattccatgagtcagctgggtgcggtggctcacgcctgtaatcccagcactttgggaggccgaggcaggcagatcacttgaagtcaggagttcaagaccagcctggccaacatggtgaaaccctgtctctactgaaaatacaaaaattagctgggtgtggtggcgggtgcctgtaatcctagctacttgggaggcggaggcaggagaatcacttgaacccgggaggcggatgttgcaatgagccaagattgtgccactgcactccagcctgggcaacagagtgagaccccttctcaaaacaacaacaacaacaacaacaacaaaccaaaaaaacattccacaaatggtagtcttggtagaagcattgcatacaggataggcgaacccatatccagagtaagtgtctatttgagtgaggacaatcctctgccctttccatgatggaagaggtccaatataatcaatccgccaccaggtagctggctgatcacccaaggaatggtgacatactgagggcttggtgtcggtctctgctgctggcaaattaggcactcagcagtggccgtagccaggtcagccttggtgagtggaagtccatgttgctgagcccaagcattacttccatccctgccaccatggccactttgttggccatgggcgatggcaggggaaagaggctgagtggtgtccacaaaatgggtcatcctatccactagattattaaacccctcctccgctgaggtcacttgttggtgagcactcacatgggatacaaatatcttgtctttgaccactcagagaggtccatccacatacctcttccccaaatttgtcaccaagtttccaatcatgctccttccaagtccctgaccagccaaaccattggctacagcccatgaatgagtatataatcacacatctggccatttctccttccattcaaagtgcacaaccaggtgcactgctcgaagttctgcccactgggaagatttcccttcattgttgtccttcagggatgtcctagaaaggggttgtagtgctgcagctctccactttcgggtgttgtctgcatatgatgcagaaccgtctgtgaagcaggccctaatcttcttttcctctgtcagctgatcatagggaactccccatgaggccatcagtgcaggctgggagagagaaggcagggtggcaggagtggaggccatgggcatttgagccacttcctcatgtaatttacttgtgccttcaggacgtgcttgagcccgatcacgtatataccacttccatttgatgatggaatgctgctgtgcacaatccactgtatggctagatgggtctgaaagcacccagctcatgataggcagggcagttcaggtcgcatggtgacttgatgacccatagtcaaacattcaatttccactaaagcccagtaacaggccaagagctgactctcaaaaggagagtagttagctgtaatcagcactttgggaggctgaggtgggcggatcacaaggtcaagagatcgagaccatcctggccaacatggtgaaaccccatctttactaaaaatacaaaaattagctggatgtggtggcacgcacctgtattcccagctacttgggaggctgaggcaggagaatcgcttgaacctgggaggtggaggttgcattgagccgagatcgcaccactgcactccagtttggcaacagagtgacactgcgtctcaaaaaaaaaaaaaaaggagagtagttatctgtagaagatggcagggccttgctccaaaatcctagaagtctccattgcgattcacctatgggagcctgccaaagactccaaacaacatccccatctgccactgacacattaagcaccattggatctgctgggtcatatggcccaggtggcagagcagcttgcacagcagcctggacctgttgcagagccttctcctgttctggaccccactcaaaactggcagcctttcaggtcactcagtaaatgggccggagtaatacacccaaatgaggaacgtgttgcttccaaaatccaaatatgcccactaggcattgtgcctctttcttggttgtgggagagaccaaacacaacaacttatcctttaacttaaagggaatatctcaacaggtcccacaacactagatccctagaaattttactgagacagaaggtccctgaattttagtcggatttatttctcatcctctggcatgcaaatgtcacaccaataagtccagtgtgtttgctatttcttgatcactggatccagtcagcataatgtcatcaatgtaatggaccagtgtgatatcttgcggaagcgaaaagcgatcaagatctctccaaataagattatgacacaaagccggagagttgatatacccctgaggtaggacagtaaaggtatattgctggccttgccagctgaaggcagattgcttctgatgggccttatggacaggaatagagaaaaaggcatttgcagagtcagtggctgcatagcaggtaccaggagatgtgttaatttgctcaagcaatgaaaccacatctggtaacagcagcagcaattggagtcaccacttggttaagcttatgataatccactatcattctccaggatccatctgtcttctgcacaggccaaatgagagagttaatggggatgtggtgggaatcaccacttctgcatctttcaagtccttgatggtggcactgatctctgcataccttccagggatgtgatattgtttttgatttactatttttttaggtagaggcaactctaagggcttctatttggcctttcccaccatgatagccctcaacctagcagtcagggagccagtgtgggggttttgccagctgctaagtatgtctatgccaattatgcattctggcactggggtaatgaccacaggatgagtccagggacccactgggcccactgtaagtcagacctaagctaaaacttcattaattacctgacttccatgagcccctagtttaactggaagaccacagtgatgttttaagtcccctggagtcatcatcagcccagagccagtgtccagtagtccccaaagtgaaaggttggatggaggtctccttggggaaggatgggagaaagattcactgcataaattgtcagtaaagtagtggggtcctttctcaagggtacctggcctccccttcattcaaggggttctgggtctgtaaactggctgaagtctggaaatggattgagtgaggggccatgattctctttttataattcaaattagtcttttgtccattcgacctagaagttttgtgtttgtataaattaagtgggaatgcagtaggcttcctgtccgtttcacttctaggaataccgtgattaattagccaatgccagagctctacatgagtcagactattctgattgtcactttgcctctgctgtccattacggtagctacgcccaccttgcctttgatggttgagtgctgctacttggcccctgccaccttgggatccagttattcccctcgtatttcaattttgtaattgagtgactgcggttctcaccattaggtctgacatgcagagaagagcaattacagggctcttcaaagattcaagtgctgccctcacaaatctatttcacaaggcattggtcaagggtatatcttctggaccctcccagctgggatgagtaggtctaaagtgagtaatccactccaccacctcaatctccctaagcttttggatgccttcctctacattaaaccaagagatatcaggcatttccagctccctcacagtgggccatcttttaatgcatatttcagctaaccaagcaaataaactattagaaccttattttaactccccgagctgcaacattaaatgcagagtccctacttagtgggcccaaatcaataaattcagcctgatccaactctatgttccttccaccattatcccatacccttaatacccattcccatgcctgttctccagattgctgtttatataaattagagaacagttcttttttttttcttagagggagtctcgttctgttgccaggttagagtgcagtggcacaatctcagctcactgcaacctccgcctcccgggttcatgcaattctcctgcctcagcctgccgagtagctgggattacaggggtgcaccaccacgcccggctaattttttgtatttttagtagagacagggtttcactatgttggccagactggtcttgaactcctgacctcgtgatccgcccacctcggcctcacaaagtattgggattacaggcgtgagccaccgtgcctggccgagaacagttctttttgagtgtagcgcacctcctcctgggtcacactctcaacctcacctctagggacctgtgggacttgagttataggtctagaagcaaatgggtgttgcaggtaccttctaaggagaatcaacattatcttgcctggcaactgcctgagaggaggccatgactcttgcctcaggcagctcagggtttatgtccgtagacaaagatggaaaggttgatggcggggatggggggttatgctgccactatgggggatggggaagctgttccttctggcaaaaaaagttcaccagagtttataaactcagtgttcccagcttcatcagggtcctcccacacatccccattccaagtttctgggtctcattcttttccaatcaatgccctcactttagcagtagacacctcaggtggctgtgcatgcatcttttgttgcaggtcagccactcgcatgataagagcttatgtctgtttttccacaatttcagctctttctcaacaggagctaagactctcactcagggcaatcttagcagatttgagactcagtatctgcttctgaagccaggaaacagaatccctgagttcatcattttctttcatcactttgttcactgaacttaggagcaaccaaccagcttcattatgttcgttggttttccacatatggtcaaaggtattatgtatagagtcactaaagtccttacctttcatgagcagtgaatcaggagtgtcaaatgcatttattttgcataactctctaaatagttcacgccaaggactatgaatgttctccatgctattagaagtagagtcctcagcatttttggatcaatcatattaagcagccaactccagaaacccccaaaccaacaaaagaactccatccttaacattctgttcctctggaaccactcctggtaccagagtctgtgttagtctggggtcagagttttcttagaggaacagaactaataggatatatatgtatgtttataaaaagaggaatttagtaagtattgacttacacaatcacagggtcccacaaaaggctgtctgcaagctgaggagcgaggaaagccagtccaagtcccaaaactgaagaacgtggagtccgatgttcgagggcagaaagtatccagcacaggagaaagatgtagactgggaggctaggcccctcttgcctcttcatatttttctgcctgctttatgttcgctggtggctgattagatggtgcccacccaattaagggtgtgtctgccttccccagcccactgactcaaatgttaatctcctttggcaacaccctcacagacacacccaggatcaatgttgcatcctttattccaatcaagttgatgctcagtgttaaccatcacactaataaaagtgtaattcttgctgaccaaactgagctgtgggctaagatgggagtggaaacagctctagacaaaagggccatagactcttcctggtcttaaccaaagctcaagcagatttcgagaatgcaaagcttctcaacttgtgttctacagtttgttgatgtccagtgctttggaatggctgatcataacagttttgtacaatttaatatgttttttttttttttttttttgagaaggagtctcactctgtcacccaggctggagtgcagtggcgcgatctctgctcactgcaacctccacctcctgggttcaagcgattctcctgcctcagcctcccgagcagctgggattacaggtgcccaccaccatgcttggctaatattttgtatttttagtagagaggaggtttcaccatgttaaccaggatggtctcgatcttctgactttgtgatctgcctacgtcagcctcccaaagtgctgggattacaggtgtgagccattgcgcccggcccatatttacttttttatggagaagattcaacagcttctttatgacatctattattaaactctctcagtgcgtgtctttctttgacataatttgctcttgtcgctatttttcttctaacagactgattaaattggatttaactttattatagttattagatatttctaaatggaattaaatttatttatttatttatttatttatttatttatttatttttggccttaatgttaacagccagagtgtgatttattttttacttatttatttaaaagtttttaaatttaatttttgttttttgagacaaattttctgtcacccaggctggagtacagtggtgcaatctcggctcactgcaacctccacctcccaggttccagtgattctcatgcctcagcctcctaactgggaccacaagtatgtgataccacgcccagctaatttttgtgtttttagtagaaatggggtttcaccgtgttggccaggctggtctcgaactcctggcctcaagtgatccagctgcctcaggctctcaaattgttggggttacaggcatgagcctctgtaccctatttattttttatttttatttttaaaaattttttgagacagggtctcactctgtcacccaggctggagtacagtggtgccatcacaatcatggctcactgcagtcttaaactcccgggttcaagcgattgtgacacttcagcttcctgagtagctaggactataagtgtatgccaccgtacccagctaatttttttttagtttttgtagaggcagggtctcagtatgttgcctagctggtcttgaattcctagtctcaagtaatcctcccacttcagcctctgaaagtgctgggattacaggtgtgaaccaccacgcctggctcagagtgtgattttttttttcttttttttttctttttgagactagagtcttgctctgtcacccaggctagagtgcagtgatgcaatcgtggctccacacctggagttgtggtggctattcacagacgtgatcattgcacactatagcttggaactcctagttacaatctccctgccccagcctcctgaaaggctagaactacaggtgcatgccaccacatctgggtcacacgtatcttttgacattttttgagacctaaatgaacttcatcaaattccaagtagtatgatgacagagtcgcatgaacctgggaggtggaggttccggtgagctgagatggtgccgttgcactccagcctgggcaacaagagtgaaactctgtctgaaaaaaataaaaaataaaaagatatgatttaggaactcattagtatagtcacaggaaatttaaatatcacatttgctttaagaaaagtaagcaggctgggcgcaggggctcacacctgtaatcctggcactttgggaggccgaggtgggtggatcactttgaggtcaggagttcgagaccagcctaaccaacatggtggcaccctgtctctactaaaaatgcaaaaattagctgggtgtggcggtgcgtacctgtaatcccagctactagagaggctgaggcaggaggatcacttgaacctgggaggtggaggttgcagtgaggcaagactctgcctcaaaaagaaaagaaatcagagaaacagctcttttctactacatttttgtataatggtactacctagaatttgaaaagataatcatttaaaattattgatgaggaattaaggttgttatttcaaataggaaaactcataaaattaggcacatggaagaaggcttaaatttatttgaaatttttagattttatttggaagtctatataaatataattgattatttaatatctttccaaatcttggtattgtatttttttcttagataatataaagaatatgtaatgaatgttttcactaagctccatataggtagagacaaactatctccagcattcccagtactgaacacatactatcttttttttctagacacttgcctagaagatgtagatcttgcccctggccttaattatcctgtctgtacttatttgggtatcggatcttgattcttaagcctctgtgccaccactctaatatatagcaacaccctttgcttgttggatttgggaattgggggtacgatgacttctgatttttcagggtctggaagtatttgctttgtacatgttttgtaatcatggtagcctcacagcatgtaagtgggaggagaggagtgtgtgggaacaaagatgaagataaaataagaaggaaggaagataggaccatattccttgctttaattctatttctttttcctaagtacatttgttggagagaggtagacggtggataacagcttgaaaggaaagcctgaaaattaagtggcttgaatcatagtatatttttactttttcaagtttgggttggagaaagactgtgtattagttgagattcttccattgtaaacaacagaaatagattggctaaattaggcaaaagaaagatgaaggccgctcacttagacttgaagtagtcaaccagggcaactaaatagctgtcactcatggacttttcttccagcgtgtagtcaataaatgatcctttccaactgtcttcttcttgacttctgattgacccaactctagtcatgtcccaaaccctataggggtagggattggtttgtattaggggagataggaagaatagatttctggacaaacacaagtagtggccattacattgtgcaactaaggatctgtttgacttgtatttaccttgtcaacaacatagcttatatgtcaacttatcctatggagtctcttggagtttctgttagactttttgaaagcaggcgtagtaccttgcacactttatttcctattatgccctgcatttgaatggtgcccaatttattgcaggcctttggctcttttttttttttttttttttttttttgatgggggagtcggagacttcctctgtcgcccatgctggagtgcagtggcgcaacctcggttcactgtagcctccatctcccgggttcaagcgattctcgtacctcagcctcacaagtagctgggattataggtgtccaccaccatgccttgctaatttttgcatttttagtagagatggggtttcaccatgttggccaggctggtcttgaactcctggtctcaagtgatcctcctgcctcggcctcccaaagtgctgggattacaggtgtgagccactgcacctggcccctttggctctttttactacattatttctgtattttctaggctattcacctatggtttgcttatagatttactttttttttttttttaaactttattttaggttcaagggtatatgtgaaggtttgttgcataggtaaacacatgtcacaagggtttgttgtacagattatttcaattaagtctagtacccaatagttatcttttctgctcctttccctcctcccaccctccaccctccaggagaccccagtgtctgcagtttctttgtattcgtaagttatcatttagcttccacttacaagtaagaacatgtggtatttggttttctgttcctgcgtcagtttgctgcggataatatcctcctgcttcccatctatgttcccacaaaggacatgatctcgttcttttttatggctgccagtagatttacttaactgcagattatgtaattaagaagctggtagtctgtaaaaatggtaatatacgtgactacagagagggaccatctcccttagctaattgagggaaacgtgtctttttttttttatgctggcagggctaagtagtttggttgacaggactatccacaagtgattcatgaagaagcaggtactcactccaagataagatccatactcacagtctttggtcaagaaagttgatttcatttgtccgatagtaatgtaactatgtaaagacctgatttgaatcttactggctatagctttggatatgttgattgtggggtttttttacacctcacttttcttataaatagaaaggacacaattgcaattgctttgtcctgccaccaccacctccctccacccccagaaatgtgagaaaagagtaactagcggtgagttaccttgggtcagactgtccatttcttagctttatttttctcatctttcaaatgagggagcctcttctagctgtaaaatcttagattttgattcttttgtttgtttcaaacaattgacaagagtttctagaaatgtttttccttttgcagtgctcgttacatgaaagatctttttcctcttcaccaggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaaggtaagtatttaaaccagactgcttatatatgttcagaaagcaggttagggattatgcctttggtataatcttggaaactgagaattgagctgagtttttttagtgtaggctagtaactttatgtttctttgttagataccgaggaggtagacttaccaccctttgagtgagcgttcatgagtctgtggatgacttttaaccctaatgtttcttctctaatgtttcaacaaccatataatcttcttcttaatttcctaaattaaactgtctactgtgccttttctctgaaagtagctttgaaaagttaaataaaattctgcggttatatcagaacttcatttagactggaatcagatgccatttgttgtctttggagtcatcccacctcaggattaaagcataattaaagcctttaagagaaatttgccattttcctggatcagatgtgctaataattggctgagtatttttgtatctgtgttcatgagggaattggtctgtagttttctcataatgtcttctgtccagttttagaattgaggtcacgccgacttcataaaatgaattgggaagtgttcccttctttctcttttctagaatagtttgcatagaattgatattttttcttcttttcagtgtttgatagaattcatcaataaagctatctgggcctggaattttctgtcggatttttaaactaggaatttagtttctttcagagatcatagaactattccagttatctgtttcttaagttagctttggtagtttgtatctttcaaggaattccttggtccctttcctggcataaatgttgcagattaatggagatatgcttttaatgtctgtaggatctattatgtcccctttttcatttcttatactagtaatttgtgatgtttctttctttctttctttctttctttctttgataagtctaggtagaggtttatcaattgtattgaaagatccagcttttggtttcattaatttttttctattgtctttctgtttttaatttcttctcatatctttgttttttcctttcttctgtttacttaagttgatttattctttttctggtttcttaaggtgacagcttaaatcaggttttgatctgagacatttcttttctaatgtaattacttaatgttataaattaccctctaatcaccattttagctgtgtcccatggattttgatatgttgtatttttattttcattcatttaaaaatatttaaaaatatttcctttgtgaattcctctttgtgtctgcctttaagattttatctttttttttttttttttttagcagtttaaatatgttgtgtttagatgatattttggaagttttcttcttgggcttttctgagcttcttgatctgtgcttttgaagtggttaagtcagctgggaaatttttggccattatcttttaaaatatttcttctgccccattctttttcttttctcctgggattccaattatatttttgttaaattgttggatagtgtcctgtatctcttggatgcattgttggtttttttctctctttatttctgtttgtgttttactttgggtactttcttttgacctatcttccaattccctgatcttttcatagttgtgttgaatctaatgatgagctttcagtggcattatctactttagcattttttatgtttttaatttctagcatttctgtttgcctctcttataagcttccttatttctgtcaaaatttcccatctgttcacctatgttttccaccttttctactgtagactttaacatattaatcatagttgttttaaatctctgtgtgataatttgaaaatctgggtcatctctcagtctgattgctctgtgtgtgtgtgtgtgtgtgtgtgtgtgtgtgtgtcttagtttttgattgaatgctggatctcacatgtaaaatagtaggctgaggccaaaaggtgttatggttggaaataggcatgtctcttgggtttagtcattttaacaggagctgagctagttttgggttttgtcattaccgtaattgccttcagtgtactactgtcttcaatccctttaattctatgcttagagtggggactgaggccctggaaggtatttctttaatgtgcttgctccactctttcagccttccctgtgtacccgtgcctcagaggggtccttgtccatgctcttttctctcttatcggaagagttctagccaggtggcaggcagagtttgtttttttattgtcccattttgtgcttaatcctgtgcttaatctcacggtttgggtctttctcaacgttattatccttttcacagtagtagcgtcttctcatggtattggtgtaggatcctggatgaggagtttttcttgctcctctctcaggtttataaagtatgtttctattactctttccctagctacagccggtcttcttgtgtgctctggggttgacagggtttgtactccttccccaggagagaaagatcccagtgggaggggttcatgcttttcccttaatggtggtggccttctccaggtctgtaccatggagggaggctctgtctggtccctcaccctgcttccaatctttcctgtgagcatgcggcagacatctgtgaagacaatcctgcaaatgagtgtgaattccctttgtgtctgtggatttgaggggccccatagtctcatgctagccttcatttacctttgacaaatcactacaatttttacttgaatttttcttacctgcttgtagggtacccaatgtctcttctgcacatgctctgatacaggagagctggtgttcacctcccatatttcctggaggggcttgtttttctttggatttcatactactaggtggctttccaattaattcaagttttttgtagttgatatggctgtttcttgttgttagggtgggagtgacgttgcttttggctttctacagccaagtggaagaagaaaacctgcttccttaatatatgtttaatttgtgtgttggggagggggggcagaccacaactcatttaaaaaagtaccgagagttctaattatatccatataaatatttactccagaccaggtgcagtggctcacgcctgtaatcccagcactttgggagaccaaggcaggtggctcacctgaggtcaggagtttgagaccagcctggccaacatggtgaaaccatacctctactaaaaatacaaaaattagccaggggtaatggtgtgcacctgtaatcccaggtactcaggaggctgaggtacaagaatcacttgaacctgggaggcggaggtggcagtgagtggagagcgtgccactgcactccagcctgggcgagagaacgagactctgtctcaaaaaaaaaaaaaaaaaagaaaagaaaaaaagttgctatcattgcttacaaaagtatcttgatgttgcaaaagcttatgttgagaagtaaagttcatattttatttttatcctttaattcaattttccagaaactcatacattttttgaacaggctaaaaaatacacatgtacaaaatccaattggtccaaagggatgtacggtaaaacaaattctcccaatccctacaccctagccagacagttctccttcctggagtaaccactcgccaatttctggagtagtctttctgagttaatgaactttttttttttttttttgagatggagtcccgctctattgcacaggctggagtgcagtggcacgatctctgctcactgcatcctccgcctcccaggttcaagcgatcctcctgcctcaacaccccagtagctgggattacaggcctgcaccaccatgcctggctaatttttgtatttttagtagagatggggtttcgccctgttggccaggctggtctcaaactcctgacctcaggtgatccacttgccttggcctcccaaagtgctgggattacaggcatgagccaccatttacatatcaaaagtagcagggaggatttaattttttataaataaaataatgtcttaaaaactttcctcctcttgggccaagttaatgttacatggatcaaataactcaagatgaagcacaagaaaatctactgctaccacctcactgtccttatccacctaggctcattcccagatgatggaaacaatgcacagttaaaggaaattagaaaacgaaaagcagctagcttctttcacctatgactgatgagggtaagttaatattaggatgggaagagcatctcaaccatgactagttgctaccatatttacatcttatcattcctttcttcatactaggttttctttgtttatgttagtcagtcaaagaacaaatgtctccaccgtgcattatggattaagagagaatagattttcccgttttccattaaggaatccaaattttttggagtaaatatttgtttttcttttgtgctgggattataggtgtgagccactgtgcctggcttttttacattattaaatgaagaaaaatgaagaaatgaagaaaaatggatgccctttaaagttttttttggtttaagtttttaattttttgttgctaccaaagatttttttaaagattaggaaacaaaaaagaaggaaccaaatcaggactgttgtaaggtggttgcctaatgatttctcatcaaaactgtcacaaattatctttgttgatgaaaggaatgaacaggagcattgtcctggtggagaaggactctctgatgaagctttcctggctgtttttctgctaaagcattggctgactttctcaaaacaccctcataataagatgttgtcattctttggctctccagaaagtcaacagacaaagtgctttgagcatcctaaaaaactcttgtgtttgctcttgactgatccacttttgctttgactacagcacttacgcctcttggtagccattgctttgattgtgctttgtctttaggattatactggtaaaaccatatttcatctcctgttacaattcttcaaagaaatgcttcaggatcttgatcccacttgtttaaaatttacatcgaaagctctgctctttgcagctcatctggatgcaaccattttggcaccagttgagtggaaagtttgctcaattttaatttatcagccaaaattgtataaactgaaccaattgagatgtctgtggtattggctattgtttctgctaattgtcaatcctcttcaattagatcattcttttttcctctcaaattgatattggtggtctgccacggtgggcttcatcttcaacatcatctcctcctttattttttttctttttttgagacagagtcttactacattgcccaaattagagtatagtgactatttacaggtgtaaccatagcacactacagccttgaactcctgggctcaagtgatcctcctgtctcagccttccaagtagctgggactataggtgcggaccactgcatctggctgatgtcttaaaacaagttattcatgtgtaaactactgatttgtttggggcattgtccccataaactttacacaaagcatcagtgatttcaccattctttcatccaagcttcaccataaatttaccatttgcttttgcttcaattttagcagaattcatgttgctttattaggggctcttttcaaactgatgttttatcctttttagtgcttcaaactagatcctgttcagacgtgttataacaagttagtatgagctttttttttttttttttaagatggagtgtctctctgtcacccaggctggagtgcggtggcacagtctcggctcactgcaacctctacctcctgtgttcaagagattctcctgcctcagcctcctgagtagctgggcttataggcacatgctaccatgcccagctaatttttgtatttttagtagagatggggtttcgccatattggtcaggctggagtatgagttattttgatacaaaaaaactcccttgaaatccatgaataattttttcatagaatgcattttccacgaacttgttgaagataccatgtttaaagtttataattatagctgggcgtggtagtgtgcgcctgtagtccgagctacacaggaagctgaggtaggaggcaatcacttgagccccagaggtcgaggctgcagtgagccataaaagcaccactgtgctgcagcctgggtgacagagagagaccccgtctctaaaaataataataataataaagtttataattatgataggttgtaaattactacattttttccataccagcttcctaaaagttgtagaagtcttaacttaaaggaaggggtgatggctgtttggagacatcaaataagaaaaacgaaggaagccgccttatttagtcttgtagaaatctggtgcaattagtgagttctttatgaatggagacttctctgctgtgggtctgatttttatacattatcggactgatggtttttgccataatgacaggtttcatatttgtgtttttcctggagaacattctaaacaagatgttcttctgaatacatctttagaagtgatggaagggccctagacttcattaatgttttattatacatctaactttaagtttgattttgttcttagatgaggttcagtaaactactgctgattgctgacactttttttttttttgaagacagggtcttactgggcgcggtggttcacgcctataatcccagcactttgggaggctgaggcgggtggatcacctgaggtcaggagttcgagaccagcctggctaacatggtgaaaccctgtctctactaaaaacacaaaaaaattagctgggcgtggtggtgggcacctgtaatcccagctactcaggaggctgaggcaagagtaatcacttgaacccgggaggcagaggttgccgtgagccgagatcgtgccattgttgcactccagcctgggcaacaagagcgaaattccgtctcaaaaaaaaaaaagaaaagacagattctttccatgtcacctaggctggagtgcagtggcacaatcatagcttactgcaacatctaacgtaactcctgggctcaaacgttcctcctgcctcaggctcctgaatagcttggactacaggtgcgcgtgccttgcttatccttttatttttatagcgacagtcagactgtgttcctctggctggtctggaactcatggcctcaagcgatcctcctgccttagcctcccaaagcactgggattacaggtgtgagccaccacacccagcctagtgctctcgatatgttcttacaacaggcttagttaggccaaccagtggaagtttatcaaccattttcttgcctctagatatagaagggacggttgagtaggttacacataatagaactctttgaacaatggtgttttatttcctttaattcttacatgtccaccctaattgtcttcaacttataaaatgagaagtaagaaagcagggttgcttttatggcatttatgacaaagtaggaaaattgcttttttctctaagtatgatttctgccttcatgcctggcaacacaagaaccccccgacctttattccttttctttggatctactatactcatttccttttgcacttcaacttattcttgcttctacaagtattttatcttagcattgcctgtgtaaaccatctaaataccaatacctagaaataaaattggtgtcaaactcttcttctaaaatgcctatcaccttgggaaacaattctcaaatactttttcaggatatgtgtactacttgttttgcaccacggctgtaataagaaaaaaataaaaagaaaattatgtacttcctgacttttttccttaaaaaatggtgttttccttaattgttcattatcagcattatatggccctattttctaggtgagggagacaaaagatagaaccctttctcttagatgtgaatgacgaagcaaacatctgtgactcttgttctttcagatgatcatctagcacagtattgaccctcagacacaaatagcacatttatggaacaagtcacttaatttttctgttctctgtgtgattaaatagttcttcttctgaagtcgagaaaatgctttctcctcaacattccataaggcctttgaagctaaaagcttattcccatagaataagaagttaacacagggcaatggcctggctaagttttttgcatttttagtaaagacaaggtctcactgtgttgcctggactggactggttttgaactgctgggctcaagtgatcctcctgccttgacttcccatagtgctgggattacaggtgggagacaccgtaccctgccacacaccagcagtctgttttaacaagccataataggtgactcggatacacatgcatgattgagaaacactaatccatggaaaagggcctaagtgacaactattaatagatactgcagaatttctccttaatacactggtatttcttttgcagaaaattgcaaccagcttaattggccagtagagggcagtgttggcatgggtctgacagcaccagagggttcccttgcattgagacctggctgttttgcccaaggctgactcacagcacacatgccttctcaggttcttgctacttctctgccaagctgatttgcctgctgtgggaatctgacatctcctggggagagggaatcaacaaaataaagtaaatttgaatatctttatatctcagagaatgtgattagtttctaaaaaaaaaaagtgtgctattttcgatgctgtgtgtatttcactgagaaagttttcatttcatgaaatgggggttctctggggaagtcagtcagtgagaaaacacattatagcatcttttgaattaggacttttccagtaatgtgcagtatgattagggtccagtatgtcttatctggcagggaaatatacaagccttttttctacttgtcaaccttattgtttttagtgttgttacgttgtttttattctctcctgggcttatatttttagattgtgaggtgttgtatgtatagtagaatccagcttctcttcttcctttctaacctcttcttgctttcattttattttattctagtaaagtttcttgatcagcctacagttattctataggtggttgatagataaatttacagttggtcaacatatagttaataacagtgagaataacaatagctaataacagtgagaataacaattactatttagcactgtacagttgacatcctgtattactgcatttagtcccacttcccaggtgaagcttaagtattagaaatgagaaggttgcatttgatcatttagttaataatgacagcacaacctgaacccagatcttctaatctcacttttatttttattaaacaattaaaacaatattttttaaatagagatgtggtcttgctatattgcccaggttggtctcaaactcctggcctcaagcagcccttccgcctaggcctcccaaagtgctgggattacagacatgagctactggatcttctcattttaaacccctgttctggctgggcatggtggctcatgcctgtaatccccagcactttgagaggctgaagcaggcagatcacgaagtcaggagttcgagaccagcctgatcaacatggtgaaatctcatctctactaaaaatacaaaaaattagccaggcgtggtggtgctcaccagtaatcccagctactcagggggctggggcaagagagtcttgaacccagaaggtggaggttgcagtgagccaagatcgtgccactgcattcaagcctgggcgacagcgagactccgtctcaaaaaataaataaataaaataaacccctgttctttctgtgaaactatacctttttcatgaacacatactttctacttgatctagtatctcactgatagtttttaaaaactaaaaatccattttttaaattcaaatagaattattagatgtatgttcaggaaatgtaaaagaatcttgcttcatttcaatacagagcacaaactgagggactctgccactaattcacatgagtttgtaaaatatttcactttcctagacaactgtttcacatctactctctgaaacttctggcacttgctctcctgttcatattcataagtcatattcataaattaattggcttaatcagaacagaacttccacatggtcccaccacatatttcctcctcacctatgttcatctatgcccttattgtctgctctttttctgttatgggtgaactgttcatgctgtcactcaggccactgctgtcacagttacctcttctgtctcctgcatcatcagttcttttctttcaattgggtcattcaccagcatcaaacatactataatttttttatcattaaaaaaaaaatcctgtctgaatctcacatccatctcatctatctttttgctttgctttctttttttttttttttgagacggagtcttgctatgtcacccaggctggagtgcagtggcgcgatcttggctcactgcaagctccgcctcccgggttcacgccattctcctgcctcagcctcctgagtagctgggactacaggcgtgtgccgccacgcccggctaattttttgtatttttagtagagacggggtttcaccgtgttagccaggatggtctcaatctcctgacctcgtgatccgcccaccgtagcctcccaaagtgctgggattacaggcgtgagccaccgtgcccggcctgccttcttttaaagagacgtttctactacctgtcaccaattcctttccttccatttcctcttgaattcactctcatcagactttaacatatgcatgaccccaaaacttctcttacctaaagtataaggccttgatgttgccaaggacaaatccagtattactccaggggttttgcctgagcaactgaaaggaaagaattgccatcatctgagatggggaaagctacagaaggagtaggatttgaagggaagagaagaaatttagcttgggatatgttcacatttagttacctgctagtcatcgaaatggagaagatggatacacagataaggagtccggagtttggaggacggttctgggctggaggttgatgttatataaagcttttgctagagttgttgttctaaaatcctttaagattggatttagatgtaactttccagaacattccctgacttctgttccctttcccttctagacctcccactacccccacaccctgccagcctttcttttcatcttcctcttggtaagtgcttttcttccctgaactttcctctttcctctgtggtacttgtaagatcataattaagctatttgttatcttacacttattaacatgctctagcacaggaataatattttgtttactgccatatttcatggagaatgacacatttagcgaaagcaggatggcacagcataatcaaagtttactagcgacctcaagtttctcagggttaagaaatcaaaggttacagtgacaagtgaccggagagaatcatggagaagcagatcaagtgaaattatgaagaatctcatggtttgtgagaaactgagggcgcaggggtactgagaaacctggccagatctgcattagagaccactgctcttggcacatgatagatgtgtaatcattgcttattacactgaattgaaatggtttttgtttgtcagtttattcaggtttgggttgtgttaatgtacagactaacaaacaattgtgtctccaaaatggtagatatttatttagggtaggtgtacttggtctaatcctaaaccctcttaatagtctcatgatcatatttagggaagtttatatatatgcataaaaaattagtgtgacatttttgcaaaaatagttattttctgactttgatttgaaaacagacttttatctcataactaatagttctttttggggaaaaaaaatatcgtaccaaaatgtatagttcataataatagtaccctagtctgaaagaagagcaggggaccgggacccgggggctcaagcctgtaatctcagcacttgggaggccgaggcagatggatcacctgaggtcaggagtttgagaccagcctggccaacatggcaaaaccccgcctctactaaaaatacaaaaattagccaggtgtggtggcatgcgcctgtaatcccggctgctcaggaggctgagaaacgagaattgcttgaacccaggaggtggaggttgcagtgagctgagattgtgccactgcactccagcctgggcgacagagtgactccatctcaaaaaaaatacaaaaaaaccccccaaaaaacaaaaaacaaagcaacaaaaaaaccacttcattgctaaaaatattctgcaagcaagccaggatggtggtatgtacctgtagccctgcccgagctacttaataggaaggaggattgcttaagcctaggagtttgagtccagcctgggtaacatagcaagaccccaaagaccccacctcttaaataatattctgcaagcaaatgactttgttaaacttcacactgcaagaacagagccaagaacctaccatgtaccctttacttggatttatcattactgttttgcacatttgctttatcattcttgttatatttacatatagttccttccccttggattatttgagaacaaactgcagaactcacacctctttccccgaagaactaggcattagcacattacaagaatacgatgatagagatcagaagttaaatgctgatgagatattcctgtctaatccacgaaccttatttcattgtcatcagttgtcccaacagattcaacacattcctttctcatttttttcttcttgtctgcaattaaatctggaatcacgttagttttcatgtctcttcagtcttctttaattggaacagttcctcaactcttctttgtctttcatgaccttaatattttgaatagtatgggcaagttattttttagaagtcccctaatttgggtttgcctggcatttcctcataattagattcaagttccacatttttggcagtagtactatgtaaatatgatgtgtcctaagtgcaccacatcaggaagcacatgatgtcactaaatcacattattggtgataataactttcatcacttgttagtgtctgcctgttttctttactgtaatttttttccaattaaaaaaaagcatttatttatttagagacagggccttactctgtcaccctagctggagtgcagtggcacaatcttggctccctgcagccttgacctccccaggctcaagcagtcttccagcctcagcctcccaagtagctgggactgcaggcatgcaccaccatgcctggttaatttttttttttgacaaagtcttgctctgttgcccagactggagtgcagtggcaccatcttggctcactgcaacctccgcctcccaggttcaggtgatcctcctgcctcagcctcccgagtagctgggattacaggcatgcaccaccatgcctggctaatttttgtatttttggtagagatggggtttcaccacgttggccaggctggtctcaaactcctgacctcaggtgattcacccacctctgcctcccaaagtgctgggattacaggcatgagccaccccccagcctaatttttatttttattttttaattttttttaagacggggtctcactttgtctcccagtctggagggcagtggcatgatctcggctcactgcaacctccgccttctgggttcaagtgattctcctgcctcagcctcctgagtagctgggattacaggtgcgtgccaccacacctggctaatttttgtatctttattagagacaggttttcaccatattggccaggctagtctcgaactcctgacctcatgtgatctgcctgcctcggtctcccaaagtgctgagccaccacccctggccacctggttaatttgtgtatttttttttttttaatagagacagggttttgtgatgttacccaggctggtcttgaactcctgggctcaagccatctgctctccccaccctcccaaagtgctaggattacaggcatgagccaccacgcccagcctctttactgtaaaatttatatttttctccttgtaatgaataagtaatttgtgaggagatattttgaggctatgtatgtatcctgtatctaatccaactttcacctactattttagtatctaagcaaatagcttttgaataattttctggtttccaagccagttgaaatgtgttctgctgcatcttatatgaaagtcacattttatgaatcagaaattcccttttgcacattttaggtcaaaaataccagggaggccgggcatggtgactcacacttgtaatcctagctctttgggaggcagaggcgggaagagtacttgaagccaggagtttgataccagccccagcaacacagcaagactgcatctctacaaagaaaaaaaaaataaaaaattaactgggtgtggtggtagtcttaactactcaggaggctgaggcaggaggaaaggcagggagaaagtaaacagatatgtgcaaatgagacttccattatgcatattattcgcaattaaatctcattatttatgcccttcactggaaaaaaaaattacctttaattgcacagatcatttataaaaagactgttggagttatgctccaaagcccacaatgacagagatagtgtgtcagagggacacaggagtcaactgaaagagttcccaatagccaacactggaaaaatttgagcaacaaaataaataaagtagcattgaattaaagctcagtggacgaggctgatcatggtggctcacgcctgtagtcccagctacttgggagactgaggcaggagtaccacttgagcccaggagtttgagaccagcctgagcaacttagtgagaccctgtctttatacaaatagaattgtctgggcgtggtggctcactcctgtaatcccagcactttgggaggccgaagcaggtggatcacctgaggtcaggagttagagaccagcctggccaacacggtgaaatcctgtttctactaaaaatacaaaaaattagccgggcatggtggcacatgcctgtagccccagctactcaggaggctgaggcatgagaatcgcttgaacctgggaggcagaggttgcagtgagctgagattgtgccactgcactccagcctgggtgacagagggagactcagtctcaaattaaataaataaataaataaataaataagccaactgtggcggtgcacacctgttgtcaccatatacttgggaggctgagggaggaggatcatttgaacccagcattttgaggttacagtgaggtgtgattataccactgcattccagcctgggcaacagagcaaaaccctctctcttaaaaattaagtcaaaatctttgccgggtgccatggctcatgcctgtaattctatcactttgggaggctgaggcaggcagatcacttgaggtcgggagtttgacatcagcctggccaatatggtgaaaacctgtctctaatgaagataaaaaaattagctgagagtggtggcgcacgcctgtagtcccagctaccagctacttgggatgttgagacaggagaattgcttgaacccgggagacagaggttgcagtgagccaagattgcgccactgcactccagtcttggcgatagagctagactctgtctcaaacaaaaaacaaagaaaactcccttcattttcatgtaatcttatttatttcctcaagaagggtagatcttttaagactttattctttgcagttacaaacatacaataaaaaatttagtggctttactttcatttgattccattttacaaatggaatcaaatcgtatgaattttaacttgctttttttagtttattatcttagaaaactttctgtcagtatatatcaagctttctttttaacttggtctaaagtagtggtcttaacttttggtcacatactcagaattctgataaattctgtctctttgtacattaagtttacatctaaaattttgtagcaaaagtttagttgtaaaacatgtaattttgagaatgttttacttttgccacataaaaataagttacctcattctgctaaatgtatccaaatgcttctaaatatatagcattttggtttccatcatctagtttaaaaatatacgaacaagctgttctttatcattggaaatttaaattcttcttttgagtccttgaacttttatttccataacatgtctcagacttttatcctaatgtaatatatttttatgcttaaaagttttttcttgattgtgctaatatgtttctgctactaaatatgtatgtaaacttaaattttaatttttaaagttcctgtgacaaaggttctgtgttttaacttggtccagaggaaatttatcagtctattgcatgtattatgttttttttaaatctcccttcattttcacttaatcctatttgtttcctcaagaagagtagagatgggctttactgtgttgaccaggctggtctcgaattcctggcctcaagtgatctgctcaccttggcttcccaaattgctgggattacaggcatgagccactgtgcccggccaacataggttgtaatttttgatgttattactatacaagttgaattttattggaaatgcttttcttatgagatgatggggtctgttatttttctcaattaaatcatgggtctgtggatcaatatttctttctctgatgaaataggattggcaatttttcctgtttttgtagctatcatagtgaagaaaccctaatcacataggtaaatatatgggaataaagcttttttttttttttgggagatggagtcttgctctgtcgcccagactggagtgcagtggcacgatctcagctcactgcaacctctgcctcccaggttcaagctattcttgtgcttcagcctctagagtagttgtgattcacacgccactatgcctggctaattttttgtattttagtagatatggggtttcaccgcattggccaggcaggtctcgaactcctgacctcaagtgatccacctgcctcagcctcccaaagtgctgggattataggcttgagccactgcacctggccaggttcttttttattattattattttttattacgagataaggactataggcgtgtgccaccacacccagctaatttatttatttatttatttatttttagagatggggtcacactatgttgcccaggctggtctcaaattcctggactcaagacacccctctgccttagcctccctaatagctgggactataggcataccctagggtgtcttggcctttatctatatttagctattagatacctgttatcttcctgtatcggtaacacgaagtgctctcatttcttttattactgtgtactattttacaatattataatctgttggtggacatttgttgtttttaagcagtgccatcataaacattctgtttatattcacttttttatacttttatgtctctttttgaactaaatacctaaaactgattgttgagttgagtattgcagaatttgataggctgccaaattgtctcataaaaaggttattcctatttacattcccccaaatgatgtaatgaaattacccttgtcaatgctggttatcaaattttaaaaggttttatcactgtaatagctgctcttataccactcgctggatatcagtttttgtaatttccattttcttataatatgcattctttaatgaagcaagtttttaaaaatatgcattctttcttgagcgaggaagaataaatcttataagcttattgtgtgaatgtgaaagggaatttacttatgccaaatgtgggatggagcatatttatggcatctctctggataagtaaaatgcagtttgtgaagacttagcagggtatatgttacatagcggctatttaatagaattctgttgtctttccttccttatttctttcttttatttaaattatattctggttttggactgccttgttcttttagattgttctctttggctgttcctcttaagtaacagaatgaatgatcttttcaacaagaagcttgtgtgaaagatttctgccttgtatttatgaggactaaggggttggacagcatgtttgtggtcttccaaagtaaaatcttgcattttttattttagtagcatatattgtagatattcacttattgtcttaggaataatatctctgaattcttcggtcagcaaggtgactgcagagctaggctggttgctaaaatgttagatatagtcagagactttcagaaaaagttgtacatccccaaattgatctatatagtcaatccccaaattgatctatatagtcttatatgcaattgcatataagatcccatcaagaattttagtataaatcaaaaactgattctaaaatttatatggaaaagcaaagaaacaaaacaaggccaggcgcagtgactcacacctgtaataccaacactttgggaggccaaggtgggaggattgcttgaggtcaggagtttgagagcagtctgggaaacatagggagaccccgtttttccaaaaaataataataatgaaaaattaggcaggcgtggtagcatgcacctgtggtcccagctacttgggaggctgaggcgggaggattgcttgagcctgagcagtcgaggctccagtgagccacgattgcactactgcactccagcctgagtgacagaatgagaccctgtctcgaaaaaacaaaacaaaacaaacaaaaacatttttggaaaagactcaagttggagggctcatattaccttatttaagacttatggctgggcacagtggctcatgcctgtaatcccagcactttgggaggccgaagcaggcggatcacctgaggtcaagagtttgagaccagcttggccaacatagtgaaacctcgtctctactaaaaatacaaaaaaaaattagctggacgtggtggcacgtgcctgtagtcccagctacttggggaggctgagcctggagaatctcttgaacccaggaggtggaggttgcagagcgtcaagattgcgccactgcactccagcctgggcgacagagagagactccctgtcaagaagacttactgtacaaatacagtaatcaagacaggatggtattggcaaaatggatagccttacaaattgatggaacataacagcccagaaataaacccaatgtaatatggtcagttgatttttttacaaaggtgcaaaggcaattcaatagaatgcagatgactttttccacaaatgactctgtaataattacctaattacctaattattaggtgattaggtaactacctaatcacctaattattaggtacaggaatagaaacttaggaatgtacaggaatagaaacttagacccacatcattacaccatatacaaaatttaactcaaaatgtaccgtaggcctcaatatgaaatgtaaatatgaaaactataagacttctagaagaaaacatggggaaaaaaatcctgtgacctacttcataaaaattaaaaactatttgaaaggcacagttaagtaaatgaaaatacagtataagttagaaacagggaagaaatttttacaaaatttatctgataaaggagtgatatttggaatacataaagaattttcaaaactcaataataagaaaataaacagttcagttttaaaatagtcaaaaaatttgaccattcaagtcaccaaagaagacaaagggatggcagagaaacacatgaaaagatgctcaacatccttagtcattagggaataagatacaactaatttccttaaaaaaaaaaaaaagagggaaaaaaaaaaaggagtcctctgcttccagaaatacagctggttacctccatgcaatcttcatccagaagcaatgatggtaccctggatttcctgtgtgggaattaataagtaattaataaatggcctccgctgggcatggtggctcacatctgtaatctcagcactttgggaggccaaggcggtgaatcacctgaggtcaggagtttgagcccgcctggccaacatggtgaaatcccatttctactaaaaatacaaaaattagctggtcatgggggcgggtgcctgcaatcccaactactcgggaggctgaggcaggagaatcactcgaacccagaaggcggaggttgcagtgagccgaggttgcaccatggcactccagtctgggtgacaagagcaaaaccccatctcaaaaataataataataataaaacaaatgccctcgtgttcttggagcgtttgatttggatttgaattgctgataccaaacctgtgttgctccatgatggttttactgaatttaatggtaatctttgataatttacagaatgaaaaagatttagacttgctattatgaggggctctcctatggaactggtactttacagagcttgggtgccctaggaattaatgattctgttcagttctgtttctgggtttccttttgttaaatgtttaaattttgaacagtttttaattgctttaacctaatgctacaaagagtgagaaaaactccattaataagacagtggttggatctgtttttcatttttctgtctgtcacaatgggtaattatttgtcattgttgcagatactccatcttctaaaccaacactcctagccaatggtggtcatggagtagaagggagcgatactacaggtaagtgattcccaggattccccaaatgtgtaggtgatgcacttacaatgaacaccttgataatctcctttgaagagcattattaatggaagcatatgaattatttctgagggtggtagtgttcttgttggaggtatttaaacccaggacattgccatgtaaaatctccaacaatggaaggagaataatgagtttgctttgatattttttgaatatttattggagctgtaccacacaagaactggatcaaccttaaaatacttttgtagatgcagaataatgatcaccaaaatatgttacatgggaggaatttggccactacaactcttaaaacagcaggtctgttccctgaatcacattgcgtttagctttctacagttcaatgttaggaagccagtgaacaacaaattaggagttatttattttgcccccagtgtgtttcctttatctttcccttaactgttgcttttgaaatttacttctaattaaactcttagctctttactagggttttgatattctttcagttagcattgagtttctgtgggttcctgtctcataaccagcaccaaccccctgccccaatgtctttgtagtgagcaaaattctcaaagcagtagcaggagtcccagggatatactatataaatattttcttaagtagctgatgtgagagttgcgtgttttattttcataaatacctgcatttactttgcagttgtgatcaggccaacactgctaacccaaatgagttgacttctaatgatcaatcccattgtttcctgcaagtgtgctcttaactgggccatacatttgattcatattattgcagtggaggtagttactagatttgtcatatttctgtatttctcttatatgcatacctcagctatgagaagcccttctgtgaggcaccacagtatttctctttttctaaggcttccagaaagccttctgttagcaatagcagctattctaggatttattctttattctatgaccataggaaagttgtatatatctttatacatcagattttttgatgaccaagttctttttgttgtgaatgtttaccaagtgacatatacatccttattagcaacttaataaattaggaactctttactttagaagctagaaacaaccagaaatgccactttatcttccagttttgtgaattgatgtttttgtatttctttgataatctcagtcaaatgtagtattgactttctgtgtctgctttgaaagcagtcatctatgtgatgtggtttttaagaaaacatttatgcaaatatccctgtgattaaaggagaagtttgaacatgaacttttaaaaaatgagtaaattcagctttctttaagcaggaaccagttaaccagggtaaggaaaggctggaggggattgacttgattaggcagttgaaagagtggatgccattttcatccaggaaggaaacaactacaaaaacgagtagatttcttctccagtaggaagtcatgcctgaccagaagagactcaaactctgtgtagcaggtgcttaccgctgccaggccttagtagtacagaatagaagggtaaaaactgtatcctggccctcactgtttcaggattcccttgtgacaaaaaagaacctggctctttatgaactacccagtggcattatgagagtaggtcgttctgttcttggatacctctctgcccttaggtagcatatagtttgcacacctggattgagttttgaattgaaccacttaactgtattaaaatagatactaggccgggcgcggtggctcacgcctgtaatcccagcactttgggagaccgaggcgggcggatcacctgaggttgggagtttgagaccagcctagccaatatggtgaaaccccatctctgctaaaaatacaaaaattagctggacgtggtggcacgtgcctgtagtcccagctacttgggaggctgaggcagaagaatcgcttgaacccaggaggcggaggtttcagtgagccgagatcgcaccactgcactccagcctggtcaacagagcaagactccgtctcaaaaaaaaaaaaaaagatactttactgaaaatatgcatgttttatttggggagggaaggtggagggaggggatggcagtgcatgtttttggagcatgtggtgacttcattctaatttggccatcactacctggagcatctaactcaatgccattttgaaaattcccatttctgtttccttcagaatgttatctatagtcccgagagcaaaccagcttcattaatagctttggtttatgagcatcttgtgatattgaacttgctgtttactaatgacctgtgcttttccacccttttcttccccttcctacttcttcctccctctctatttttctcctcctagaagcctagcgtgtctctcaacactggggctgctgcaacaccagaccagtgatctttcctaagcatcgttatacttctaaaaccttcagcattttgcagagctttgcttttcattcctggacatgatgtagaagaaactgagggtagttcttcggggcctatttctgctgatgcctgagcaaacaacctgcttcctcttgtgctctgcagggtttgatggagcctcatttccctttgtgaacacaaagtgcaaaatgaattctttttaattttagtaatttttacaaaggttatctaatgtcttttatttcttgttttctttatgattttatcatttgattcattctcacatttttttcctttaaatatttttagttgacctttttcctttggttttcaaatgttcaacatgaatcagaatagtgtaacaccaaatgagaacatgtgttttcataaaggggttgaggccaccagtactgcagcgaatttccttttcttctccctcctccttccttctctgagcttgcttttagggaaggttaatcttacaggctacctatgtttctctccaccttactaaaatctaaataatgatagatattttaagtttttaaattgagtagttctgagtaatcctagaatatttttccaaattaaataatcctttattatttgcaagttgggccaaatttttttttttttggagacggactcttaacaatctaagattgtttcaacaggactttcttattcccattcctaattttttcaaactaattgcttaaatctagaaccagttgagattagtactgtacaatggtatgctttgattgtatttatagaaatataacataaaacatggaccatgttttgaaatcttagaggaattctggtttaaaatctgaaatactttaaagttttctatccttttactgattatgcagcttcttataacccccaaggtacagattatttcagcttaaaagaaataattggcaccatgttctgagaaagattttgagatatacattgttttttgtttttgagacagggtctcactcttgcctaggctggagtgcggtggcgcgatcttggcttactgcaccctctgcctcccaggttcaagtggttctcctgcctcagcctcccaagtagctgggattataggtgtgcgccaccacaccagctaatttttgtatttttagtagagacggggttttactttgttggccaggctggtctcgaactcctgatctcaagtgatccacccgccttggccacccaaagtgctgggattacaggtgtgagacactgtgcctggccagatatacattgttttagatcccctgatacagaactacttttgagatggtaagattagaatatcatgaaagtttaaactgaatccttgcagcgacttccggaatttaggaagcattccctcttctacaggggtctggtcacaagggctggattctctgacaaaaatttcttctatggattctggacagaagacacttgagggtgatatgttttaaaggaaagaggttatgcttatcttcttagcagttgataaaatattaaaactctcttgccatagagaatacaccatcaaagaaaacacaaccctttccctttggtgtacagttatttattaagttgattttggggtttctttcgccagggatcttttcaaaactggtagtagttatttttaaaaatcatgtttgacatctttctattgctcgtaaccagtccctgtagctgtctaagttatgggtggagaagcctgggtatgactttccgttgtgtacactcacacttcatgattgacatttatttattcttttatttccatttggttatgcttatttttgtttgaaatttgtttttttcaaatatgtttcctttttgaacttacagaattgttgaaattttctactaacagccagctaaaatttggtatatgttagctctatctgtttcacttggacgtttcattttgaaagaaagaaattttatgtttcacatatagttttatacaaagtagccagtcccataatgaaatgctgtattgccatagtggtcacacccaagtggtccagtatctcaatggtgaggcagccagactggtcagggctgctttgttgaaatgtgatgattttcatatgccttctttctctttctctctctctttttttttccttttttggcccaatgttgaagatgtagaactttgtttttaaataatgtttttataatttcattcgtatacctaagtttgtattttttgtgactttggacttcaacagtttgtatattgggacttctaatgtgattactgtactaaataaattccactaataaacatcttacattaacaccttatggactggatttggttggggtcataattgttgaaatataatgttactaaaacacaagttgggtaaagacttgaggcccaagttctaggtctaatatagcttctaatcccacccggattaattgtatggacttttaagtttttgtcaagcattttcacttatgaatttttttttcttttttcttttttttttttgagacggagtctcgctctgtcgcccaggctggagtgcagtggcatgatctcggctcattgcaagctccgcttcccgggttcacgccattctcctgcctcagcctcctgagtagctgggactacaggcgcccgccaccacgcccagctaattttttgtatttttagtagaggcggggtttcaccatgttagccaggatggtctcgatctcctgacctcatgatccggccaccttagcctcccaaagtgctgggattacaggcgtgagccaccgcgcccagcccacttatgatttttgatagttattgtaaactctcttttatccagaattataaaagttaagaagttcaaatgactactgatatttaatgtcatttggtgagaaagtcacttgacagaaaggtgtgaagaagttattccaaaaggaggtttccatggtatatcaattgttgttagatgctttctaatactacatttattaatttctaacactacatttagtttagtgcagttaaaattcacattcaaagtcttcctaaagtgcctcctgaattatcagataaaatttactacattcagtaacatttaatttgataactttgttatttgataacccagtatgcagtatctgggaagaattcaacaaaatgcgcagttccctagccattctgggttagtgtttgtttacagtagggttgcaagtacaatatgttgactgaattaagacattaaaaatattttatatctaagtaatttgcatagcataaggaactttttaagcttggcagacattttagttaagaacacttaatttaatgtttttagatttcctttttattaaaacagctcagtaatctgttctcaggtttaaagcacagattttaaatactataaggaataattgaccattaactttcttatacataccctaggtttaaagcttttggtaattgaagcaattcttgaattttgttattgtcctcatccctgatgcgaagtgaaacctggcttcatttggattcttcctccttattgacttgataatatggtgggaggctagagggtgttctaggcaaagacacaggactggtccagcaggcacagaatgttagtttcattcctaaatcatgtgtaatactgtattatcctcaattttatgttgatgccgtttccattacagtgaaggtttaacaagacttaactacaaattatttgtgggataaagctctgtgcgaccatggaggtaaattactcttatttatagtgtttggggctagacacattgcactaagtgctgtacaaatggcagtgttactggttgtttccatcgtaattagagtaggtaaacagtttactattgtgataactgtttgcatgtgtaaagtcatgccagcagtgaaacagtaaatctacttttttagaatatcatgacacagaaggtattctgtgtgcttcatcactatctcatctggtaggatgcaaaggatttagcatcagaaaaatgcaaaagcaccaaaaatgtgaaatattaacagataaataaatctgtggtgtgttagagtttctgaacagctattggagccacgctgtaaattggcatcataactcacaagtggagcccagacataagctgcacattatgttgctatgtatagacagcaagacatccatccgaactccaccaaattcctggaacaaagttttatttcttttctttcattttccagttaatgagttgcatgctggagacacatcagcaaattaacagcacgtaatgtttcttaaagtttttttggttcatggttttctaataaaaatacagaatttctcttcagaaaagtccacatatacccatatacaagatgttacatttacgtttagagtgtttaggactccattgaaaccagctcatggactacaatccttttctaagccaagcatttaattaatactctaagccacgttatttcagtttcttttggggctttgtattgaataagacaaaatagcttcttcttgagctttaagtgaaaatataattctgatttttttttgtttgtttttgtttttgagacgaagtttcgcccttgttgcccaggcttgaatgcaatggcacgatcttaggtcactgcaacctccgtctcccaggttcgagcgattctcctgcctcagcctcccaagttgctgtagctgggattacaggtgcccgccaccatgcccagctaattttttgtatttttagtacagatggagtttcaccatgttggccaggctggtctcgaactcctgacctcaggtgatccacctgcctctgcctcccaaagtgctgggattgtaggtgtgagccaccacgcccagccttctgatgttttttgggtttttttgttcttgttttttgagatggagttttgctcttgttccccaggctggagcgcagtgcaatggcacaatctcagctcaccacaacctccacctcctgggttcaagcaattctcctgcctcagcctcccaagtagctgggattacaggcacacgccaccatacctggctaattttgtatttttagtagagacggggtttctccatgttggtcaggctggtctcgaactcccaacctcaggtgatccacccacctcggcctcccaaagtgctgggattacaggcatgagccaccatgcccagcttttaaagactttttaaaaaacctatcttaagttctagttactgagagaaaatccatattgaggcaagggctttgcatgtaggtagtttattttgggaagtggccccagggcacaagagtgggatactgggaaaagtgaaattagaggaaaagaatacagtgaagtatgactactgacctagtcactgctgtgggcaaagtgggcttaagtcttttggggtcttttgaggacctgtatagaatgcctctcagtgttcactacctgagtatcttggttatagaagtggataacatttattcaccatttaccatctctcattgcttaagactcttttttttttttttgagacagagtcttgctctgtcgcccaggctggagtgcagtggtgcgatctcggcccactgcaagctctgcctcctgggcctaacactcttgtacttctggatttgcacatgtgtggtgccaggatgcagatgtcttgtctcttggtgtcagagaagttgtagggcagaaaactctggtttggttgatacaaagtgctgtcaaatcacacctatgtgcagctggatgctgtagcaatagctagaataaatagtgaacttaacagagtgtgaggtgggggcacaagaagtgtctaaccaagaggttacttcaaagcaagattctcttaacataagatttgtctgcttatgccttaccatagaggatgagatccttcaactctgtagaggaaatttgaaggaactccatctattatggtactaatccttttttttttttctctccccgcgccccgcgagacagagttttgctcttattgcccaggctggagtgcaatggcgtgatcttggctcactgcaacctctgcctccagggcttgtgattctcttgcctcagcctcccgagtagctggggttacaggctcccaccaccatgtctggctaatttttgtgtttttagtagagatggggtttcagcatgttggccaggctgttcttgagctcctgacctcaggtgatccacccatgttcgcctcccaaagtgctgggattacaggcgtgagccactgcacctagccaggtgctaattcttgagctgcattgttagaaactatagagatagccacagatgttagttttggaattttccacccaaacgtttttttctttagttagttttagtagtttttatgtttctagaaatttgttcatttcatctaggttatataatttgtttgcctacagttcttagtattcccttataaaccttttttattcctgtaagattcatagtgatatctccttttcatttctggttttagtagtttgaatcctctctccttttttcttcataaatgtagttaaaagtttgtcaatttttttcatcttttgaaagaaccaactttcagttttggtgagttttctctattttctctcctctgtttcctttatttccactttaatcttttttatttccttccttctgcctcatttgagtttagtttgctatttttctagtttcttttggtagaaggttatgttagtgattggtgatttttattttattttattcttttaatataggtgtttatggctataaatttccctcttaccactgttttagctgtacctcttaagatttgatatgttgtgttttcattttcattcatctgaaagtattttctaatttcttttgggatttctttgacgtgttgattatttaggagtgtgttaatttctgcatatttgtgcattccccaatcttctgtttactttctaatttcatcccattgtggttggagaacataattggtattctttcaatccctttcaatatatggaggcttgttttctggcctaacatatggtctgtcctgaagaagaatgtatattcggctcttgatgcgggtggaatgttctgtaagatgtccattagatgtagttggtgtatagtgttatataggtcttctctttcctcgttggtattctgtcttgttgttctatccattagtgaaagtgaggtattgcagtatccaacaattattattgagtagtctattgtttgctcaagttctgttagctttaaattttacatgctttttacatttctcaaggataaattccttgtgaaaaatgctacggttgtggataagaaagatacacacaaatgatcgctacaactatgagcctcagaagcagcagttgaaatgtcggtcgctggtaggacgatttaaagtgtttttttgttttgaggcagggtcttactctgtcacccaggctggagtgcagtggtgtgatcatagcagcctggaactctgggttcaagtaatcctcccgcctcagtttcccaagtagctaggactacaggtgcacaccaccatgcctggctaatttttaaaatcttttgtagagacagggtcttgcttttttgcacaggatgggcttgaactctttgcttcaagtgttcttcccacctcggcctcccaaagtactgggattacaggtgtgagtcactgtgcccggcctaaatgtgtattttattttattatttttgagaaggagtcttgctttgttgcacaggctggaatgcagtggcatgatcttggctcactgcagcctccaccttccaggttcaggtgattctcttgcctcaccctgccgagtagccgagattacaggcgcctgccgccatgcccagctaatttttgtattttcagtagaaacagcattttaccatgttggccaggctggtctcaaactcctgacctcagtgatctgcccatctcagcctcccaaagtgttgggattgcaggcgtaagccactgcacccagcctaaatgtgttttttgttttgttttgttttgttttttgtgacggagtctcgctctgtcgcccaggctggagtgcagtgacccgttcatggctcactgcaacctccgcctccgggttcaagcaattctcctgcctcagccttccaagtagatgggattacaggcatgtgccaccacgcccagctaattttgtatttttagtagagatggggtttctccatgttggtcaggctggtctcaaactcctgacctcaggtcatctgcccgcctcggcctcccaaagtgctgggattacaggcatgagccactgcacccggccctaaatgtgtttttaaaagatgatattttttcctcaaaatctgaacaatgttttttgcagaaatagaaaaatccattcggaatctcaaggagccctcctgaatagacaaaacaatcttgaaaaagaacaaagttggaagtctcatttgttgattttcaaaacttactgaaatgctataataatcaaaactgtgtggtattgacttaaagggagacatatagatcaaggaacggaatggaaagcccagaaataaactcttttatacatggtaagatgattttagacaacggtaccaggaccattcaatgggaaaggatggtgttttcaataaatgatgaggggaaaactggatatccacataaaaaagttggatcctgctgggaacagtggtttatgccaataatcccagcgctttgggaggccaagtgagaggattgcttgaggcaaggagttcaagaccagcctaggcactataggaagacctcatctcttaaaagaaaaaaaaattggccaggtgcggtggctcacacctgtaatcccaacactttgggagtcccaggagggcagatcatgaggtcaggagatcgagaccatcctggctaacatggtgaaaccccgtctctactaaaaaatacaaaaaattagccgggcatggtggcaggcgcctgtagtcccagctactcaggaggctgaggcaggagaatggcatgaacctaggaggcagagcttacataagccaagattgcgccactgcacttcagcctgggcaacagagcaagactctgtctcaaaaaaaaaaaaaaaaaaaaaaaaaaaaaaaaaaaaaggtagtgtgggcctgtagtcccagctactcaggaaactgaggcaggaggatcctttgagctgaggagttcaaggctgcagtgagctatggtaaagtacaccgctgcattcaccctgggagacagagagaaatcctgtctctccctctcttttttttaagttgggaccattatcttatattcaaaaattaacttaaaatggatcaaagacctaaacaaagcaccaaggctatacatttcttagaagaaaacatagagggaaatcttcatgacattggatttggcagtgttttcttggatatacaccaaaaacacagacgacaaaagaaaaaacagataaattaggctatatgaaaattgaaaatttttgtctatctctgtagagtgaaaaggcaacccatggaggcaaaatatttgcaaatcttatatcttctcaggagttaatatccagaatatgtaaataacttctagagctcaacaaaaaaaaattaaaaatatgggcaaaggacttgaagaaacatttcttcataaaagatacaaaaattgccaagaaatacatgaaaagatgctcagcatcattaatcattagagaaatgcaaatcaaaaccacaatgaaatatcacttcatactcattaggatggctagtatgaaaacaagaacagaaattaacaagtgtttacgaggatgtggaaaaattagaacccttgtgtactgctgataggaatgtaaaatgaaagtgctatggaaaatagtatggtggctcctcaaaaaattaaaaacagaattattgtaagatccagcaacccaacttctggatatatgcccaaaggaattggaatcagggacttgaacagatatttgtacactcatgtttgtagcagcattattcacagtggccaaaagatggaagcaacccagatgtcccatcaacacatggaatgaataaacaaaaatgtggtacattcatataatggaacgttatttagccttaaaaaggaaggaaattctgatatggtacaacatgaataaaccttgaagacactatgctaagtgaaaaaagccagtcacaaaaatacaaatttatatgcggtacctaaagtagtcaaatttacagaaacaaatataaatatactccatttatataaattaccttaagtagtcaaatttacagaaacaaagtagaatggtggttcccaggggctgggagaggcggggaatggatgtgtttggtgttgcttaatgggtacaaagtttctgatttgcaagatgaaaaagttctggagatggatggtggtgatgattgcacaacagtgtgaatgtacttaataccactgaactgtacacttaaaaatcgttaaaatcgtagaaataaacaaatgcagctcatatttaaagggaaaaaaatttcaaattaaccatcatatcacagatctcttcagaattaaagggatgctttatatgttaggtattttgtacgtttgttctggtttgtccagttgcagagagaaatacacaaatatgtcaacattgcttaaatgctaagcagttatggggaacattttgtaagaacagatacaatattggttaaattccatgagggggttgagtgagaactaaggaaatttgaaattcgagcttgaaatctccatttggatgtagaattgatatctcaaatttgaaatgttctaaactgaattcatgattgccccaccccaaaatcaaaacagagaagaaaaagaagaaaaaaaccacctgcctccccatctccttaaatggaaattctgtcctggttgttaaggctaaacatttggtttccctatcctcttctgctcctctcacaccccacacccagtttgtcagaaaaagatatttggaacctgaccacatctcaccacctccactgctctctccctgattggaccaccatcattaaccttggctactgtaataacttcccaaattagtctctctgcttccatttgcttgctccctgcagcatattcttaaaaacatctacagtggtcctgtacattgatcatgctgttcttttgcacagaaccctccagtggttgcccatctcaaagtaaaagccaaagtccttatgaaataccacaaggccctatgatgtcgttgtcatctttctgaccagatcttttcttagttacccctttacttactttgcttcatggtgttcttgctactgttccttgaacaagccaggtgggcatctgccttgagctctgagcactagcagttttctctgcctggaatgttcttccctttgatatattcatgattgactcttcactttctcaatgagtacttctcgactatctttttaaaaattgcaccccttctattttttcgtcccactgttctacttgaattttcttcgtggcttttgtcatgtcactttctaataatttgtatagtttacttatctcatctgcctttccccaccagaagaagatattatagaaacaaattttatgagagggacagggcttttgttttggtcactgctgtggcccagcacctagaacactgtctggtggatagtagatcctctgtagctattgaatgaataatctttaatatctatttgtttctggcctcacatgggaaaagaaacttaaaaacaagaccagatacaatcgtaataattcttgccaggttattggtacgcatctttctggaaatatgttatctgtcatgaatttgtttaaattttgaggaagctgtggatagagcacctactagctttgatttcttaggcaagttgtttgccctctttgaggctaagattcctgctgtgtaaaaggagagctctataaaaatagttgtttgcctgaagtgacagaaattattttcagtgctttgaaacctcgttgaaggggttaatatttaaatgtaagatgatattagaatgatgattaatgtccacatagaaagttcttacagttcaacccattatatacttttgttaaatcattctgtttgaccatcagccccttttcctacttaattggttgtgtaacagtattttaatcggatgtaactggagcatattggtccattgtgaagcagaaatgctctgtttctagaggacaaaactggaggtgaaacttcaaaagtgagctccaggcagactgaaagaagagtttttttgttttgtttcttgtgaaaaaattaacttaggactctcactgcaaaaaactggcaagcctggccctccagtgggttttcagcaatttaaaatgaaatgagaagatgcaaaactatgtcaactgtaaacttaagtattaacattagactccttagaggtcttcattgaaggattttgctttctatttaacaaattaatatttctggtcttcagtttttctgtgtaaaacgaacaggcattctgctgtttctgctgctgctgttagtgctgagcaacagagatacagtatgttctgcggtaggtgatagctttttagacatttagagattaacatttgccttctgatttattttctttgggttaaacatctttcattttttcttccactctttcctattatgtagatttatgctgtttttaatggccaatatttggatcagagtctattcaggagacagaagctacaccataaattgaacagagaatttactataggggtaaagagaactctaaagaatacaggaatgacagatatagggaatagtcactacccttagggctggggcagagtacacaaagaaataacaaatttggaaaagtatgcgcccctcccccaccctgcccccaaagctgattgcatatcttggaggaagtctccatttggtagtaaagatgtttgctgagttgctgcaggtcagggtgatgtggggcaaacaagcccccagactggggcttaacccaggagggttcttggctttgccaggaaagaatttaagggtgagccagtagtgagagaaagaaacttttattgaaccagtgctgcttcttgctgagcagggctaacccataggcagtgtgcccagaatcggtgtctgtgagctgctagctagctgtttatatctgttattaattacatgctaattaagaggcaggttatttagaactttctggaaaaggggctggaagtttctgggaatcagataaggtaacttctaggctgttgccatggcatttgtaaactgccatggcactggtaggagtgtctttatgctaataaaccctgagggcaactcgaggttacttttgtcagcatctgctggtttcagccagatcttgttccaatcagcagggtgcgacaggaaattaagtcctgctggtcttctacctcaaaggtagttaagcaggaagctgtacttgggggtgctgcggcatcaccagcaagcctgtttgaggcactggtggaacttgcctgggaagatgtccatgagaatgcccactaaagcttgttgggatgagcaccatggggtgttctgcacaccagcagagcaccatggaagtaagaagatgcaaaagcacactagaaccaggaagagaaaccctttccttccatgccctctactaagcttagtgtcatcatgcccgctctctaggaagaaatgtttacattattacaggcagggcaatgaaaggtagatttggaattgagaggcaatatattgattacttgcatagcctattattttggctacttagcttccatatgcactttacacacatttgagctcccatataacaatgaaactcttatgtttctacctaacaagatacagctatgtcagagggtgaaactctcacccttgttctaaaatgaggaatgaggacatgctcagccccatagtcattgtatccattgctggctatatttttgtttgtttgtttgttttaatagaatcagggttttgctgtgttgcccaggctagtctcaaactcctgagctcaagcaatcctccggcctcagcctcccaatgtcctgggattataggtgtgagccactgtgcttggcctgctggctgtttatcagtcctcaaatagaagttccagcttcagagggccaaggtcatgtgatgggagccaggggcttggagttctgagggaagaggagtgaagtattgggggatgtggcagtatcactgacagtgaggttttttggaggcttttttggtctgatttgtgagattgatattgtccttaatgataaggaaacaaagaaaatggcagaagtgaaaactgaaaatggcgaagtagaaaaacaccatctcctctatgatggagaatctgtttcaggaaaggtgaaagagtctagaaagagctagagcaccacaacattagaattgaatttgtacgtcaaattgaacttttctatgataagagtaatattcaagagtttgtaaacctagtgaaagaactagccttacctggagagctgactcagaagttgtcatttggaatttatacatgttgaaaagtcatgagaatcttacattggtgctaatgtcctcttgatgtattgaagtgttagtagtaagaagactgacagacttggtaaaaagaatgtgatcttactgttcaccaacttgccagctatcctgatggaagtgggcattgaagattgtctacatatagaatttgaatataatgaagtatcatttaaaggatgtgactgttacaaaaatttacctcttataagtaagaataaaaacacaacatatggggttacaactgatcaataagactgttgttagcaggatatgacctaactccaacaatgaaagttatgaacaaaaaagtttcagtaaggtactttttgaatttagcgcctgttgatgaggaagacagagggtactttaggcagcagatcatttaatggagaaaagctcctgaaaaactgaggaaacagaataaacttttaccagtgatttgaacctccagaatcacaagcatctgctgaatagcctgaaatatactgaataagatgaaaaaagaaaaacaaaactataatcattaagttaaacaggttaaagatggctgcagcatgtggaggggcaaaatgggcataactctgcccgggcatggtggctcacacctgtaatcccagcactttgggaggcgaggcaggcggatcacttgagatcccaagttcaagaccagcccggccaacatgatgaaaccctgtctctactaaaaatacaaaaagttagctgggcatggtggtgagtgcctgtaatcccagttacttgggaggctgaggcaggagaattgcttgaacccaggaggcagaggtttcattgaaccaagattgcaccactgcactccagcctgggcaacagaacaagacttcatctcaaaaaaaaataaaaatggccaaaactccatttatattcatcttcctttatcttacagcgctacatttatttcatgatatagcaaaatgttcttcatgtatatacatttttttttttttttttgagatggagtctcgctctgtcgcccagggtggagtgcagcggcgcgatcttggctcactgcatgctccacctcccgggttcacgccatgctcctgcctcagcctcctgagtagctgggactacaggctcccgccaccacgtccggctaatttctttttgtatttttagtagagacggggtttcaccgtgttagccaggatggtctcgatctcctgaccttgtgatctgcccacctcggcctcccaaagtgctgggattacagacgtgagccactgcgcccagccacatttttttttttttcccttgaaaatcgctcttttgcccaggctggagtgcagtggcacaatcttggctcactgcaaccaccgcctcccagattcaagcgattctcctgcctctcagcctcccaagtagctgggaccacaggtgtgtgctaccacgctcggctgatttttatatttttagtagagacgggggttctccaggctagtctcgaactcctgacctcaggtgatccacccgcttggcctccaaaagtgctgggattacaggtgtgtgagttaccacacccggccaccttcatgtatatacatttttaaaagtgctttctttgaaatgctcaaattttcttaaactgccttttttttttttactgcacactttgatgacaagcattcagatatgcgtcagcataagctttaaagattttcatgtggcagaaaacaaagttccactgactagtttgttaccaaaagttgtattataaatctaatttcaaggcgggtgcggtggctcatgcctgtaatttcagcactttgggaggccgagttgggtggatcacgaggtcaagagatcaagaccatcctggccaacatggtgaaaccccgtctctactaaaaatacaaaaattagccaggtgtggtggtgcacgcctatagacccagctacttgggaggctgaggcaggagaattgcttgaacctgggaggcggaggttgcagtgagccgagatcttgccgctgcactccatcctgatgacagagtgagacttggtctcaaaaaaaaaaaaaaaaaaaattagccgggtgtggtgcacacccctggaatcccagctactcaggaggctgaggcaagagaatcacttgaagctgggaggcggaggttgcagtgagtcaagatcgcaccactgcactccagcctgggcaacagagtgagactcggtctcaaaaaaacaaaactaaactgaactaattccaacttataataatgggaagaaggaaagaagaaaatggttagaatatacaaacaaataccaaatataacaaagagaaagttcatcctcatttctgtgattagtaatgaggccacagttgatatctaggcttctttcttcagttacctatttcatgtttcccttgccttcagcacgaacctcagctggttgaggttctttacctggtgaaatgactcaaacatttattccctcattagtccagtccttttttggttgctgtagttttccattaatctttatttttggcatggaagtattaagaggtgccttagataatcccttgggtttcagacatagtcctccttgctttcactgtgtagcagcaaccgtttccccttgacaattgggctcaatctttcccaaccagtaggttcagcctgttggttcagtggtgtaaggagtcccaagtagccaagtggcagtctcatcttctaatgcaattgaaccattgttgtgtatgctagtagatatatttcctgcttagggactagcacttccaagccagcagaactcagttgttaggagtgaaagcaaaaattcagtgattgctagatataatagtgagtggagccgcacatacttctaccctttgattcccagacctgtatattctgattgagggaggagacagcaccatgtaaggtgtctctgattgaaatcattaccccatcctttcagggtgttgtctccctgaaactgtaacttagtcttcagtaatcaattccctattttaattaggccaaccattctgtgtgataggatgtgacaacaccagttaagtccatggacatgagcccatttctgcatttctttactatgaaatgactttcttggtcaggagcaatgctgtgtgggcttggcatggtggcatatgcctgtaaccccagcattttgggaggccaaggcaggaggatcacttgagccaaggagtttgagaccagcctgggtaacatagtgagaccttgtctctattttaaaaatacatctttttttttggccaagcatggtggctcacacctgtaatcccagcactttgggaggctgaggcgggcagattgcctgaggttaggagttcgagaccagcctggctaacatggtgaaaccccatctctactaaaaattcaaaaaaaattagccgggcatggtggcacatgcctgtagtcccagctacttgggaggctgaggcgggagaatcacttgaacccagaaggcagaggtttcagtgagacaagatcgtgccactgcactccagactgggcgacagagggagacctcatctcaaaaaaagaagcagccgcaacactgtgtggaatgtcatggtggtagattgggcacttatatataagttcatgggtggtggaactgccaaaaacattataggcagagaaggcaaatctgtatccagaatacatgtctattctagtgaggacaaatctcttccctcacccctgcccttattccccataatagaagtccagcgtaatcaacttgccaccaggtggttagctagtttttgggaaatggtgcatattcagggctcagagttagtctgtgccattaacagattagacatttagcagtagctttagtcaggtcagccctgtttaggggaagatcatgttgttgagtccatgcacagccttcatgatgattttttccatgggttttattgagcaagcactcttgtagctatggaaagtgtctaacatttatattcatgaagtacgtcattttgtcaacttgcttattaagagcctcctctacagtgaatgcaaatgattattcacatgggacacaaatatcttcacagtctgtgcctgttctgagagtttcatctgcatatctttcccccagatttccttgtcaccatttccttccaagttcctaactagccaacaaaatccttaataattgttcataaatgagtataaatctctgcttctggccatgtcttacctcaggcaaaagggaaaaccaaatgtacccctcaacgttctgccctctgaaggaaagatttttcttcatcactgcccttcagtcctacctctttaaatggggctgtagtgctgcagctccccacttttgggtgatactggcatgttgtgcagagctatgtgtaaaccagacttgagttttttctttccccagtcagctggtcatatggagctctcaggaggccattgacttggattgagggagaggaagcaatgcaacagaactcaatgctgaagtctgagctacctcctatgtaacttactcatatttctggacctgcttgaatttttttttttacgtgtttttcacttgatgatagatcgtgctgcacatgccaagctagactacataggttggataacatctagttcctgatgagaagctcaggacacgtggttgcattatgtcccatggttaggcatttggtctctgccaagacccaatagcaagcctgaaactattttttgaaaggtgaataattttctgcaaaagagggcatagattttctcaaaattctagaagtctgggcagtgattctcttattcttgcttgctaaaggctccattcagcatccctatttgccatggacacttcaagtatcattggatctgccagatcataaggcccaaatggcagagcagcttgaaccacagcttgaacttgctatagaatcttttcttgctctgaaacccactctaaactgtcaaccttgtaggtaactttgtagctgggttgaagcctaccaaacattgtaccctctttttcattgttggtgatgttaattagagcaacttaatcaccttggaagggaaattttgacatgttttgagcaattgaatcctgacatttcattgctgcagtgggtctctgaatttttgtagggtttatctcgcatcaactactttgtatatgtcttactaaagcatctaacgtatttgctacttgctatttatcagacccaattagcataatgtcagtatagttgactagtgtgtgtgtgtgtgtgtgtgtgtgtgtgtgtgtgtgtgtgtgtgtacgtgcttatttatttatttttttggaatgtcacgcgatcaagatctctgtgggctacattatggtaggagaatggcatagccctgaggctagattcataggcacgtaaaaggcaggtaaaagcaatgtgcttctggtggttcttgcagatttgtatgaagaaaaaggcattattcaggttaatagcagtataccaagtgccgtgacccatgttgatttgctccagtaaagatgctatatctggggcatcagctgcaattggaatcatcaccagattaagtttatgatagtccacgagtttatgatagtcactaagatccatctgacttctgcacaggacaaactggcgagttaaatcaagatataataggtatcactaccctgtttctttcaagtcttttgatggtgacattaagctctttaattcttgagatgtggtattgcttctggcttaatatcttagtagggagggtaagttctaggggcttccatttagcccttactattaaaatgactcttatcagttgggtcagaaagccaatatgggagctctgccaatagtcaagtatgtctgttccaagtatttattcaggaactgaggagataacaacaaagtaggcccattgtactatggggtccactgtgaggtggacttgagctaagcatttcatctattacctgaccactgtcagcactcactttgactgataggccacagtagcattttgagtccccaggaattagtaatccctgaaaggtctgggtatttccttttctctaatccgtagtcactctagtaaatggcctttggggaagcttggatgaggatttacagtatgtacttgtacttgtgggaacactacaggtttttcctcaggggacctgggcttgttaattgacttgggtctagaaattagatgagaggtcaaaacttttctagtcaggtttttactaccagagctggagtttttttcagttgtacagatgaatctgttttggtaggctgcttgtggaatactgtgtgatcaattactgccaaagatcctggtgggccaaggtgttctgattaccagtacaactttactgtatttatagtagatttcccaccttgtctttggtgattacatgctgctacttggcctctgttattttaggatcccgttacccctttaaatcagggaacccacttagtggtggcatttcccatggccatacctaggggttgtgacagagaccttagggactgtaaaacctaaaatgtttatctgtggccctttataaataaagtttgccaacccatgtctaggggaacagggacacactgcaaaggggagcaaccacagagcttttcaaggatgaaggtgatcccctcactaatgcatttctttttttgttgttgtttgtttttttttttgtttttttgagacagagtctcactctgtcacccaggctggagtacagtggcacgatcttggctaactgcaacctctgcctcctgggttcaagcaattctcatgcctcagcctcccaagtagctgggattacagttgtgcaccaccacacctggctaatttttgtatttttagtacagtcggggtttcaccatgttggccaggctggtcttgaactcctggcctcaagtgatccacctggctcggcctcccaaagtactgggattacaggtgtgaaccaccatgcccacctcactaatggatttctcaatgcctgagtgaaaggattatcttccgagcttttttttgcaacataggttacacatgaaaaatccattccaacatttctatctccctaagtttttgaattgcctcttctacatcttgctagggaaactttggcatctccacctcattaaacatagtggactcttttttaaagaaagttttatttatttatttagagacaggctctcactcggtcactcaggctggagtgcagtggcgtgatcatagctcactgtaatttcgaactcctaggctcaagtagtcctccttcctcagcctcctgagtagctgggattacaggcatgtgacactgtgcctggttaattttttattttttgtggagatggggtctctgtgtgttgctcattctaggcttgaactcctgggctcaagcctcctaccttggcccccctgctgagattacaggtgtgaactgcacccagtccttttgttgttgttttgtgtttttttttgtaagtttttaaagtcctgtttattgaagcatgaatttacattcagtaaagttcaccctaagatttgacaaatgcatagtcataccatactcaagatgcagaaccattgtaaaatcactctatcaattccctcctgcccctttgcaatcaacccctttttgatcccaaggaactaattgacctgtttttctgtcaaaagtgtcaaatttaatcactaaaatgacctacagtaccatggaaaaatatgtaagcatataaaatacacaaaccaattttttttttgtattttatttattttttgagatggagtcttgctctgtcactcaggctagagtgtaatggtgcgatctcggctcactacaacctctgcctccaaagttcaagcaatttttctgcctcagcctcccgagtagttgggactacaggctcatgccaccacacccgaccaatttttgtattttttagtagagacagagtttcaccatattggccaggctggtctcgaactcctgatctcgcgatctgaccaattttttatttttatttttatttttattttttttttaatttatttatttattttttccatttaaccctgagtggacacagcacatgtttcagagagcacagggttgggggtaaggtcatagatcaacaggatcccaaggcagaagaatttttcttagtacagaacaaaatgaagtctcccatgtctacttctttctacacagacacagcaaccatccgatttctcaatcttttccccacctttcccccttttctattccacaaaaccgccattgtcatcatggcccgttctcaatgagctgttgggtacacctcccagactgggtggtggccgggcagaggggctcctcacttcccagtaggggcggccgggcagaggcgcccctcacctccctcccggatggggcggctggccgggcgggggggctgacccccccacctccctcccggacggggcggctgccgggtggagatgctcctcacttcccagacggggtggctgctgggcggaggggctcctcacttcccagacggggtggctgccgggcggaggggctcctcacttctcagacggggcagctgccgggcggagggtctcctcacttctcagacggggcggccgggcagagacgctcctcacctcccagacggggtcgcggccgggcagaggcgctcctcacatcccagacggggtggcggggcagaggcgctccccacatctcagacagtgggcggccgggcagagacgctccacacttcctagttgggatggcggccgggaagaggcgctcctcacttcctagatgggatggcgggcgggcagagacgctcctcactttccagactgggcagccaggcagaggggctcctcacatcccagacgatgggcggccaggcagagacgctcctcacttcccagacggggtggctgccgggcagaggctgcaatctcggcactttgggaggccaaggcaggtggctgggaggtggaggttgtagcgagccgagatcacgccactgcactccagcctgggcaacattgagcactgagtgaacgagactccgtctgcaatcccggcacctcgggaggccaaggctggcggatcactcgcggttaggagctggagaccagcccggccaacacagcgaaaccctgtctccaccaaaaaaatacgaaaaccagtcaggcgtggcggcgcgcgtctgcaatcgcaggcactaggcaggctgagacaggagaatcaggcagggaggttgcagtgagccgagatggcagcagtacagcccagcttcggctcggcatcagagggagaccgtggaaagagagggagagggagaccgtggggagagggagaggagggagaggagggagagggagagggtctgaccaattttttaaaaagtgagatactttaaaaagtttcttcagcataccaacaaaaaaatgaaggtagcattgcattttactacagatgtgcagatattcattaaagttcaccattgtcatatatatggctcaacagtagtatttaagaatatgctgtaaaacaacaatctttagagtcaaaagaatgtaattttaaaacctttataaattaaagcagtttataaagttgtcttaattgtaaaatagctaatctagttacaattaatgtgttccaaaactgacctacttgaaaaactagtcttatatatttgttgagtatgtgaaccatgattaggtcttgctatttggtattaacactgtcaagttacagaccacagctggttcatagaaaagctactttaaataatggaattgaattccgtagaaattttctacaagaccaactcagctatggggagaaacacgaaactgtcaggtgaatattcctacagatgattggggccacctcagaattcacccctgctacccctatgaaagggaccaaaaaaacaaaaaaagcaacctctattctgtagttactaaaggttacatattcaaatatatctcatctacttgaaaagcttcactgattctttcaagcgccagaccttaaattcatcagcatcttgaaactccaccaagcccagtcatgtgccacagctgaaatttgtttttggtttttttttttaaacataatttactcgagtctaaaatttcagtcaaccaatgaggtgaactgttagagccacctccagctatatgatctactcctacacatgttctgaaggtttttgccagtatattattgccacgatcttgcatgtcctggattactagcatcccctttcccattggcaaggtgcttagcactgcacttaaacccaagagtgccaccaaaccaatttctaaatcccatgtttttaagtccgtcctctgagatcaccctactttttgtaccagttctggatcagggttcagtctggaaacagaaatattgcaatttgaacaagggaaagttaacataaagaattattaactagtaatagattaaccattaaagggtaaagagaactctgaaagatgtaggtgtatcagctataggagcagctactccctctgtgcctgaggcagagtatgaaagaaagagacagattggagagagagcctacccaaggcggagattcagaccttttgaggaggtaaagctgtagtctgttgcagttttaagttcctgaggatggcaccagccgagggttaaaagcaagagtattgtttgctggagtgccaacaaaactgtctaggaagctgctctgggtggtgctgtcgaaaatcactgggaagttagctggggtgactggaactcacctgaagccactcattgtggtatccctaaaactggtgggtgagcaccgctgggtgtcccacgcatcacatgaggccacgggagaaagaagaggaaaacacagtggaaccaggaggaaatcctcttcctcctgtagtattcctccagtgcttgctattggcataagaaaaacatttgaagagtccagcttcattattgcaaagcagagcagtaaagtatagatttggaactgaaaggcaataaattgataactaatatatcatacctcttaacctatgcctagaatggaatacaatttccagatgtagtttagccagcataagtagagcaggatacctaccccactccgcatcattcctggtactatgttgttgatgttgcttgccaagaatgtaagctctctatgggtggtgattcttttttttttttttttttttttttgggacgcagtcttgctctgttgcccaggttggagtgcagtgggacaatctcggctcactgcaacccccgcctcctgggttcaagcaattctcctgtctcagccttctgagtagctgggactacagatgcacaccaccacactgggctagtttttgtattcttagtagagacggggtttcaccatgttggccaggctggtgttgaactcctgacctcaggtgatctgcccgcctcaggctcccaaagtgctgggattacaggcgtgagccaccgtgcccagctgggtggtgattttttattgctttatccctagaacctaaatggaacctggcacgtagtatatgtacttaagggatagttgaatgaataagtgattacagctcaagatagcgttaaattgttgtcttttttatgttagattcatccaaattagtgaaagaaaaactgcagtttgacctagtcaaccaactgaaatggattaatgtagaattctgagtggctgagttaaaggacaccttatttgatttggtttaagaaaattgatcggccgggcgcagtggctcacgcctataatctcagcactttgggaggccaaggcaggtggataatgaggtcaggagttcaagaccagcctggccaacatggtgaaaccctgtctctactaaaaatacaaaaaaattagttgggtatggtggcgggcacctgtaatcccaggtactagggaggctgaggcagagaactgattgaacctgggaggcgggggttgcagtgagccgagattgcgccactgcactccagcctgggcaacagagcgagactctgtctcaaaaaaaagaaaattgatcacctgccagagcatggattgacccctcttctgatgacttggtatgtgtttgtacacactgttaacacccctttctatagaataggtcacaattatgggttgggcgtggtgactcaacgcttgtaatcccaagactttgggaggctgaggcagaaagattgcttgagcccaggagttcgagaccagcctgggcaacatagtgagacctgtctctacaaaaattagcctggcatggtggcacatgcccacagtcccagctactccatatgttgaggcaggaggatcgcttgagcccaggaggttgagactgcagtgaattatgatcacaacactgcactccatcctgggcaacagagctgagaccctacctatctcaagaaaaaaaaaaaaaaaaaagaataggtcaaccagccttcccaacatggcgaaatcccatctctactaaaaatacaaaaaattagccgggcgtggtggcgggcacctgtagtcccagctacttgggagcctgagtcaggagaatcgcttgaacccaggaggcagaggttgcagtgagccaagattgtgccactgcactccagcctgggcaacaagagtgaaactccatgacaaaaaaaaaaagaaagaataggtcatggttatgaccagtgggtacaaaagacatagacttgtgtatttattgcatgtttcaaggtagaaagcaaattgctgcatcaagtattgttgtcatagcctttaattacctattagtaatgcaaagaagcagagatttttgttttcttttctttttttcttttttcttttctttttttttttttttgagactctctctgtcgcccaggctggagtgcagtggtgcgatcttggctcactgcaacctctgcctcccgggttcaagcaattctcttgcctcagcctcccgagtaactgggactacaggcgcccaccaccacgcctggctaacttttttgtattttagtagaaatgcagtttcattgtgcccaggctggtctcgaactcgtgagctcaggcagtttgccctcctcggcctcccaaagtggtgggattacaggcatgagccaccacacccggcttgagatttctctcttctaggagagttctggcagatgatttggcctttcctcccttgttgtacactaagaggaaatgaggcagagtaggaaagaaaggtacccaaggttgagtgttgaatgagaggaccagggattaaaatcaaaatccctacctggctgaatgtggctctgctgccttggggtaggagattgggccacaagtccagctgggtgccaggaggaggaaggggtaaaaagggagtggaaaacccctccaaggacccactgaccctgctggcagacttcttattcaagtgtgaagaaatctgtcagaatctgagggaaccaaagacaagaaaaaagtacaatgtttggacataaatttccttaattcttgtaatgttttaggattctaataatcttctataaggaggatattaaatatccttaaataatttgctgtacttgggaaagtggtttttcttcttcagtttagagctagaatctcagttacctatagttgcctggagtcaattggtagaatgggtttgaagccattgaaaattgagcgtggatatgaatacagtttaatgtttacatgtgatttctgccacagttgattttgattatggctacttgtaaatcatttttctggctttaaaccaaaaacttttaaatttctggcataatttaaatactttcataaatataacctgcttaacctgtttaacagaatgtgaaaatagaaatagggttcattataagttattgacatttaaagggaattcctgttttgtatatcacatcatagatatatgatagccctggtttattatgtctattatcctgacataattgttaatagttgcttctttttttttttttttttttttttttgagacggagtttcacctttgtcacccagacaggagtgcaatggcacaatcttggctcactgcaacctctgcctcctgggttcaagcgattctcctgtctcagcctcatgagtagctgggattataggtttgtgccacaacacccggctaatttttgtatttttagtagagatggggtttcaccatgttggccaggctggtcttgaactcctgacctcaggtgatctgcccacctcagcctcccaaaatgctgggattacaggcgtgagccatcatgcccagccaatagttgtttattttactcttgttttggcctactctgaccaggcaaatttatttcttagaatgtgttgatttagtttagtataaattaaactaaattagtgtaatagtcctgagcatttaagttatggggccgggtgtggtggctcacacctgtaatcccagcactttgggaggcagaggtgggcagatgacaaggtcagtagatcgagaccatcctggctaacatggtgaaaccccatctctactaaaactacaaaaaaaaaaaaaaattagccaagcatggtggcgggcgcctgtagtcccagctactcaggaggctgaggcaggagaatggcatgaacctgggaggcagagcttgcagtgagccgaaattgtgccactgcactccagcctgggcgacagagcaagactccatctcaaaaaaaataaaataaaataaaaccagtcttggcaacacggcgaagccctgtctctacagaaaaatacaaaaaattagctgggtgtggtgatgtgtgcctgtagtcccagatacttgggagactgaggtcacttgagcccaggaggttgaggctgcagtgagccaagatcgctccactgcactccagcctgggtgacagagtgagaccctgcctccaaaaaaataaaaaatattaaattataatattttaatattcagcaaaaaaagtaaataaaattcagtagaacaaaggtgttgcaaaaagaagaatcttaatttgtagattgcatcttttaagaaaaactcataagaataccagccagtatttttatctccagatgaattttttcccctccaaattacaatcatttctccattcaacatcctttattaggcaccacctaggtatcaggccagatacatggtgctgggaatagtgaagagaaagacacagtccttgttctcaaaggactaaacagagaatggaggaaccgtatcttgtattcagatgtttaaatgtatgcataggttgcttatgcatacattatgagaacctatgctacatgttttaaatgtatgcataggttctcatgacatacatttatgagatctcagctcactgcaacctctgcttcctggattcaagcaattctcctgtctcagcctcccgagtagctgggactgcagtcgcatgccaccatgcctggctaatttttgtatttttagtagagaggggtttcaccctgtgggtcaggctggtctcgaactcctgacctcaggtgattcacccgcctcagcctcccaaagtgctaggattacaggtgtgagccaccgcgcctggccagcaatctgatttcatctgttcccaatcactccctccatttaaccctaggtgttttttggaagcaaaccccagatcatttgatctttatattagcatgtatctcaaaaaaaaaaaaaaaaaggttcctttttagagcataattgcaataccattaacaaacacacaccggttccctagtaccaaatatccagtcagtattcaattcaccagttatctcataattaaaaaaaaaaaactagctcgttagaattagaatctaaatttattttaatccatagattcttctataggggatatatatataaacagtttggattttacttgtgttttaaagatgccagagatttaactgtgctcatagccagagggggagaaatgaggagagaaggaatgaaaaattaagtctagaaggttggaggactgggtggcaagaaggtgataaagggcatatttgctgtccttggaaaggagaatcacgtgtattttgcatattctctggtttagcattttccccaaattaaaaagaaataaaaatgggggattatatttttctcataaataggaaggaaagaagtaatgatggactctgatgtagataaatttatggtagaggaaacagcagtcatataatatcattttctataaagtaaaatactatattttggatggagtgagctggaaaagaaagtatgtataacagactgtggagaatgagaaaggaagttgcatggggacacattttgtttttgtttttgtttttgagacagagttttgctctctcgcccaggctggagtgcagtgacgtgatcttggctcactgcaacctccgcctcccaggttcaagccattcttctgcctcagcctcctgattagctgggattacaggcgtgtgccaccacacccagctaatttttgtatttttagtagagacagggtttcaccatgttgatcaggctgttcttgatctcctgaccttgtgatccacctgcctcagcctcccaaagtgctgagattacaggcgtgagccaccacgccttgccagggacacatgtttttataggaagttgtgtagagaggtgtgtttataggaacaagtacattcagtatgataataaatcaagtgttgtaggaggtagaatactgaaactattcagtattctgagttgacagctcagctactgccaacttagcctgtattgtggtctcagggtagcatccttcacctgtggccactctgagacacatccagcagaatttctggttgaagcaaaacaagtgtgctatgtgatcttaaagttatctccttcctgctggagatttccttcaaatgccttggtgttttcaaatattgctagagggctaaactcagagtcttccaaccattgtagggatgtcaaatatcattaatttatttttgtttttttaattgagatgggtttgaagccttttttggggagagtgggggaaagagtcctgttttgtcacctaggctggaatgcagtacgggatctgggctcactgcaccctctgcctcccgagttcaagcaattcttctgcctcagtctcagtggctgtgattacagacatgcaccatcacgcctggctaatttttgtatttttagtagagatggggtttcaccacatgggtcagactggtcttgaactcttgacctcatgtcatctgtgggcctcagcctcccaaagtgctgggattacaggcatgagccaccgcatctggcctaaaatattattttaaatcaagaaaggttagtgggctttttgctagtttaatacagtggagaaggacgctaatatagttggatatgaacatttggatctatttaattataaaaaatggagtcggctgaaaatctgagaaaggagtaggctttctcctgtcactttttttattgaaatacttttatttttattttgaaagttttttttcttttgtgtttttggagacagggtcttggtctgttgcccaggaatacagtggttctatcatagctcactgcaatcttgaaatcctggctcaagcaatcctcccacctcagcctccaaagtaactgggacgacaggtgtgcactaccgtgcctggctaattttttaaattttttttgtagaggttggggtcttgctacattgcccaagctggtctccaatgcctgggctcaggcgatcctcctgcctccacctcccaaattgcgatgattacaggtgtgagccgccatgcccagcttattttgaaataatttcaaatttatagaaaagttgaaagaactttatacatttttccagattcaacaatcaatacgattttaccacaactattttagcattctgtaagatatgtatgtatatgaatatacacgtattttccttgtcacctttgtttgatctaataatctaagatgttctcacatgtgttacttacaatgtcaacagtaactggtatccctgtgtgcatgaaaaaagcaaaaaacaaaaaacaaaaacagtggtgattgtcagggcacagtggcatgtacctgtagtccctgctacatgggaagctgatgtgggagaatcacttggggccaggagctcagtcaaggctgcagtgagctataattatgcctgtgaatagctactgcactccagcctaggcaacaaagtgagaccccatctctaaaaataaatagaaaaaaaagtttttaatttaaaaaaaactgtcagtagtaaatgaaaataccacattcagacattttcccctttcttttctgtgaagcacctttgccagcattaatttttcttaatttttattgttatgccattttaacgtctttatgattaagtttagctcttaatgagatactgtgttgtgtattttttcatttctcacatggctaagcttctatcccaaaagcataatgaagcctgaactttgtcttggatttcttgactttctgcagggaatggggagagggaagaacggggctgtaggaggctagaagtgtgagcttgcactggagtatatagggatttggactaacagacttctaaaactgtaaaggagtttagagaccaaatactagcacagcccttagtaaagacccccaaagagcttgtgtttgtgagggttatatctatttatcaaactaaaactggagaaacctgaaaaatacttatctcattttaaaaagtaataataaacaatatttttattgagaagtatagtttcaaaaatgaaggagattagtaagaacagtggtagcgttttcgcctttttttttttttttttgagacggagtcttgccctgttgcccaggctggagtgcaatggcacgatctcagctcattgcaacctctgcctcccgggttcaaacagtcctcctgcctcaacctcctgagtagctgggattacaggcacacgccaccatgcccagttttttttttttttgtttttgtttttttagtagagactgtgttttactatgttagccaggctggtctcgaactcctgacctcttgatccgcccacctcggcctcccaaagtgctgggattacaggcgtgagccaccgagcccagccatggtttcgcttttaaaaatctttttaatgtctgtcttaatagaacacagctgtatttttatatctgcctctgcattcagtctgtcacaatatgttgtttgggttgcagtatatgaagaaaatccatttcacacaaatatgtagttaggaggaggaatattttgacagttttttttccaggtaactatgggtatttgatttgacatcaaaacttcacaaatggtagtttcttttcttcttcttcttcctttttttttttttttttttttttttttggtagagatagggtctcattatgttgcccaggctgatctcaaattcctgggctctggccaggcgctgtaatcccaggactttgggaggccgaggtgggtggatcacctgagatcaggagtttgagaccagcttggccagcatggtaaaaccccgtctctactaaaaatacaaaaaattagccaagtgtggtggtggctgcctgtaatcccagctacctgggaggctgaggcaggagagttgcttgaacccgggaggtagaggttacagtgagccgagattgcaccattgcactccagcctgggcagcaagagcaaaactctgtctccaaaaatgaaaaaaatattcctggtctcaagcagttctcccacctcagcctcccaaagtgctgtggtttacaggggtgaactactgcacctagccaagtggtagtttcttaaaggttgtttgcaatggggaatctgaaaccatatcaatgaactttttgtactgttatttaaaatccattagtctatcttgcacttggaatggatcatatgtgacagaattagtctagttttgatatgtagatatgctacttgtttaattagtactttaagtgtttagccatatgccttttctgttaaatgccttcaatttcacagagatagaaaactgtcccctgtccttccccattctacttttataggagaatcaaagtctctagggatggccagtggtagtggtaagtattttttctactgcattatgtaaattgcttcttgtttagaatttcattttccatagttttactgaaatagactctctgagtagattgcaagtatgctaaaaaatttattctgaaggctgttgtttctacaggggagtttgcctgcttctgctgtgtagttttaagaacaaaatctaggtcagcagtattgaataaagatgtgggagtgagcctctggtcaaacatgctccttaataataatggtggcgggggactggtgattctgaactttgctgttgagatagctgctccaggctgtgctgcaccctgtggaagggaataaccagcaaaattctgcatcttaaaaccagatttgggccaggtgtggtggctcacacctataattgcagcattttgggaggccaaggcgggtggctcacctgaggtcaggagtttgagaccagcctgaccaacatggtgaaacctcgtctccactaaaagtacaaaaattagccaggcatggtggtgcacatctgtaatcccagctactcgagaggctgaggcaggagaattgcttgaacctgggaggttgcagtgagtggagatcatgccactgcactccagcctaggcaacagagtgagactccacctcaaaaaaatttttaaaaaaatgaaaaaaacaacaacaacaaaaaacagactttcatgctccttctccaggaggggtgaggaaaatgtacccatttctctgattaaaaacttattttttgatcaagaggtggttgtttaaaaaaaaaaaaaaaactatttctttacagtttcttaccatgagtaagaaatataagcagaatcagagtttttaatgtctatcttagaaatgataggctattgtttaaattattttggaattccttatgcttttttaaaaaaaaacattatgtcaccaaccttatgctctttataataaatgcaaatcactttccaagaagtttggtgtataatgtgaatttaacttacatcatttagcccaaataatgatcttgtgataatttgatagcaacttatttattgaatactattctgtctcatgcagttagctaggcattgtgaggaaataaaagtagtaaaagcacagtattttctttttaaacattaatgagttcacttactaacatgtaaaataatgaaaattttaatgataaatagaatacttaaaggctttttaattttttaaaaaaagactaacaggaaaacatgtgcttaaggactaaattctttcctagtaacagtgaatggtaaaagagctaagtagtggaaaatgagcattaaagtcatcagagaggttctgtggaagctatgaggcccaagtggtggctttggaattggatcagggaggagacatttcaagcaggggatcagtgatctcatgagcaaaggcacaggggcagagtggagcacaggctctagcaggagccatgaggggacagcatacttactgcatgactttcctgttggagtagtagggaacaagcctgggatgggttcatttgatgggtaaggaaggctttagattagcatctaacatttgccgtaataatgttttgtgttgttgaagccctaaacacatcgtctttataagctttgaaatagatggataggtgcaccttctctaaataggatgtgacttgaagaatgttttttacttaaccataattttagaactgaacaagtatccttagaggtcattactgtgactaagagagatgaaagggctgtcccaaatttacatggttagcctgtggcaaagccagggttaagaactcaaatatgggcctggtatagaggctcatgcatgtaatcctagcactttgggaggtcaaatccggaggattgcttgagcccagttgttcaacgccagcctgggcaatgtatggagaccctgtctctacccccaaaataataacaataataaattagaagggcatagtggcacacatctgtgtccttagctactggagaagctgagaggggaggattgcttgagcccaggaagttgaggccgcagtgagctgtgattgcgccactatacctgggagacagtcagaccttgtctcaattaacaattcccttttttctttttttcctttgagacagaatctcgctctgtcgcccaggctgggtgcagtggcacagtctcggttcactgcaacctccacctcccaggttcaaacaattctcctgtctcagcctcccgagtaggattacaggtgtgcgccaccatgcgtggctaatttttgtatttttagtagagacagcgtttcatcatgttggccaggctggtctctaactcctgacctcaagtgatctgcctgcctctgccttcccaaagtgctgggattacaggcatgagccaccacacccagcagagatcttgtctcaataaaataaaagtaagaactcaaatatgtctgctggtgcccagctgttctctccctcctttccctctatagattttttagaatatttaataataataataaaagaagaaaaatggctgggtgcagtggttcatgcctgtaatcccagcactttgggagactgaggcgggcggatcacctgaggtcaggagttcgagaccatcctggccaacatggtgaaacctcgtctctactaaaaatacaaaaattagccgggcatggtggcaggcgcctgtaatcccagctactcaggaggctgaggcaggagaatcgcttgaacccgggaggcagaggttgcagtgagctgagattgtgctatcgcgctccagcctgggggacaagagtgagacttcgtctcaaaaaaaaaaaaaaaaaaaaaagaagaagaaaaaggaaaagctgttcttgaaggtagccaaaggttctgagattgattcctaccttcaacctgagaacatcagaaacatctttctcctataattttctgattaatttcactgcagtaatccagaatggggttgttttattacatttgtgttttgtgattcaagaactaagacaaatatattaatcctatgaaaaaacatattgcttttaatatttttactaatttaaaaaggcgtttatccaagtttcatcaccttttcttcccctctgctcagtgtatatgccacttgtgaaccttcccgaggatgctgtggtttgttctttaattcatcgtcatttttctggcttagacaagtaatgagtactttcatctacttaaatgaccaagtatttcatctgtctaataactgctgagtcttatttgtaagttatgttttaccagatttttgagaattataaagatgaatggataagtcaaaagtctcagaattaattttaaaattaaaatgggcttcagaaattatgtagcacaatttttttttttaattctggatgagtagtgtagctctaacagtcttaaggtcacacccaaagttaagtggcagagtcaagattagaacctgggtctcctgattctgttttctttcttttctttttttttttttttttgagacggagtttcgctcttgtcacccaagccggagtgcagtggcgcgatcttggctcactgcaacctccacctcccgggttcaagcagttctcttgcctcagcctcccgagtagctgggattacaggagcccgctaccatgcctggctaattttatatttttagttgagacggggtttctccatgttggccaggctggtcttgaactcttgacctcaggtgatctgcctaccttggcttcccaaagtgttgggattacaggcgccagccaccgtgcctgggctcctgattctgttttctagttctgttttccttctttagcatatctctttttggtttagattgcttttctgtcctgtgaagaagctttgtttttagagatttcctcaatgttacgtgtgccattataagaactaggcattgtatatttgtatattttgttgcgtgcttgtagctagattttttttttttaacatataagggttttagaataatacctgatccataagtctctcctttctcctcccccttttttcttttctttttttttaagacagagttttgctctgttgcccaggctagagtacagtgatgtgatctcgggtcactgcaacctctgcctcccaggttcaagcaattctgcctcagcctcccgagtagctgggattacaggtgcctaccaccacacccggctaattttttgttttcttagtagagacgggttttcaccacgttggtcgggctggtgccaaacttctggcctcaagtgatccaccacctcagcctctcaaagtgctaggattacaggtgtgagccaccatgcctggcctctttctctccttcttctccttctttgtctctctcccaccctcctctttctccccttctttcctccctacaccttctttggcttcattcttaggcagtgtctttcagggttgagaaagatggccactggcagctatattcttaattttatattcttatataaaattcttaatttttttgaggtatattcctaatattttttttttttttttttggagactaagtctcactacgtcactgcagctggagtgcagttgtgtgatctcggctcactgcagcctctgcctcccgggttcaagcaattctcctgtctcagcctcctgagtagctgggactacagacatacgtcaccacacccccggctaatttttgtatttttagtagagatggggtttcaccatattgatcaggctggtctcgaactcctgaccttaggtgatccacccgtctcagcctctcaaagtgctgggattacaggtgtgagccaccacgcctggccagctcaggtatattattatggttcaatatcttaaaatgtctgtatatcaggtttctccaaaagggctttgggcctgcttgaatcacaagtctacttcttcggtggggaaagcaaaacaccaggaccaaatagaggaatgggatggttcctaggggtgggtttccctttagaaggcattcaggcagacaaatcttaagtttctatttggcctttgaaactctagctgccgtttatgaagaactgctgtccttcataaatgtgtttcatccaaagtgatatgctcttggttttcccattcttgcccatggccctaacttctattttgcttgctgtgtgtcttccccactttgtctctttctctgtttcccagcttcatttaattacatccttctatcttcctagattcaattaagttctagtctcctacaggaagatcctagatcatcccacgactgtgttatgtgactgttctttaaactcctataagtagcacttactgcattgtagacacttgtcctacataaaccataatggttattataggattagcaataatttagcatgtttctcataattttctaagcacttcacatatcttagccttatgaagtaggtattagttatgaaaactaaagcttgcagaggtttgcatcattgggcatgtcttaaactctcaactaggctaatacttgcttctgtgttttcgtagtgcctaagcatagggtggtgatggtggtgatctaagttccatgagagcaggacatttcaccatttggtttactgctgaatcactaatgcctggagtagcgattgacagtatgtgcttaaattggtaaatgaattatctggacaaatgtggcatggtttaaacttcagaggtttggattaggtgatcctctaggttcctttcactttaaagttctgaggttaccactgggggaaaaaaacaaaaaaacaaggaaagagctgagggtgtgaaatagaaggagtcactgattcgtttgttagtaatatgtaaattatgagccgcactaatattgtttataagaaagcagactgggccaggcacggtggcctgtaatcccagcactttgggaggccaagatgggtggactccttgagcccagaagttcaagaccagcctaggtaacatggtgaaatcctgtctctaccaaaaatacaataattagccgagcgtgatggcacgtgcttgtagtcccagtactcaagaagctgaggtgagaggataatttgagcctgggagacggagtttagggtgagctgagatcaagtcactggattccagcctgggagacaaaaggagacgctgtctcaaaactatgccatcagtatacagcagatactaaaaggtattgaaagggtagaaatttgactggggaaaagtagggttcaaaaccctaatcacttttttaaaaaaattatttaatatgttgtggtgctgttgattcagtgctgcctggtcaccaccagtagattagctcttgatgtcctgtccctctctttacccagtgcctgagtctgttgcttcggtcagccttgagatttcttctccagcagtgtttaaaaacaagtatgtgtgacctatgtaaaattggccttacatatctactgaaatggtgatgaatacatacatagagtacagaaaattaaactacataattaacccaatttcaccacattcagctctggggaacctacttgtgttgaaatgccatttaaagttggcttttggggccaggtgcagtgacacatgcctgtcatcccagcactttgggaggctgaggcaggcagatcacttgggttgaggagtttgagaccagcctggccaacatggtgaaaccctgtctctactaaaaatacaaaaaattagccgggcgtggtggcaggcgcctgtagtcccagctgcttgggaggctgaggcaggagaatggcgtgaatctgggaggcggatcttgcagtgagcccagatcgcgccactgcactccagcctgggtgacagagcaagactctgtctcaaaaaaaaaaaaaaaaagctgggcaggatggcatatgccagtagtcccagctacttggcaggctgaggtgagaggattgcttgagtcagggaggtcgaggctgcagtgagctatgatcgtactaccgcactccagcttgggtgacagagtgagaccctgtctcaaaaaaaagaaagaaaaaaactttattgaggtgtaatttacatacccaaaaatttacctgttgtaagtgtggaagtaaatgattcttagtaaaattacggagtcgaaatgattcttagtaatattatggagttgtgcaaccatcagtgtaatccatcgttagaacatttttttattaccctaaaagttcccttgagcccatttacaaagccagtcccttttctgacctacagtttcaggtgaccattgatctgcttcctgttatagttctgtatgttctagaaatttcatataaatggaatcatacaatatatattctttggtatcttgatttcctcacttagcataatgcttttgagattcttctctacaaaaattaaaaaaaaattagccaggtgtggtggcatgcacctgtagtcccagctactcttgaggctgaggcaggaagatctcttgagcccaggagtttaaggttgcagtgagctgtgatcgtgccactgcactccagcctgagcaacagagcaggactgtctcaaaaataaaaacaaaaaaagatagccaagcatggtggtgtacacctgtggtctcagctgtaggtgtctcttgcagaggcaagaggattacttgagcccaggagtttgaggctgcaaggcagtatgattgcacctgtgaacagccgctgcacccgaatagtctgggcaacataatgagaccccactcatttcacgtctccaaagaaaacatacaaatgccagatgaacacatgaaaaaatgctcaacatcattagtcattagagcagtccaaatcaaaaccacaataagatgctacttcttaccacatctagggtgactacgataaaaaaagataacaacatgttggtgaagatgtgaagaaactggagtcctcatgtattgttattgggattgtaaaatgacgcagccattttggaaacagtttggcagtgtctcaaaatattaaacataaagttgctttatgacccagcagttctactcctagggatatatcaaagataattgaaacacgttcccacaaaaacctgtacgtgaatgttcatagcagcattattcacaatatccaaaaagtagaaacaaccaaatgtcagctgattaatggataaacaaagtgtggtggatctacacagtggaatgttatttggctataaaaaggaataaagttcagttaccatactacagcatggatgaaccttgaaaacattgtgctaaatgaaagaggtcagtcacaaaagatgacatattgtgtgacttcatttatatgaaatatctagattaggcaaatccttaggaacaaaaagtagacgagtggttaccgaggggtaggggaaagtgggaaaggagaaaagatatgggatttcttttttggagtgaagaaaatgttctgaagttagatagtggtgatggttgtataactgtgtatatgctaaaaaacctttgaactcgactttaaaagagtgaattttgtgaattatactcgataaaactgttatttaaaaaataaaaagaggctggtccaaaggtagtgagttatctcaattgttcagtcagttacagattgaactccacgttccactctttccctgcttctcactgttgtacttgactagtctttaaaaatacagatggagccaggcacagtggctcaaacctgtaatcctaggacttgaggaggttgagatcagagaactgcttgagcccagaagttggagaccagcttgggcaacataatgagaccctgtctctacaaaaaaaaaaaaaaaaaaattttgtttaaattaggcaggtgtggtggcaagtgcctatatttgtagctacttgggaggccgaggtgagaggattgcttgagcttgggaagttgaggctgcagtcagccatgatccacaccgctgcattccagcctggatgacagagcaagaccctgtctcaacaacaaaaaaagagcaactttgagaaaaacaaaaataagtaaataaaaggaaaccaccaaactaccattttacacattctcaaaattgctcctgtcagtctttttgtacagccttttttaaaaaatagggcctttttctgtcaccaaggcagtagtgtgatcacaggtgactgcagcctcgacttcccaggctcaagcaatcttcctgctttagcatcctgagtagctgaaactaaaggcactcgtcaccatgcttggctaattttttttttgtatgtttttgtagagacagggtctcactatgttgcccaggctggtctcaaactcctgggctcaggtgaccttcttgcctcagcttcccgaagtactgggattacaggcatgaaccattgtgcctggcctgataacagccattttagtggttttgtagtaggagttcattgtagttttaatttgcatttccctaaggactgatgagcttcattcatgtgcatattacgcattatatattttctttggtaaaatgtctattgaaatatttagccaatttttttttttttttttttagacagagtctcgctctgtcacccaggccggagtgcagtggcgtgatctccgctcactgcaagctctgcctaccaggttcacgccattctcctgcctcagcctcctgagtagctgggactacaggcatcctccaccatgcccggctaatttttttttgtatttgtagtagacagggtttcactgtgttagccaggatggtctcgatttcctgaccttgtgatccgcccaccttggcctcccaaagtgctgggattacaggcatgagccgctgcagctggccatcaagttttaaattgagttgtttatcttataattgtattgtaagagattataatctcttctacatacaaatcttttatcagatttatgatttgcagatatttctcgaagtctatgacttctcttttcattttctttaatagtacctttgttgttgtcttttgttttttttgtttgtttgtttgtttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgtcttttgtttttttgtttggttttgttttttgagacgcagtctcactctgttgccccaggctgcagtacagtggcacaatgtcagctcactgcaaccttcgcctcccaggctcaggtgattatcctgcctcagcctcctgagtagctgggactgcaggcacaggccaccaggcccagctaatttttgtattttttagtagagatggggtgtcacccagttggccaggctggtcttgaattcctaacttcaggtgatccgcctgcctcggcctcccaaagtgcagggattacaggcatgagccaccatgcctggccgtttaatagcatctttgaaaagcaaaagttttaaattttcatggtgtcccatttatatattttgtctcttacagatagtgcttttggtgacatgtctaagaaatctttgcctaatccaaagtcacaaagattttttcctgtttataagtttttttagttttaactcttacattaggtctttgtcttgtcttttttttttttttttttttttttttttttgcataataagttagcaagtgagctacgttaggtctttgatctgtttggagttaacttttgcatatggtatgtggtcagtgtccaattgtttctgtatcatttgttgaaaaaaaatttgtttctgggttgaatataattatgttgaattatattatgtttgtagatagccagttgaccctaactttgtatgtttctttctgaacctgttctgttccagtaccacgttctgaacctgttctgttccaataccacgttgtcaataccatgctgagttggtacagtcttgctctgtcacccaggctgtagtgcagtggcgcaatcttggctcactgcaaccttcccactcccaggttcaagtgattctcgtgcctcagcctcctgagtagccagaattacaggcatgcatcaccatgcccagctaatttttgtatttttgctagagacagggtttcaccatgttggtcaggctggtctcgaactcctgacctcaaagtgagctgcctgcctcagcctcccaaagtgttgggattacaggtggtgagccacttctcccagcctgagttggtacatttataataacttttgaaatcaggttatgtaagcccttcaactgtttttcttcaaaattgttttggcttttctaggttttttgcatttttatataaattatggaatgagcttattttgtactttcttcaatatattggtcattttcaggattgccatcttaacagtattgaatctttcattcctgagcatgttatacctttccacttatttaggctggctttttttttttttaattccagctccctgaaattgttgcttttgacagttttatccttgttctttcatgtggagaaatcactaccctcttcgtgcctgcataacctagaagtcactctgtagtgtttttttaaccttaatgacctactttatttccttctatctaaaattttttttagtgacagagtcttgctatgttgcccaggttggagtgcagtagctgttcacaggtgtgatcatagtgcactacagcctcaaactcctgggttcaggtaatcctctctcagtctcccaagtaaatggggctacagacgcaccattgcacccagctccttttatctttcaattaaaagaaaaaagttttcttgtaagacactagctagataggattttttatattgtactagctgtaatactttgtagaaattccactgtagtggaggagaaaactgtaatatcttgtaacttttgttttgtgtctctattttaagggtctccaactgaattccttgaagagaaaatggcctaccaggaatacccaaatagccagaactggccagaagataccaacttttgtttccaacctgagcaagtggtcgatcctatccagactggtaagtgttggcttgctcgtgactactaaatgtgtgctatgacataaatgtgaaaaagctacaaccaccattcagatgaaaatgctttagcttaagtatagatcacaaagtacaaccttagcattggtttgtccctttctcttcttcatttatcctttcctttgagacacttaatgccctctagttccctgctcttcaaaacctattttaaatacattatgtgaaattcatatacactgaagattagaggatccatagtaccttagaaccttaattcttccagaaggaattattatggtaatgttaaaccagtgctgttctgtgccaggcacagtgctagagcctttatatacacattatcggtatttcttacctaactctgccaaatatatgtatcctcttttgacagaagagaaagctgattcatacccactttctataaaattaaaaacagaccaggtgcggtgggttatgcctgtaatcccagcactttgggaggccaaagtgggcggatcacctgagttcgagagttcgagacaagcctgaccaacatggagaaacgctgtctctactaaaaatacaaaattaggcaggtgtagtggcatatgtctgtaatcccagctactcgggaggctgaggcaggagaattgcttgaacctgcgaggcggaggttgcagtgagccgagatcgcgccactgcaccccagcctgggcaacaagagcgaaactccatctcaaaaacaaacaaacaaacaaacaaacaaacaaaagcctatctgtagtagcccagagctagagttggtaggaagaatgagttccaaaagagccttaaaggaatagctttggtacttccctgttagccagattgagagctcaagttatgtttccacttaaatatggcttcttttttgacatctaacttataagatgctcatcgtttgtttcaaataacctagtatgtgatgttctgtaccatttgtcagttatcggctttcctaggtacaaagtaattatggggggagggtgaagaaaaagctgtattgagatacaattcttttttttttttttttgagacagagtcttgctctgtcaccctggctggagtgcagtggcgcaatctcagcttactgcaacctctgcctcctgagttcaagcgattctcctgcctcagcctcccatatagctggaattacaggtgcccactacacccaactaattgtatttttagtagagaccaggtttcaccatgttggccaggctgatctcaaactcctgacctcagatgatctgcccacctcagcctcccaaagtgctgggattacaggtgtgagccactgcgcctggccaataattcacagtaccatacagtttacccatttaaagtatatagttcggccagattcagtgacttgtgcctgtaatcccagcactttgtgaggcataggtgggatgatcacttgaggccaagagtttgagaccagcctgaacaacataatgggattctgtctctacaaaacattttaaaagttagctggttgtggcagcacatgcctgtagtcctagctactcgggaggctggggtgggggaatcacttgagtctgccacttcaaagctgcagttacctaggatcgtgcttctgtactctagcgtgggcaatacagcaagaccctgtccctgatagatgtgtagacagacagacagacagataggtagagtagatagagtagataaatggagtaacttaggccaggcgtggtggctcacacttgtaatcccagcactttgggaggccgaggcaggcggatcacctgaggtcaggagttcgaggccagcccagccaacatggtgaaacctcgtctctactaaaaataaaaaaatcagccgggcatggtggcgggcgcctgtaatgccagctacttgggaggctgaggttggaggatcgtttgagcccgggaggcagaggttgcagtgagccgagactgtcccactgaactccagcttgggtgacagagccagaccctgtctcaataaaataaaataaataaaatagagtaacttaattccactgaattggccgggcgtggtggctcacgcctgtaatcccagcactttgggaggctgaggtgggcagatcacctgaggtcaggagttcgagaccagcctggccaacatggtgaaaccccatctctactaaaaatataaaaaaatagccaggcatggtggtgcacgcctgtaattccagctacttgggaggctgaggcaggagaatcacttgagcccgggaggcagaggttgcagtgagccaagatcgtgccattgtactccagcttgggcaacgagcgaaactctgtctccaaaaaaattccgctgaattgtactctatctacttacctatctatttatctatttatggttataaccataaccagattcaattttagaacacttttattaccacaaaaagaaactctgtaccttttaaatatcacccccatctccctatccactgcaaccctaagcaactaccaatttgctttttgtctctataaatttgcttagattggacattttatataaagggaatcatataaagtggtttctttgtgactgctttttttcacttagcatactgttttgaggagtcctgcattttgtggcatgtatcagtactttctttatggacacgtaatactccattatatggctataccatattttgttcattattttatttttttgagacagaatctccctctgtcgcccaggctggagtgcagtggcacagtctgggctcactgcagccttgaccgcccaagctcaaatgataagtacataaataatttaaatcaggaagaagaggagccagcaagggtaacaaaggaatgaccaattttgagtaggaaaaaaaattcagtggagtttaatttcctcagcggaaagttgagtgtggtagtcaactgccaagatggcgtccaatgatccctgcctcctggtattgatacccttgtgtagtcacctcccatgtggtactaggtttggtctgtgtgattgtagaatagatggcagaaataatagtgtgtcatttctaagattaaattacagaaaatatcatagcttcagccgggcacggtggctcacgcctgtaatcacagcactttgggaggctgaggcaggtggatcacgaggtcaagagatggagaccatcctggccaacatggtgaaaccccgtctctcctaaaaatacaaaaaattagccaggtgtggtggcggatgcctgtagtcccagctactcgggaagctgaggcaggagaattgcttgaacctgggaggcggaggttgcagtaagctgagatcacgccactgcactccagcctgggcgacagagcgagactccatctcaaaaaaaaaaaatatcgtagcttccatcttgatcactctgtgtttactaatcatgaggaaagccagctgatatagagaggcacacatgggagaggagcagaggcctccattcaacggccacgtaagccatcttaacaggcaggttctgcagccccagtcaggtcttcagatcaccacagcccctggccaaccgctggactgcaaccttgtgagaaaccctagtcatggagctgggggagaaataggttctggggcacattttgaaggtcaagggcaatggattttctgatgggttggctgtggtgtgtgaaaaagaggaggtccaggatgactccaaggttttttgcaaaaaacatagaaggatagaatgccattagagatggaaagactatataatgagtagatttggaaacatgctacataaaagtctgaaaataaggtgagaggtctagaggtcttgaattataaattcaggtgtcatcaacctatagatggaattttaaactgtgggattagaggagagggaatgtagagagagaaaaggtttgtcttcctcctcataaccactcagttctttagttctcagcttaaatacttatcaagcaaagatctcccttgacttgaaccaaaatatatcctgtgggaacatatataaatgttcccatccctgaccttgtacatctttgggttttttagagcatactgggtctgccatgtggtaggcacccagtaaaaaattaatgactaaatgacagaactctgtaagaatcatctatttttacaagtaatttagcaagctcccatcttaaagtgcaaaccatccagaatttagtctgtttgatgctttaagaatccttttttccctcaagggggaagtgtgagaggcagagcaagcagcgagctatcccaaaccatatagaactgggaagaatgaatgtttatcatctctctcatattctatctccccatcttttctttttcttaattttgttctgtttttattatttattttgagatggggtttcactttgtcacccaggctgtagctcagtggtacaaccacggctcaccacagactcaacctccccaggctcaagtgatcctcccacctcagccttccgagtagctgggactgcaggcatgcgctaccatgcctggctaatttttccgttttttgaaaataagggtttgttttttttttttttaaacaaaaagcaggctgtgttttttgtttttaaagatgggcggtctcggtgtgttgcccagacaggagtgcagtgactattcacagtcgccatatcatagtgcactgcagccttgaacccctgggctcaagaagatcctcccacctcagcctctcaagtagctggggtgtgtgccacttttccaggctcccatggttttctgaagaagaagcctcaacaagtttcccaatattgccttctgcttgttcacacttcccgatgcagtggtctcccctaatcctgaaatttcttacaaaaagagggtggtatagctgcctcagagccaagaaaatgaacattctctcaaggcctgggcttttatgcggctgtctctgacaattgaagtgtcttaagggagtgatgtgttagtgtcactcaggaactagttggaaatgcagattctcaggaaccagcaatctttatttttaacaagtcttcaggatgattaagataataaaataaattccaagaaggcctcttcagaaagtggaactcttgtttagcctgaacagctttgcttttttttcttttttttttgagacagtctcactctatcacccaggctggagtgcagtggcgccatctcggctcactgccacctctgcctcccgtgttcaagcgattttcctgcctcagcctcccgggtagctgggactacaggcacgtgccaccacgcctgactaatttttttatatttttagtagagacggggtttcactctattagccaggatggtctcaatctccagacctcgtgatccgcccgccttggcctcccaaagtgctgggattacaggcatgaaccaccatgcccggccctgcttttttttcatgtacaaaagcacaaagagtttacctgatgttttgagtgcttttattcatgccagctcctgagtcaagagtttatttcttctgttaggataacaattgtttatcttgtcccattcagacagttttgaaatgcagttttcttcatcatgtccacatgaggtgaaaaattacttgttggtttttttttttaagcttgttaatggctctgtctttttaaaaagtaacttaaaatgaatgttatataaatatatattgaaaatttagtttatactttcacctctcagagtgtttgttatacagctgagcattagttgccctttttgttttatgcatttgttggctatctgatgtacataaccaaatcttagagaagggattatttattattaactcataacaaatgaattagtgaatattgattctctaccatgtgcagtcacatatgatttcggtttacttactattgacaactcatctatattcatcataggataataagaaatattggccaggcatggtggctcacgcctgtaatcctaatactttgggaggccgaggtgggcagatcacttgagatcaggagtttgagactagcctggccaacgtggagaaaccttgtctctacaaaaaaatacaaaaattagccaggcatggtggcgggcatctgtaatcccagctacttaagaggctgaggcaggagaattgcttgaacctgggaggtagaggttgcagtgaaccaagatggcaccactgcactccagccttggcaacagagcaagactccacctcaaaaaaaaaaaagaaagaaagaaagaaatattaatctttctagttgcattcaccaggaatgagttttggatttcttctatattccagatccctttaagatgtaccatgatgatgacctggcagatttggtctttccctccagtgcgacagctgatacttcaatatttgcaggacaaaatgatcccttgaaagacagttacggtatggcttcttcaaatggatttattctgtagggaaggaaaaaaattttttctttactcatctttggttcactgactagggctctgtgacaaaagattaacaagaaaaaagagaccaaagtttaaaatgtgaatttaatatgtacatgagaggtacctagggaatgagtaactccgcaagaggtggctttagaattccaccttatatagcttcttcaataaagaatgacaaattttttttttgagaggtgagaagatgaaggaaaagacttttgagtctctaggggccgcaaattgtgggagacaggtaaatggtaggtaaaagctagttagtaaaggttgctgtgtagattcctatggtgccatctccaggctaataatagccttcagcttaaaaaagtccttatgccaaagtagcgtattttggggtggcatattctggtgtcctttagttgtttaatgccaaacaatcaacatggcctttcacacatcacctttgaagctaaccactaagaaaagtcagatttaggggctgtgggtgtgacaaggctctctttggattaatcaaaggagacaattcacagattcacagttgggctgtcatctccccttttttttgagacagggtctcactctgtcacccaggttggagtgcagtgatgcgatcacggcccactgcagccttggcctcctggtcaggtgatcctcccacctcaatctcctgagcagctgggattacaggtgtgtaccactatgcctggctaattttttgtagagatggggttttgtcacgttgcccaggctggtcttgaactcctgggctcaagtgatccacccgcttcagcctcccaaagtgctgagattacaggcgtgagcctttgcacccagccacatttttctacttcttcatttacaggcagacacagtggctcatgcctgtaaccctagcactttgggaagctgaggtgacaggattgcttgagcccagcaatttgaaaccaatctgggcaacatagggagatcctgtcctacaaaaaattttaaaattcatccaggcgtggtggcacatgcctgtagtctcagctactcaagaggctgaggtggaaggattgcttgagcccagaaggtcgaggctgcattgagccatgatcatgccactgtactccagcctggacaacagagttgagaccctgtcttaaaaaaaaaaaaaaaaaaaaaaaaccatctgggtgcagtggcacacgcccgtaatcccagcactttgggaggccaaggcggatggatcacttgaggccaggagttcaagaccagcctggccaaaatggtgaaatcccgtctctactaaaaatacaaaaattaggctgggcctaatggctcatgcctgtaatcccagcactttgggaggcagaggcgggcagatcacctgaggtcaggagtttgagaccagcctggccaacatggtgaaaccccatctctactaaaaatagaaaaattaggccgagtgtggtggctcatgcctgtaatcccagcactttgggagacggaggtgggcagatcacctgaggtcaggagttcgagaccagcctggccaacatggtgaaacactgtctcgactaaaaatacaaaaattagctgggagtggtggcagacacctataatcccagctactcaggaggctgagtcagaagaatcacttgaacctgggaggtggaggttgcagtgagctgagattgtgccattgcactccagcctgggcaacgagcaagaatccatctcaaaaattaataaataaatataataaaaataagaaaattagctgggcaaacaacaacaacaacaacaacaacaaaactgctacaaagtattttaataaaattgtcttctaatgttggaaagggaggtgttaatctcattttgcagatgaagaaattaagactcgcagttttttactatagtatattatgttggttgtggtgttggaactagagttcaatcattaatattttgaatctttatattaccctttatatattatatagaaagtagccagtgaatgttgattaatggcactactgggatatactataccacctactaacaactagctaaaacctgaagaatgtcagcagtgtttcctttaaaacttgtttgcgttgtcggccgggcgcggtgtctcacacctgtaatcccagcacgttgggaggccaaggcgggtggatcatgaggtcaggagttcgagaccaatctggccaacatagtgacaccccatctctattaaaaatacaaaaaaattagccaggtgtggtggtgtgtgcttgtagtcccagctacttgagaggctgaggcaggagaatggcgtgaacctgggaggcagagattgcagcgagccgagatcgtgccattgcactccagcccaggcgacagtgcgagactctgtctcaaaaaaagaaaaaaaactttttttgcattgttttttattagtctgtgtcttcctggcaatatatgcagctgattttaaatatcaaatacctcttaggccgggcgcggtggttcacgcctgtaatcccagcactttgggaggccgaggcggttggatcaagaggtcaggagatcgagactatccgggctaacatggtgaaaccccgcctctactaaaaatacaaaaaattagccgggagctgtggcaggcgcctgtagtcccagctactcgggagactgaggcaggagaatggcgtgaacccgggaagcggagcttgcagtgagccgagatcacgccacttcactctgtctgcgtgggcaacagagcgaaactctgtctcaaaaaaaaaacaaacaaaacaaaacaaaacaaaaatatatcaaataccttttgtttccaatgtttactaagtttcaaaatgtatttgtttgtgtttcaatattaggtatgtctccctgcaacacagctgttgtacctcaggggtggtctgtggaagccttaaactctccacactcagagtcctttgtttccccagaggctgttgcagaacctcctcagccaacggcaggtaaactattagagactccctttatcagttaatggttgcagtattggtaatcaatataaatcatcaggtgtattttttagcagcttacagcaggtataaaaatttcagaacaatcacaaatgttttgcttatattagtgatatcaccactggaggaattaaattgttgaactataacacttagggttaacgggcacataaatactttttttaaattttttaacatatatatatttttttcatcacattttcattgtattaggtatcagaatttttttttttaattcagtacagatttacggcctggtgtggtggctcacacttataatcccagcactttgggaagctgaggcaggcagatcacttgaggtcaggagttccagaccagcccagccaacatggtgaaaccccatttctacaaaaaatacaaaaattggtctaggcacggtggctcacgcctgtaatcccaacactttgggaggccaaggcgggcagatcacctgaggtcaggagttcgagaccagcctggccaacatggtgaaaccccgtctctactaaaaatacaaaaaattagctgggcgtggtggcaggtgcctgtaatcccagctactagggaggctgaggcaggagaatcacttgaaaccggaaggcagaggttgctgtcagccgagattgcgccactgcactccagcctgggtgaaagagctaaataaataaataaataagctcagcgtggtggcgtgtacctataatcccagctactagggaggctgagacaggagaattgcttgaacccgggagccgagatcatgctactgcactccagcttgggcaacagcgtgagaccgtgtctcaaaaaacaaaaacaaaaattcagtacagatttagaactctggagtttttcttgataggaagcatgactgacctgctgtcccacagattatctttctaatactaattctgtgcccgtgttatttttgaagcctatgttttctctcttctttgccatttctcctccactacttgtcctcccagtattttacatcttattcttccaagtgttgagactgtcaaagagtaggcagaatatgttacttgacattagcttcttcttctttttttttttttttttttgagacggactcttgccctgtcccccaggctggagtgcaatgccgtgatctcggttcattgcaaactccgcctcctgggttctagcaattctcctgcttcagcctcccaagtagctgggattacaggcgcctgccactgcatggctaatttctgtatttttagtagagacagggtttcaccatgtttgtcaggctggtctcgaactcctgacctcagatgatccatccgcctcggcctcccaaagttctgggattacaggcgtgagccactgtgcccggcctaacattaattcttagttatgtgtacagtcttatggtcacaaaagccaaatactctcatgcctgaagaaagtaagcatttttaatgcaaaggtatgagtagacaatgatgtgtcctaaatttccaatttagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccaggtacgtgcttgtgcttattctcagtatttctctctaccaggttgtagtctcgagaagactaaggacaaacatcatgccaggtaaagtacagacagtcacactgtactttgcaagtttattcatactcctgctctcctagacaactctttcccgcctttaccctcctcccacctccaacaccttttctatgttcattctctgctgattgtcctgtttttcttgcagataagtcaagcaataaaatagaacatcgacaaacttctattccattatctacccaactacttgtatctgtatccatggtctctgcttatgaaagttcccgtttttataagtaaactgttcctgctcctaattaagaccaacctctcctcattttgccctagattccatctcctctttcctactcgatatattgccccatgtattcttcccttttttgcccctcataccaatttaaatcttttttcattggatcattcccacccatttaacaaacgtttgttatttttcccatcttaaaaaacgaaacattgaccgggcatggtggctcacacctgtaatcccagcactttgggcggccgaggtgggcggatcacctgaggtcgggaattcaagactagcctgaccaacatggagaaaccccgtctccactaaaaatacaaaattagccgggcatggtggcgcatgcctgtaatcccagctactcgggaggctgaggcaggagaatcacttgaacctgggagacggaggttgtggtgagccgagatcgcaccattgcactccagcctgagcaacaaagagtgaaaaactccatctcaaaaaaaaaaaaaaaagtaacataactagacataccttcccaacttcagcttccaactaccacttcactcctttgctgccccttgtaggagaactcctcagaaactaatcccatatccaatttctggcagatggaaaatagctgaaatcatgcttctctgaaacgtgtgtggcttttgttattacctttagaaaccgtcacaggaacggggaaaaagtgcagcttgccggccgaggaggattctgtgttagaaaaactaggggaaaggaaaccatgcaacagtcaaccttctgagctttcttcagagacctcaggtaagttaggaaaacaaaatgaactctttgaaacaaattaggggcgatagagtagtgatggtagacattgtctctagttccctgttgtatggtggtaatcagcagtatagtttatgaagtcaattctcttagacagattttatctggtttagacagaatgtcagcttgttatatctttaaaaattactactacagcaaatcaggatacctaattttttttttctccactgttttttttgttgttgttgtcgttgtttttttttttttgagacagagtctcactctgtcgcccaggctggcgtgcaatggcgtgatcttggctcactgcatcctccacctactgggttcaagcgattctcctgcctcagcctcctgagtagctgggattacaggcgcctgccaccatgcccggctaatttttagtagagatgaggtttcaccatgttggccaggctggtctcaaactcctgacctctggtgatctgcccacctcagcctcccaaagtgttgggattacaggcgtgagcgaccgtgcctggccttctccactgttttcatagtgaagaaaggacacccaaattttgatctggttcagctattcactattctatcctgtgtggtcttaagcaagttacataacttgcctatatctcagtttacttagctataatataaattaattggtcaaatgttctctaaagtcttactagttacagtgttccatggcccaacagcatctacattacctgagaggctggtagaaatgcagaatcttgggctctaccttaggcctttgtaattattatctgcattttaattagatccccagataattctaattttcattaaactttgagaggtactgctctaagatactttccaatttaaagtttgattattcagtgaatttgaagattacctgtttttaataacccagaagcatatgtatatgattatcaacttgattttctgtttacttttctgtgactatgattggaatgtggacatcctgacatatgggacataagggcccatgacttatttcacttagaatctctaatgctttgcacactacctagcacaagactagagcttaaataaatgtgtgattttttttttaaatgttgttttactgactcaacaaatcagtaaagatttatcaagtgcttatggtatacaaaatacaccatgttaaggcatatagatatttaagtccccgtccttgccccctgaattattatattataacctgaatgaagagataagttctcaggcatgaactctgaaacccaagatttacataataattgaataaaatagtataaaagatggcactgaatagctgctgattaattgctgaattaaatgttataaatactgggggatactatagcctagcaattttttgagcgatgcaataattaacctgagatattaaacaaaggctaggatttagaggatattggaggggtaaggacaagaatgaaatccactatttacatattataatattcttggaaatcaatttattgggtcagacttgacaggagctggcatatacctgctcttaatgagactcttgccaggatcttggatccatattatattaactgggaggaaggttagaccagatcacctgctgaaactcttccaaaggtactcatcttaattgttaaaattaattatcctacttaacattatatatatttctctgtcttttgggaagtacatttaggagcagaatgttgaaatttaacatatttgtctttcaaagtaggatgctctggttctggaatcatgagaatttttctctgaccaaaatgtggattcagtatattttgtgtgtgtgcgtgaagtgacttaagtctggccttctgatctagttcccagaatctgtctggtttgtttgacaagtattagtttaatattggtgacctagtcttagaattataaattttgtccaaaatcatgtatatttaactgaagcaattaataaatttcaccaaaaagaggcaagcactaagaatgaccaatataaatcagatgagatttacaggcagtaagtgcttatttttagaggttaaaagatgtgaaatgtttcatttttaaaagttcaatcctgctacttctgaaatttcaaatattttataaatgtttgaaaacaatctttacctgagatgatgatctgttaaatatttttgctagcgccagttaaaagtgagaaatgttttagaaaagactgttttcctgagcaaattacagtaagtactatatgtattagtgaaaatagcctccttaaattagtcatttatatggtctggtttttttgtttgtttgtttgttttttgttgtttttaagaaacaataacgaggagttttttgtttggaattttagccaacttcatgtattgcggtacccctcccacacaagccaaacaagtttgcagacccagtgaccgcaggtcaacccggcccaagcctgccagggtccctcctgagctgctgggaggctctcctccatggaagactcttgatcacaggctgggccactgctctttgtctgagtcaggttgggtctctggttcatcctcctgtggtgggcctgggaaccaaagaaaaagtattcatgttgactcacttgaaccccagagggatcttggcagggaggcctgggatatagaaagcacaccaataatgatgaagaaaaagaagaagaaaccaaagcaaaagagatattctcaaccacgggctggaggaccttcggatgatgacaatgcagataagcctaaaggtcatccatttgcagctgacacacaaaaatcaggtgttctccccagccagcctaccactatgggtacagaatatggacttgtatctggagaaaacttgaaaagggaatgtttagttaactccagtgcagccagactggtagctgagaactttgtctcagagagtctcagaattcctttatatccttctgaagaagcccccaaaactgcaataagttctcagtctaagctgagagtagaggaagagagcaaaagtaacaagtcagtactacaaaaccaagacaagaaattgctgaagcaacatgaatacaaaccacagcctgcaccccacctgaagactcctgtagataaaagccagtcagtaggccctctcaatctgaaaggacccctagcagaagtttctgcatacaatgtagaaacccctttggatatcagacttaaagagggttgctctcctttcttggaccaagaggttatgggtgtagtttcaaaacccacagcagcaaaagaaataccaaatttggtacccactttgatagcaagtaatccattagaatgtaatctaaaagaagggaataatgaaagtaaaatgactaaactgcagaatgtcaaactgaaggagtttcctgaaggagctgaagaggataaagaactaaaaaaggaagcttttcccaacgaaagacaagagatcagcatctttacttctgagcagctgcagggccaagtgttggtacaggtccctggggtagagaatgaaccatttaagagaatggcaggtgatggcaaaagcaggaagggaaggggaagttctgggaaaatgagaacagattctgggaaggtaaaagcaaaatctgagctgccatttcttctggacagccagaaggacggaagggctgttctcataccgagtgagccagtctctaaaactgaaggaatgactactcaggataagagtgaggagctggggctgaattcttcaaagcaaccaggcactaaggctgatctcacggaggcagtggtgatgggggagcctaaagagatgactcagcctaaggtggcaggcaccatgcaggcattgattcctttggaaagtggatcaggcatgactcagacttctggtgttagcacagaaacaggagatgtagtcaaagatatgggtgtcaataaccagagcaaggaaggaaggtgtccatggaaggatcatgaggcagctccctggatttctgaaaagcctaaaaagagaggcaatgaaggcaaaagcaaaaagtttaaaaataattattccacacagcctgctagaatggagaggaaggaagaaatccttaacccaccttttgaagggaaggatggagatactggtagtattccccataaaagcaaggaaataggatttactttccccaaaatgcatgattcttcgttctcacatacaccagatacacccacagtggaagcagttgacaggaagggtggaaattttcaggttaattttgttgagcttgggactcttggggaaaacaagataagcacagtcaaggcttctactgttactgaaccacctgccaaggtgacagatgtgagctgccaagagcaaatccagggggcaggatttgttccttcagtagtatctgaggagaataagacagatgcagccaatagatacactgcagtggctgacaaaccaagtaaaaggagtaatgatggaaaaagtaaaaaggttaaaaatagttctcctgagaagcacattctggagaataagatagatgcaacaaaaatacatgttcccatggaaaccacaggggaccagggaattgaaggaatggcctatatggacgaaaatagaaatattacatttacctgtcccagaacaccatcagagctgataaataaatcatctcctctagaggttctggaatcagcagcctgtgaaaaactgcccactcctactcctcaagtagtaaaggaaggtgattcctttccagataccttggcaaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccatagaaacagttaacattcatggagatcactctcttaagaataaagctgagcttgctgattccatgaaaaatgaagcagggatcgatgaagggcatgtgataggagaatctgagtcagtgcacagtggtgcgtctaagcattcagtagagaaagtcacagagctagcaaaaggtcacctccttcctggagtgccagtagaagaccagagcctaccaggagaggccagagccctagaaggatatgcagatagaggtaatttcccagcacatccagtgaatgaagagaaagagactaaagaagggtctgttgcagttcagattcctgacttactggaagacaaagcacaaaagctcagtttttgtgaggaccaaaatgctcaagatagaaattccaaaggttcagatagtttgaataagaaggtagatctgactcttttgtctccaaaaagtgaaaatgataaattgaaagaaattagtctggcttgtaaaatcacggaattggaaagcgtttccttgccaacaccagaaatccagtcagatttcttacatagcaaagtcgaagctcctccttcagaggtggcggatacgttagtaataatgactgcttccaagggtgttcgactcccagaacccaaagataagattttggagacacctcagaaaatgacagaaaaatctgaatcaaagacaccaggagaagggaaaaaggaagataaaagcagaatggcagaaccaatgaaaggctacatgagacccaccaagtcccgaggacttactccacttttgccaaagtctacaatccaggaacaagagagacataagcaactgaagtccgctggtatgaacctgccatggggaaatgtgtgtgcttgtggcttttgagtcagcatcagaaaggcaaagagcttgtgtcttggctccatccagactctaatcatccttgttaatcattggtttgttggcatgaaacctataactgctacggtgtgttttctgcagccaatgtgttccttgtgtcctgcttgaggaggctggtaacttggttgcatgccttttttacccagcactgaacgttgaattttaggggaagttgaattttcaatgaattgtctaacaaaagacctatcatcatccatttcttaatttttttaaaattgtgcctcctatgtatcaagtttacagctaaattttaatcattacttggtataaggattcacaggaggaaagaaaatatttcatgtctagctatgtgcatgagatttttttcaatttatatgtagcttgtgctggtgggactaaatatccaaactgcttttaggttaaatgaaatcagtccacctccttatgaggaaatggtggcctcaaaccagcattggtaggcaccgatttatttgtgtttctagtaatgggaaatgatctctcaatgatacagatacattttttgaccagtttgttgcttatatccattgccccacagttccatgtgggtttgagttttgggcatagtctgtgtccatcaaacatagtccataaaacttgcccatgttgtgttcctcataattttactcttttttggctctattcagtcaagtaattggaatgagattaagaagatgattcctttaagatttagaaatggtagccccgtttccccccacccccaattccccaaaaaagtatacatttaatcgtggcttccctgaatctagctttcaaaaaatgttcccttgtctttgagatttttcacagcctacaagtgacactatttcttaatcactgtttcccagcttgcatgatgtagctactaactccagaatttaaaaaaaacaccaattggttttagtagccagtcaggcttttagagaggtttcatcatgggattgtgttctgcatggtatggacttgttcttttgggtaaagcttgtctatgcatgagtatgtacccactaaggaatactgctgtgtgagtaaagaatgctaaaggttgttatttgcataagacattctcatcttctctgtttttatcttctattagctaccctattaccaaggcagaaaatgaaatagtatgtagagggctttccagcattcattgagatttccagtgttctatccagttctttcgttttggtttctagacccattctttagtttcagcagtgatctaaaagttaacatgtaatttctgtgaaatcccagccatctctttttgctcagtatttccaaagaaatgcagaaagaggatttgtttttcttgaggaagcaagaccagtactgcagaacttttggggccctgcctgggtcaggtcaggctcagagactgtgttagcagtggccttacagagtgggtatgggaaggataatgggtttgggacaaaatttattgtttcttctataaattctaccacacctttcccctaaggacaatgtatacctttttaatagttaaaaaaaaatttttaaactaattgtcgaataggttaatacattcacatggtacaaaggagtatacagtaaaacgtaagttggcctccctccattaaccgccttccagctttccctctccagagcaaccagtgttcacaatagcttatatatccttccagacaatttatgtataataagtaataacatatatatttcctgatttcatataaatgagacgtatacatacatactgatgtgtgctattctttttaaacttaatttttaaagagatcttttaagactcagtataaagaagccaggcgcagtggctcacacctataatcccagcactttgggaggccgaggcaggcggatcacctgaggtcaggagttcgagaccagcctcaccaacgtggagaaaccccatctctactaaaaatacaaaactagctgggtgtggtggtgcatgcctgtaatcccagctacttgggaggatgaggcaggagaatcacttgaatctgggaggtggaggttgcagtgagccgagatcgcgccactgcaccccagcctgggccacaagagggaaactccatttcaaaaaaaaaaaagaatcagtataaagaaagaggcctcttttttttgtttttttttttaatcttttttcctggtacatgtctctagatatgactcattcttttttgatagctgtatactatttcattacataggtatatactaatgtattatagtactttttttttttttgagacagagttttgctctcattgcccacgaaggagtgcaatggcatgatctcagttcaccgcaacctctgcctcctgggttcaagtgattctcctgcctcagcctcccgagtagctgggattacaggcatgcaccaccacgcccagctaattttgtatttttaatagagacggggtttctccatgttggtcaggctgatctcaaactcccaacctcaggtgatctgtctgcctcagcctccccaaagtgttggaattacaggtgttgagccaccgtgcctggccagtacttctttactgatgcacatttaggtgtttcccaactttttttcattagaaatatggtacataaactatctttgtatctataggatgtcatcttcatgtgtgtgcgtctgtgtaataaaaaggggctccggagtaagaatctctggtttgaagaatatgtattcataattttgatgggtgttccatattgctctctgtaggcctacagagatgtcccttgtagagaaaggtacatctctactcccaccctcaacatagacaaatacctgtttccctgcctttctctactagtgtgattttttttttttttttggttatgtgtactgatctaatcggtgaaaaattatttcatggcatagattttgtgtgtgtgctgttttttgtttgttttttttgttttttgagatggagtttcactcttgttgcccaggctggagtgcaatggcacgatcttggctcactgcaacctccacctcccaggttcaagcgattctcctacctcagcctccctagtagctaggattataggtgcctaccaccacgctcagctaattttttgtatttttagtagagctgggtttcactatgttggccaggctggtcttgaactcctgaccttaggcgatccacttgcctcagcctcccaaagtgctgggattacaggcatgagctaccatgcctggctgtgttttattttttttttagtgacttcttcatgtattaacaagtttataaaagccaatccatgctctgaaattatgaaaatattttcttttctcttctattaatatttttcattttaaattgttggccaatctagaatttgcttgtttgtggggttttttttttttgttgttgttgttgttttggtatgttttgtttataaggttgtgaggcagggttacttggtcatcccaccatcatgtttataatcgatctcccactgaactgccacctttgtcataccctaaatttctgcatgtatttggtctatttctggactttctttcctgatccattgatctttccaccaggcttcctaatatattttaatatctaatagggctagcccaaccccttgccctattattctttttcagagttgtcctattcttattttttagttttgtagaagaaaaattaatccactcaatatttttcttgaagtcactgtttctagcttatcgtagggagagtttatgtcttgcatatcgagtttttctgtcgaacagcataatgtgttcacatgttttgttagtccatcactggtgtttatctttgttcctcactttgaatcattcatgttaactgccctgcccccatattgctaccaattctcacatatcttgttctcattcgtcttgtggtcaaatggtgtcacccatggtttccattgtttggacagtaaagatattacaaatggtgttggctgggcacagtggctcacacctgtagtcccagcactttgggaggctgaggtaggcaaatcacttgaggccaggagttcaagaccagcctggccaacatggtgaaaccccatctctactaaaaatacaaaaagtagccacgcatgatgttgcatgcctgtaattccacctactcaggagactgaggcaggagaatcgctctcttgaacccaagaggcagaggttccagtaagccaagatcacaacactgccctccagcctgggcgatagagtgagtgagactccatcccccgccccgcccctctctagcccccccgcccaaaaaaaaaaaagatattattagtggtgttagtaaaaataatagtacctctaactaatccgggtgttaataataatagcactggccaggcgcagcagatcacctgaggtcaggagttcgagaccagcctggccaacatggtgaaaccccatctctactaaaaatacaaaaattagctgggtatgacagcgcacgcctgtaatcccagctactcaggaggctcaggagaatttcttgaacctaggaggcagaggttgcagtgagccaagatcgcaccactgcactccagcctgggagacagagtgagactccatctcaaaaaataataataataataatagcacctaccacctattgagttgattttatttgcctggttatctggaaataggtaaatagatcatacacacacacataaaataacactattaaagattatctccatttttcaggtgagaaaatggaggctgtcaaggtcacatagctggtgaagtgccagggttagaatttgaatccaagtctttatgtttctaagatccatgcttttcttagacttgcttcagaagcttccggaagtttcaggtacttaaaaagaaaaagatgaaggttgacaattagtaaacataaaatagactttttttagtatctaggcactaattaaacacttttctacttggagaaataaagatacatcatgaaaatataaactgtgaattagaggttaatttaggattagaatctaggtcttttgactctgtctagcattttattgtccagagagtctgtgtttgatttatttacatgtactttttaacacccagcctagagctttatatatacatgatgcctaatgacattttttgaattataagtgaattatctttttgctgatcttaccctgtttagaagtagggaaagtgaatatattgccaaagtctcttccagcttactgtttgctctactgttattttttcatgctgctgtcaaatttagggaaactttaacagaaggtttctttgcatactatgcatgttcttccaggcagggaagattaatgcaatacgtcaggaagtctaagctcaacttttcagaaaaggactttttttttttttttttttgagacggagtctcgctctttcgccaaggcgagagtgcagtggcgcgatctcggctcactgcacgctctgcctcccaggttcacgccgttctcctgcctcagcctcccgagtagctgggactacaggcgcccaccactatgcctggctaattttttgtatttttagtagagacggggtttcaccgtgttagccaggatggtctcgatctcctgacctcgtgatccgcccgccttggcctcccaaagtgctgggattacaagggtgagccaccgcacctggccagaaaaggacttcttatgggattgtgttttttgtgaagggaagcacaaacttgaaaggatgatccacattagattccaatacccgctccatgttagttgttcccctggaaaccaagtagaactgtgagtgacagtgtacttgctatgctgctactgtgaatgggacagtttgggatccctgtaaataggccctccctttgccatagtgaagcctggtcttcttataatctggctttcatttctttcttcagtttgcttgagctcatcaactgtctaccagcagctgggaatgtcagtttatggtgagaaactctcttggtgtgaaacttgaagtaatttataaacccagaattctaacagtttcaaggcccttgtacataaataaaatatgctcagcagatgaaaaaaccatttgttatcttagaacttgctactattttacaactggagaagtacccatttggtaatgtcttttcttaactgtagtgccatttgtgaagttcctttcctcattactctcaccccacttgccctctgattcaactggcttctttttttttttttttttttttttttttgagacagagtctccctctgtcgcccaggcaggagtgcagtggcacaatctcggctcactgcaacctctggctcctgggttcaagcagttctcctgcctcagcctcctgagtagttgggattataggcatgtgtcaccacgcccggctaatttttgtatttttagtagagatggggtttaaccatgttagccaggctggtcttgaactcctgacctcgtgatccacccacctcggtctcccaaagtgctgggactacaggcatgagccactgcgcctgactccactggcttttttttactaccatgctgatgaaatttattgggactagtcacacaactaaaaatagctaccatttattgaaccttactatatactcattgccatcctaaactcttaacctccaaaaaatactgtgtggtcattaccttgtttgagccagaacatttaaatattctttgaaatgaatcaagcaacaattgattatcctactttgttttgttaaatttgtatttatttttttgagacaaggtatcactttgtcacccaggctgaagtgcagtggcatgatcacggcttactacagcctcgacctcccaggctcaagtaatcctcctgcctcagcctcccaagtagttgagactacaggtgtgcaccaccatacctggtgaatattttttgtagagatggggtctcactctgttgcccaggctagtctcaaacttctggcctcaagcaatccttcctccttggcctcccaaagtgctgagattctaggtgtgaggcaccatgcctggcttgaatatcctactttaaaagaagcttcttcccctcatattccctcacccttcacttgtaccctctggttgacaaatagcattgggggattctgaacacactgttaaaataaaaacttagttttgatttacagtattgcagatatagttatttctttaagatatggaggtgacagtaagggggcttccattcttttttttttttttaaatagggtcttgctcagttgcccaggctggggtgcagtggtacagtctcagctgactacagcctccgcctcctgggctcaggtgatactcccacctcagttgcaagtagctggaactacaggtgcgtgcctccgtgcccggctaatttttgtattttttgtagaggctgggtttggccatgttgcacaacctagtcttgaactcctgagctcaagtgatccgtccacctcggcctcctgaagtgtataaacattgcctattgctctgcaaatagcggacacacagcatgatttgtactttttagtatttagtttattcattcattcagtagataccaagtgacattactcctactctaaaaatagactaataaaacacattctatactcttcagagattccagggtggaaaacagacagttttcctctagtaagagaagtttactcctctgaaaaaggatagaagtgtgagctagatcctatggaaatacagagcagaaagggactaagttttcctacaagacctagagaaatcttcacacaggagactctgaaagtatggctaagagtttgctgagcaaattaaggtaaagaattctaggggacagctgtgtaaaggcatgcatagtgaagtgcaggtgcatggaataaagtcaagtttggggaaacagggacatctgttaaacattttgagatgaaattggggaaaagaaagtaagctcctaaaggatcctaggggtattgtgtgcctctaaaagcagaagatcttagatttttgcttgaagaaatgggttatctttctacctagtttagttggatgattctcttttcttttggggagggctatgggagggtccatactagacttaaaagaacaaagacttgatatttccaagttgtagtttttagagttgttgttgttgttgttgttgttgttttgagacagtctccctctgtagcccaggctggagtgcagtggcgccatctcggctcactgtaatctccacctcccaggttcaagcgattctcctgcctcagcctcccaagtagctgggactacaggtgcacaccaccgcacccagctagtttttgtatttttagtagagacagggtttcaccatgttggccaggctagtctcaaactccagcaggtgatgcgcctgcctcagcctcccaaagtgctgggattacaggccttagctaccatgcccggcctttagaggatttcttatccataagcattttcatgtctttggttcacatatatcagattattcgcctcagcttattcattctgtctgtttgcttctcatcctttttttaatcagggagaatcatgatttattttcttgagttaaaacatgagaaatgtttctaaaatgtagaatatggtttctgaaatagttttacctttatgtatgtatgtctaaacacttggaacgtttacttccagggaagaaactagattataacttgacaactttatcttttattaacaaggagtgagtgtcatcaatcattgttaatagtagaattattgactttcattgtaatgataattgtttcctggaggcaataactgggaacagttggtcaatctggaaagtagtgttgccttggtaactgataagaaagaatgcagagaaactagttgtctgtcatgtataaaaaccaaggccctgaacaggttaaatactaactccaagcacaaggctaaaacagaaatatctgccagtacatgtactgggattagagacctgcaggctttgccaagagtcctggaaaccaccttctgcccagacacacaggaatccatgcgctttcttcaaactcagacagaatggaatagaacttcacaatatttagctcaaaggacattccagatcaccaccgcttgggttgggttgaagacagctttaatgatggaacggatcaggtcaaatgatgcagatgcagtgtaaaaggaaactacccatcctttcactgagcagatcttttttgaaagcttatttactgtgagtcaagcactgtgcagtgcacccacatggcacaaatgcacagttcacattcctaccttctagaagctcctgggaaagtcatataaataaaagattacagtgtggtttctaaattctaaaaagagatagagtattatgataatataaagaactcaggaggggttcaaagagactttgcagaggtgagtgagtaggaataggacctagaggcaaggggccgggtgcggtggttcacacttgtaatcccagcactttgggaggctgaggcaggaggatcacctgaggttaggagttccagattagcctggccaacatagtgaaaccctgtgtatactaaaaatacaaaaattagctgggtgtggtgattagctgggacacctgtaatcccagctcctggggaggaagaacctagagacaaggaatcccagtggcagctgaatctaggacttagtccttctggttcttaagtgtgtttctttttacctaggcaggctcacccttttcaaacttcatgtatttacctcatccaccaacttgatataattttacagtggctgggagattggagtttcttgctgtggctatttcctgtggataaatctgcatccctgattgagattatgtctgtaattcttatttggactggagtactgaactggccattctcagggtgttctgtgggttgttttgttttgtttttaaacaaggtctctgtcgctcaggctggagtgcagtggcgtgatcatagttcactcactgcagcctcagactcttaggtttaagtgatcctccttcttcagcctcccaagtagctagtactatgggcatgcaccaccacacctggctaaaaaacatttttttcttattttttttgtatagatgtgggtcctgctatgttgcccaggctcttgaactcttggcctcaagtggtcctcccacctaacccttctaaagtgctggtgttacaggcgtgggctactatgcccagtctttcttgagttttactaattattctatactagggtttccccatcatttgtcatccaggtggcattcacctcatttggggtgcaacaaagccattaattattcttccatttaatatctttgtatgccttgcaaaagcaatagtgtaatcttttttttttttttttgaggcggagtctcgccctgttggcaggctggagtgcagtggcgcgatctcagctcactgcaacctctgcctcccggattcaagcaattctcctgcctcagcctcccgggtagctgggactacaggtgcgtgccaccacgcccagctaatttttgtattttcactagagacagggtttcatcacgttggccaggatggtctcgatctcttgacctcatgatccacctgcctctgcctcccaaagtgctgggattacaggggtgagccaccatgcccagcctagtgtaatgaaactagaagctactctgtcccttccccctctgtaaaagcgtctggttctctgctttttcttagtgaggctgaatctgtcttcctactcagaagccacatgaaaggaaacttacagtgctaaggcaccatagaaagatattaacataaatctaagttctcttaagactggaaattagaaacagaagtttgctaaggaataagtcacccacatcttactctttgcataattaaagcaggaccattctttcttttttttttttcccccccccgatatggagtctcactctgttgcctggcctggagtgcagtggtgggatctcggctcactgcagcctccacctcccaggttcaagcgattctcctgcctcagactcccgagtagctgggattacaggtacctgccaccacacccagctaattttttgtatctttttttagtggagacagggtttcaccatgttggccaggctggtctcgaactcctgaccttgtgatccgcccgcctcgacctcccaaagtactgagattacaggcatgagccactactcccggcctcaaacaagaccgttcttaagatataaagtaaacaccgaaaccaagtgcattgcctctttttctcccttacttcaaacacgcgtttgctcccctaaacacacatacatacacacacatgtgtatgcatactgtgtattaatttgggagttttggagtgatcacaaaagaattaaattataattccaaattaaagtttgaagtacttcaatgatcacaaaaaagatacattgggccgagcgcaatgcccacagctgtaatcccagcacttggggaggccgagttgggcagatcacctgaggtcagaagttcaagaccagcctggccaacatcgtgaaaccctgtctctactaaaaatacaaaaattagtcaggtgtggtggtgtgggcctgtaatcccagctactccggaagctgaggcaggagaatcgcttgagcctgggaggcagaggttgtagttagccgagatcatgccactgcactccagcctgggcaacaaagcgagaccccctctcaaaaaaataaagatacatcgaaaaggagagtcatctagtgactaagattaatttttgctcagcggtttgggaagactggcagtcagaaacctagcatcttctttgtggcttttccattaagttttcaccatgtgatcatgggcaaaccactttttttctctggacaccattttgttcctctataaaatgaggggtctgttagggaagcctcagcattctgactctgtactgtcacacatactttagtgtctttgcagtactgttgatggatataatggacccttgtcctaaaagggattcagggaataggttatttactttccttaggcagtgccccagattttgaaatttagcttttctttttctcttatctgttagtgattgcaattacgatttatatgttgtttcttgtgagtagtagtggttgttttgttttgtttttgtctgtctttaccagagtgcagcagttctccagtccagggacttaggctttctcacttttgttgttgttgttgttattattactacacatcagattccctatagggagtaggaaaacctacttcatatatatatatgtacagtttcttggttgtttttttgtttgtttgtttggagatggagtttcgctcttgttgcccaggctggagtgcaatggcatgatctccactcactgcaacctctgcctcccgggttcaagcgattctcctgcctcagcctcccgagtagctgggattacaggcatgtgccaccacgcccggctaattttgtatttttagtagacacggggtttctccatgttgttcaggctggtctcgaactcccaacctcaggtgatcctcccgcctcggcctcccaaagagctgggattacaggcgtgagccaccgcgcccggccttcttggttgtttttttaaagctagcatcagtagatacattatgtatttgtgtgttttaactactttgtcaaatgctttttatatatattccctcaatcctcacggctatgtgttttgttgtactcagacccctgggtgaccaccaaacttatctgtatgcctgagcacctggctgacatgatgtcttgggtactcgccccttctatgggcttgaacttcttgttctgaccgcccccccaccccagattgcttctttcaactctctgtctcctgagccttgtaactatgaagccagtgcttggcccagttgctagatgttgacctcataattatattttttcagtttgaccacatttctgatctacacagtatgaactgtagtctggaatatgcacttctttgtgcctgactagcttcattcttctggtttctgctcttggtcttttggctggttcacattttgcagtctgctgtttatggatagaattactgaggcagaatatgtgatatctgaaggtagcagagacctgtaattttagttattgccttagctgttgggtagggatgaactagtgaagtgggtctgggtaggctggccagaactaaaaataatttggctataaggaacaagtttctatgcttgttctttgccttggtattttccacttcttcagaatataagggccaactaccactttcttcagacatgctgcaacgtccgccatgcccagtcatgcctctgccaataggcagcactcccgcatgagacagaaaggttactgaagatactgcctagtggagtcccaggttgaagtcatactttgagctggacatagcagtgggcctgtgattacttgaatggctgtttcaacttcagaagtgaaagtggtaaaactgaatccaagagcaccttaaagattcccctccttttatagaggaagaaactgaagctaagagcagttaaatgagtttctaagactcttaactattaagtgacacagattttaaaatctggccttctgactcaaagtcaaattaattttttccccaccatgtcagtaaattaagggtgtatatgtgtgtgtcgtttgtggggggtgactagtttacacagaatggggttgttgaggcttacctgatttctaaggtattttccagagttttcctctggtatattcagactgtattacaacaatatcttcctcacccccttttttttttttttggacagggtttcctctcacccaggctggagtgcagtgatgtgatcacggcccactgcagccttgacttactgggctcaggcaattctcccacctcagccttctgagtagctgggaccacaattgtgatcaccatgcccacctaaatttttgtactctttgtagagacagggttttgccatgttgcccaggctggtctcaaactcctgggctcaagcaatctgcccacctcagcctcccaaagtgctgggattacaggtgtgagccatggcacccagccatctccagactttcataattttcctcacatattgtacatacttaattatattattcaattatatgtataaaaaaagaaagcaagaattcaactatgttgtattaccaaggcctttctgtacccaatctcgcctcatattttttcttttttttttattttttgagacggagtcttgccctgtcgcccaggctggagtgcagtggcgtgatctcagctcactgcaagctccgcctcgtgggttcacgccattctcctgcctcagcctcctgagtagctgggactacaggcacccaccaccatgcccagctaattttttgtattttttagtagagacagggtttcaccatgttagccaggatggtctcgatctcctgacctcgtgatccacctgccttgggctcccaaagtgctgggattacaggcgtgagccaccacacccggccaatcatattttttcttgttactaattagaatcatgattctcctggcattcttcattttgttatacctcacttccttttccttagcaagatctttgccatagagtatggaaaccaggttccttgccagttaatctgtattgtgctttgtcatgtattgttactaaacagctcaagatcaaggggaagaaatgtatatgaggctcagttcatgttcagtttttttttttcagcattgcaacattgccactcatcatcatgagtgtagccctgtgtcaggtactgaaggtaatggaaaaggtatataaggttgatccctgtactcttgttgggaacttgagtggtatgaatagagaaggtgagttcttggggacagaggctacagtttagcaagctttcctatgcggaccttggtaatttctttacattttatagaccaaagaacaatcttaacttgcccttttttctaaaggcattgtttaaaaactgtcatcaaatcattgcagtttatggcaaatggcctttttttaaaaaaaaaaaaaaagcaatctaaatcttttcttcatcttggaaaaagacttctcttggatttctgatagaatatttccagtatgctatgttattgcaagacagtaacttacagctagacaagaaaaatcagctttgttcaaagtaagagtatagcctgtccttatagtgtaatttttttctcacagttttgttttatggttccttcagtttgaatatacaatatttgagctcaaagcccagggcagcaaaggaccatgctgagttaaatgggggcagtaagctctggtgagtggggaaaactccaagctacaattgttagagtccctaagtctggaggtcagagaaagatgcactgcccccagtgtgttcacatgacacctaacagattattaggctggaaagagcagggcttggtagtggagggagcaacccagctcatccaaggaaccaagtgggggcagggacaggcgtaaatgcataaggggtatgttgtcacacaaatgtcttataattagaatatctatccccaaagccctgatcactgaagtctttaaatgaaccctttattaaactcttccattatgcagagctacagatggagctcttacgggttttggggaccccactcaagtcagttttcaagttagtttgataagttgctatgacagcaaacccactcttcctctgagaatgaatgcctgcaatcttaatactacgttaaggtgtggttttttttttttttttttagtccaattttgaacaatttcctggattcattgttcttcagggttatagctggggattggcaaatgagtctcggttatttttaaaacagttttctgagtggttgaatgtggaagggtgggcatggtatcagataaatgagtgtgtgggtatgcacgtatctatatcagtgaaagccaaaataattactatccttagtgcttggattggcaccatactgtgttttaaattgcagatctaaacagagtgctagttcacgggaaattacattctcagattaaagtagcattttgttgtgcagaaagcagcaggttccttcctttctttcgctttcattcattcttcctttctttctttctttcacatttgtaagtgcatttaatactcaactgcttgaggagagaggggcattgagggagagatgaattttgtcatgaatactggggaattggtgtgatgtcactgcaagctctgtgtgatcgtaggtggtattagagctccaggagcgaaagcagggagagcagtggaggagagacgatgtcgctctcagacaagcagacagcctctctcactgccgcgtacggtcagctcagtaagggcaagcctgcagagtgccgaatggactccccaaaagaaatcagtcaagccggattcgaatggcagaggacagagggcaaactgaatgaaattgggctgaatgtcagcatggacgggcaaccaaaagatgggcttgtgaagaatgccagcttcctggagcagaacaagctctgcttttttgaggggaagctagacaaagagctgagcattgaaatgcaggacaaggactgtcaagaagcctcaggtcaccttgagagcaggtatgtgatttcagagacctgccatcccttggaggggaactcggtacaccagaagacctccgagttccatctgggactcatagaggggccagacaaaaacaaaaccattccagttcaggggaaggtggcagggaagaatggactagagaccaagagccagtcagatctggatttccctggggctgctgacatccctaccagatatgttaaggagcaggaaaccagtgtttggaaccccagctttcatccagtggctcaaggctctctgggctcaagggaagcaactccgggagagatggagaatagcatcacccctggctgcccagtgattggggtggtaaatgataactctgagcagctgaagtgtgagtccccactcctggtgtctctagcccacccagcccccattattgagcattcacccaccaccattccgccaatcactatggtgttcacccaggaacatttgaatgcaagctgtcacatcagagaccatgataaggagttggagaaattgagttctaccgaggaggctgtgctcaaccaagccccccagcagaaaaaggcagtgcgcagggccctgtctgaatgttctcacctctcagttcccccagctgtcaaccttgcagataagtaccctgaactccctgcccgagaagagccttcttctggcctgctgcctccccctagtagcccaatgcctagtcctacacctgggaaactgggagctcctgctatgaagcgctccatgactgtgggtgaggaacagacagctagctacaaattgagccctgggaaactgcccatcttgtctactaaagagatacctcctttcatctgtgaggaaccagtggccaagaagagagaagaattggctcacttcagcaacagcagcagcaactctgggaagaaggaactcggcactgctggattatatctccatagtaagctggagcagattcctgaaggaagcagcaaggaaaaagggcaggaagattttagtgaaactagaattgattcatgctcgcaggtttgccagcgaggagagaaacagccaggacagacggctctggcagggaagaaagaaattgaggtcactgcaacccagagcactccatcgttcctgtttgaaaagcccccacgtgatggtatgtttctaaattttgcctccattgggaacaagcagacagcaaggaaggaaccaaagtgacagattaccggcagagcactaagcagctttttacagctgggttctgtgactgcctggggaaagcttaattcccttgtgttggaagcttgctgggagtgaggcaaggaagagaacaaagtgaatcttgcagggtcaagctgaatgtcttgctagcatgacagataatgtgaattgagtgtgcaagtttggggtggaatggggtcagagaatggtgggtataaaaactagaccccctttcttgacctcatgtcaccctgtccaacccatcccccatccacccagccctcagctccctgttggtttgaaccagatgattcctgagctctaaatccttcaatcccaactgattgatttccttgcttgaaaatctgtcactttatatagattcacaatgggtttatcagcactaacctcctctcattaagttgcacaatctgggtggaagctctgttttctgtttttgctttggagaacgttttacttttgttcaaactgaaaaagagccctttaaagctagctatttaatattctttctgtgttcttcatgtttgacccaatcttgcttctagttttctctttttgtatgtgttttgagaggatttgtggggagaaaaagaagaaagagaaagcagggagagaaggagagacttgcaacctaataaacagctaaattttgcggtctttgtgacagccttttgtgtctttcttcctggccctttcttttcttccccatctcccatccccccacagctcttattgtggtggtctaaaaaagcttgtgtttctccgagtccagtttgagcacaaagggccataattcacaaacttgtaaatggggatttaaaacatgtgttttgcttgtttaaaaaaaaatagtcttgtttcctgggacctgttttctctaatatttattactctcagtatatttttatgaaattgtactttttttctttgaaagtaagaaatggtattttctaggggagtggtaagtagaagacatacagatgttttgggttttttttttttatggagataaaaaacattttttgttttttatggagataaaaaacacgtttttttatggaggcaaagaagcttaatagttcctctttgatttcttatgactccagaattacaagcattcaggtgtcccatgctgttgcttccttctagctgggacagaactgtaagctcttcctggacaggactttgtcatctttttcttgatccccaggtgctttgttcagtaccacataacttctaggtgatcatgagtgaagactttgtttcagaacaagttctttctaattcagactaacagaagtttgtgctaatagaaaaaaatttcagatgactgacaaatccaccgatccattcacccgataaatgtttaaatgctgactctgctaaccactctgtagataaaacttttataggaagattgtttcatttaacatgcctaccatttgcattcactatctaggcactggaaattatccttatcctcaagcaacttttgatccagttggaggactgggaggcagtgggagggttgtgaattgtggaaacattttggaggaagtcacatttgaggtgggccttggaaccctgggatgccaaataatgcggagggaaagccttccaggcaagggaactcatattaaacaaagatatgaagcctagacagctcatgttaggtaaaagaacaatggaggaatctcagggcatccagtcacaggaaatgtggccaggctgctgccattgtgtatatctctcttgggacctctgcttctccctgcacatgtactccattctcttccctttaaaaatctgtatttcctctgtcatctctttttgcttcccttgtaactctgcccaggacagaatagcattgagttgccatggtttgagctctgtggccagctttgttaccaccatatatgtcagggttccgatgttgcatgactgtcatttccatgtctttgtctatactgacaatgagtgagtaattatatcttattggctcagcttggtccagtcaactctataccaggtcccatagccttcttaaccaatctgagccatttagacccacccgcttcattcaccttgaggcttctctaaaggagagagtataggttaaggaaatattccaaagccgtctttacatatgtgacaagaaataatgggagaaaattctagaaagttgtttggaatccaatcttgctaagcttcaaatgtcccactgaaaagtttaaagcttactactgtgtctggaattggtgggttcttggtctcactgacttcaagaatgaagccacggaccctcgcggtgagtgttacagctcttaaggtggtgcgtctggagtctgtcccttctgatgttcagatgtgttcggagtttcttccttctggtgggttcgtggtcttgctggctcaggagtgaagctgcagaccttggcagtgagtgttacagctcttaaggcagcgcgtctggagttgttcgttcctcccggtgggtttgtggtctcactgggctcaggagtgaagctgcagatcttcgcggtgagtgttacagctcataaaagcagagtggacccaaagagtgagcagtagcaagatttattgcaaagaacgaaagaacaaagcttccacagtgtggaaggggacccgagcgggttaccagtgctggctcgggcagcctgcttttattctcttatctgggcccacccacatcctgctgattggtagagccgagtggcctgttttgtcagggcactgattggtgcgtttacaatccctgagctagatacaaaggttctccgtgtccccatcagattagttagatacagagtttcgacacacagattctccaaggccccaccagagcagctagatacagagtgtcgattggtgcactcacaaaccttgagctaaacacagggtgctgattggtgtgtttacaaaccttgagctagatgcagaggttctccaaggccccaccagagcagctagatacagagtgtcgattggtgcattcacaaaccttgagctaaacacagggtgctgattggtgtgtttacaaaccttgagctagatacagagtgccgattggtgtatttacaatccctgagctagacataaaggttttccaaggccccaccagagcagctagatacagagtgtcgattggtggattcacaaaccttgagctaaacacagggtgctgattggtgtatttacaatccctgaggtagatataaagactctccacgtccccaccagactcaggagcccagctgggttcacctagtggatctcgcactggggctgcaggtggagctgcctgccagtcctgcgccgtggtgcgttcgcattcctcagcctttgggtggttgatgggactgggcgccgtggagcagggggtggtgcttgtcagggaggctcgggcggcacaggagcccatggaggggtgggaggctgaggcatggcgggctgcaggtcccgagccctgccccgcgggaaagcagctaaggctcagtgagaaatcgagcgcagcacttatgggccggcactgctgggggactcagtacaccctctgcagccactggcccgggtgctaagtcccccattgcccggggccagcagggctggctggctgctccaagtgcggggcccaccaagcccacgcccacccggaactccagctgacccgcaagtgctgcgcgcagccccggttcctgctcgcgcctctccttccacacctccctgcaagctgagggagctggctctggccttggccagcccagaaagggggtcccacagtgcagcggcgggccaaagggcccctcaagtgccgccaaagtgggaacccaggcagaggaggcgccgagagcaagcgagggctctgaggactgccagcacgctgtcacctctcactaccatgttctgaaactgtggtgactgcctatgatagcagataaagtagctccaggtcagctttaggaagatttacttgttctcagtaagtgtgatgaactggaagacaaagagttgaaagcaaacaatcctgttagaaatttgattcaggtagtggcagatgaaacgctgaggatatgagaggggaaatataacaggtgaagataaagtgaaactggaatttggaaggtgtgtgagaaaaaggaattgaaggtcatgctgtgatgtgaggctggttttcccagccagtggtagtataggtaatggaaagacccaacagaagagcacagttcattgaaggagttagtaagttccacatcagacattgcttttgtgaaactctggggatatgtgggtggtggtctctagaaattgcctgatagctgggcttggtggctcatgcctgtaatctcagcactttgggaggccttggcaggcagattacttgaggccaggagtttgagaccagcctgagcaacatggcaaaaaacccatctctatggaaaaatacaaaaattaggtgggcatagtggcatgtacctatagtcccaactgtttgggaggctgaggtgggaggattgctcgagcccaaaaggacaaggctgcagtgagccaagatcatgccactgtgctccagcctgggagatagatcaagatcaggtctcaaaacaaacaacaaaaaagaagttgccttatatatccatgagacaagggaaagggcttggtgagaactaccttctgggagagagaaagcagtttctgcttatgcacagttacatttatttgtataggtcgagttactgcatgcctgtatcatagacaatgcgactttatgaaatatgttgtttactgaaaaatgctgaacttattgaaaaatatttatagtggtctggggccagtggcagctagttacacaagtaagatcttctttgagcttgctgtagaacaaaggcattagccgggcgcggtggctcacgcccgtaatcccaacactttgggaggccgaggcgggcggatcatgaggtcaggagatcgagaccatcctggctaacacagcgaaaccccaactctactaaaaatgcaaagaattagttgggcgtggtggcaggcgcctgtagtcccggctactcgggaggctgaggcaggagaatggcatgaacccaggaggcggagcttgcagtgagccgagatggcgccactgcactccagcctgggtgacagagcgagattccgtctcaaaaaaaaaaaaaaaagaacaaaggcgttaacaaatttgcacagttgttggctatggtttttccccattacattttaaaactagaaaaatactcagtttttgactaaaagtacatatggttcaaacatcaaaaagtacaaagtgctctccattacaaaaacctcctaccaagacaagatggtatcatctcattgttttctgctcctcccctgtaaatacaactaaatagtctggaaataattgaagataattccataaaagaatatgaggtagaaagaaggcaaacctggtagggatctcaggacttgaggaatggcaatacagtgaattccctgggactgatgaattgattgattgattgattgattgattgattgatggtagagatgggatcttgctatgttgcccaggctagccttgacctcttgacctcaagtgatcctccttgcttgacctcccaaagtgctggtattacaggcatgagccactgcgtccatcccctgggttttctttttgtctcctacatatccctggctgggcactggagaggcctgtaacctggaattaccaacaggcatagactgaaaagaaaaggaaaggaaaaaagaaaacaaatagagaaaatctgttctctattgccaaaaaaacaagaaagaaaaaaacccagcaaagacctaatggtgagccctgtttcactacccatccccagcagtgggctcagtctgcctgcaggtacagtgtcaatgcagcccataagggccttcctgttgtccactccatactcagcagaagctataggcctggtccgcccacatcaccagcaactgcagggaggcctgtcccctaccaggtaacagcaccagtggcttctatagccctggtgtcttgtaatcctctacccaggggcaggagactttcgtaggtttcagaacctctacttccttccccttagcaagagaaagcccccgaggtaggtgtttcctgctcccagcaaccccagcagagatcaaacaggaggtctgcctgggtcccaggcagccagagagcagtccagaggaagctctctattctatgtttccagcatcactcagcccctatgtgctgacactgggtgacacaggtaagtccctacagccctttcaggcagtaccaaaagggattagttagaaccttagcagaatcagaacacaacaggccataaatgcattgcaagggctctaggaaccaaattgtcatcagaactacagtcataacctgtagactaaatataaacagggtgattgcatgctaaagtacaaaatcagaattttaaagcagccatcataaaagtgctttaacaagcaattatgaattctcttgaaacaaatgaaaactaaaaacctcagtaaagaaatagaagttacataaaaagaaccaaatgttaattgtcaatatgaaaaatataataattaaaattaaaaacttcaatgggctcagcagcagactgcagataacagaggacagaatcagtgacgttgaggacagatcaataggatttattcaatctgaacaacagacgaaaaaatggtctacaaggaaaaaacatatcttcagacccatgggacaataacaaaagatctaacatttgtatcatcagaatctcaggagaggagcaaggatgcaaggctgaacaactgttcaaagaaataatgacaacaaacatcccaaatttgacaaaagacaaaacttacagattcaagcaactgaacaaataccaaataggataaatgtggagaaatcatgccatgacttttcataattaaacttttataaactaaagacaaaaatctgtaaaaaaagcaaagagatatgatgcattagggaaacagcaatttttttttttaaccttccttatggtgctgaggaaacagcatttaaatgacagcctgtttcttatcagaaactggggaatgcaaaaagaagtggcacaacatttttcaagtgccaaaagaaaagaactgtcaactgcaaattatttggtaaaacaatccatcaggaatgaaggggaaataaataaaaaagacatttttagataaaggaaaactaagaatttgttgctagtagacatacccttagagaatggctaaaggaggctctccaaaaaaataagatttggtaacagaaggaggcttggaatttcagaaataaaagaacaacaatggaatgggtaaaaatatggaaatagccaggtatggtggctcatgcctgtaatcccagcactttgggaggccaaggcgggtggatcatctgaggtcgggagttcgagaccagcctgaccaacatggagaaacccccgtctctactaaaaatacaaaattagccgggcgtggtgacgcatacctgtaatcccagctactcaggaaggctgaggcaggagaatcgcttgaactcgggaggtggaggtcgtggtgagccatgccactgcactccagcctgagcaacaagagcaaaacttggtctccaaaaaaaaaggaatataatagacttatctcctcatgaattttttaaagtcataaatcatatttgaagcacaaattgtaatgccatctgatgtagtgcttaatctatgaagaggaaacacttaagacatattttagggctgggcgcagtggctcacacctgtaatcccaccacttttggagaccaaggtgggtggatcacctgaggccaggagtttgagaccagcctgggcaacatgacgaaaccccatctctactaaagataaaaagaaaaattagccaagcatggtagcgcacacgtgtaatcccagctgctcggttggctgaggcatgagaatcacttgaacctgggaggcagaggttgcagtgagccgagattgtgccactacactccaacctggacgacagagtgagactctgtctttaaaaaaaaaaattaaagtagggagaaaataaaggatcctaaatggaagtaaggttccagtaggtcactcaaagtagtaaaacatagctgggtgtggcggtgtgcatctgtagtcccagctactcaggaggctgaagacggcaggatcacttgagcccagagtttgagaccagcctgagcaacacagtgagaccccatctctagaggaaaaaacagtagtagaacattgataccagtttgttgtatgtatattgtaatacctagagcaaccactaagaaaactatacagagcaatatactcaaaagcttttttttaataaaaatagaattctaagaaatgttcaggtaaccttgggtgagatgtaatttgaaaaaatgaaaaaaggaaattaaaaagattaaaaatgttcaggtaaccaacaggaaggcaggaaagtgaaacagaaatgagaaaaagagagaacaaataaaaaataaaatatcagacttaagccttaacatagcagtaattattttactttatttcatttatttttttatttactgagatggagtttcactcttgtcacccaggctggagtgcagtggtacaatctcagatcactgcaaccttcacttcccaggttcaagcgattctcctgcctcagcctcccaagtagctgggattacaggcgcccaccacaacgcccggctaatttatgtatttttagtagagatggggtttcaccctgttggccaggctgatctccaactcctgacttcaggtgataagcccacctcggcctcccaaagtgctgaatggattacaggcgtgagccactgtacctggccatcaggaattattttagaagcaaatggtctgagtactacaattaaaagacaaagattggaagagtatattatttttaaaaaatgactcaagtaggccaggtacagcggctcctgcttgtaatccctttaggaggctgaggcagaaggatcacttgagcctaggagttcgagaccagcctgagcaacccagggagaccccatctctacaaataatttaaaaattagccaggcatggtggcacatgcctgtggtcctagctattcaggagctgaggtaggaggatcacttgaaccgaggaggtagaagctacagtgagtacagtcagccatgatcacacctgtcttaaaaagaaaaaaaaattgcccaagtatatgctatctacaagaaatgcataacaaacataaggacataggtaggttgaaagttaaaagatggaaagaaatatatcatgttaacaattttttaaagtagcagtagctatatataatgattatgcatatatatatatatatatatatatatatatatatatatatatatatatatagttgttttttcttgttgcccaggctggagtgcagtggcctgatcatagctcacagcaggcttgactcgctgggctcaagcaatcttcccacctcagcctcccaagtatctgagtcttataggcatacaccaccatgccccactaattttctttcgatttttgtagagaggaagtctcactttgttgcccaggctagtctcaaactgctggcctcaagtgatcctctgcctcagcctcccaaagtgctgggattaaagattacgtgtcctggagtgactatactaacatcagacaaagtagatgtcggagaaaagaataaaggatcaatcccactaagattgatccttacatttagaaaacttagcaattctaaatgtatacacaccaaaaaacagagcatcaagatatatgaaacaaaaactgacagagctaaaaggagaagtacacaaagtcacaattacagctggggacttctgtaacccactatgaacagttgatagaactactagacagaatgttagtaaagatgtaacagtgccatcaaacaacaaaatctcataaacattgatagaaattccactcagtgacagaatgtacattcttctcaggtgtccattaaacactcaccaagatggatcttgggtcataaaaccaacttgaatcaatttaaaagattgaaattatgatggggcatggtggtttgtgcctataatcccagcactttgggaagctgatgtgggaggactgcttgagaccggtcagtttgggccacatggcaagacctccatctcttcaaaaaaattttttttgtaaattattcaggtatggtggcacgtaccagtagtcccagctacttggaaggctgaggcattagggtctcttgagcccaggagttccaggtggcagtgagctgtgatcatgccactgtactgcagcctaggcaacagacttcatctcttaaaaaaaaaaaaaaaaaaaaaactgaaattggaattatttcaggtatacaaggttagtgcaataatcaaaagtaattgtcagccaggtgtggtggctcacacctgtaatcccaacattttgggaggccgaggcaggtggatcacgaggtcaggagatggagaccatcctggctaacatggtgaaaccccatctctactaaaaatgcaaaaaaaaaaaaaaaaaaaaaattagccaggtgtggtggcgggtactgtagtcccagctacttgggaggctgaggcaggagaatggcaggaggcggagcttgcagtgagctgagatcacaccactgcactccagcctgggcgacaaagtgagactccatctcaaaaaaaaaaagtaatctgttatagtctgaagaaaataaattgtaaacacagaaaaatcgtttaacagaatcaaatagccattcatgttaaaactctcagcaaagtaggaatagagaggaacttatttaacttgacaaagagcgtctacagaaagcctacagctaacatcatatttaatggtgaataagtgaatactttctatctaagattgggaacaaggcaaggatatctacttgcaccactcttttaaatatagtgtactggaagttactatagagatggagaacatagtagttgccatatatttagggattggaaaggggatggggtagatatggctatagaggggtaacatgaagaagccctattgattgtaaccagccactccaggccaggtaatctgtaatcccagcactttgggaggctaaggtggtggtggtggttacacaaagctacacttgataaagttgcatagcactacacacacaaacacacacacacacaaatgagtgcatgtaaagtgaaaaatctgagtaggctctgtgggttgtctctgtttcttggttttgatagtatactgtatttacgtaggatatcaacacttggggagactgggtaaaagggtacacagggaccttccctatgtatttctttgcaacttcctatgaatctgtaattatttctcaaagttttaagcctcctaacctccccagttttgtgtcccatcctttccctcaaaaacgttgttctgtttaattacaatcctttcaaaaattcttttaaaatgcatatataagtgtatttgcaatatcttttccctcatcccttttcaagacaaatagtttcacattatacttatgctttgttgttttttttttcacttaatagagaccattgcatagtaatcataaaagaatttctccatgctttattttttcacattcagagattacattgatatttctaccataataaccagttttctattaacggacttctgggttgttcttttgcttttagaaacaatgatctggtggaaaccttgcacatttactatttggctggtgtgtaaatacacttctaggataaattactagaaattggttttctagattagaatttatctgtccttgtaattttcagaaaatgacactgccaggcagccctgcctatgggtcatacagttcacatacctaccaagtatatttccctatattattctcagtagttattttaaaattttaggacttttgacaatatgttaatattaatggcatttcaggccaggcatggtggttcatgcctgtaatcccagcactttgggaggctgaggtgggtggatcacttgaagtcaggagtttgagaccagcctggccaacatggtgaaaccctgtctctactaaaaatacagaaattagctgggtgtggtggtgcatgcttgtaatctagctacttgggaggctgaggcaggagaattgtttgaatggggagacagaggttgcagtgagccgagatcgcagcattgcactccagcctgggtgacagatcaagactttgtctcaaaaaataaaatggcatttcagtggggtttttttatttttcttatacttaacattgtacatcttttcatagtttcaaaaaactttgtatctcttttctataaagtctgttcatattgttttgcattttcccagtggattattggcctttgtagcagttactgatttgtgggagtaatttatagaataagctctttgtctttggtatgagggtcaagtattttttctgtttgtcatttgccttttgacttttattatagtgttttgtcttattttgttttttgccacattgaagttttttatttttctttagtcaaacttatctcttgtggcctcttgactttgtgccagttagaaatgccttcccccacagcaaggttatacatttcacagtattttaatgctctcaggtatagtcctattgaaatccagagtaacctctccacagagaggaggctatgttgccttaggcaggagactttatttctggccctgagtctggttccatgggtctccttggccttgttgaaaatctgggtcactgttagaactggatcaggttaatctcacatcctccataaagtggttctttatagggaaaggaaggaaagggagtcattgaatgatcttctggctcttatcccatctcacagcaacctttattccaaagatagactggtagaagaggtttttgtcctattgcttggagagctagtggttggaagacagagtccctttggtctctagggaagggaaaccaaacttaaaggaccatttttttccactgatcatttgtgcatgtgtcccttagactgcttctccacagggtcaggctctctgaatctgaggaatctaaaactgtcctccatcacaatgagaacttgggaggcttgtccacatttcagcagcacaaccctgtggacttttttcagaatgaagtgctagttagtggtctgtctttgctaaaccttgtattttcaaaatgggcatgtaaaatgtttgcttagcataattcccactcaccctctccccttaggaatagccaggccagaagaaggaaggcctgtggtgagtgggacaggaaatgacatcaccaccccaccgaacaaggagctcccaccaagcccagagaagaaaacaaaggtaggtgccagaatggtggttatcttctactgccataatttttaaacggagtatcttctgctgttattgcttgaatcacgaatgaaatttcttttttctgagctgttattgtccttcctcatgtttggacatgcttagaaaatatcttgtattctcatttaccacagtggcctaaaccaactttaaaatctcagcctttgaccctattatcttatatatctgtaaaaaatgttctgtagaggccgggcatggtggctcatgcctgtaatctcagcactttgggaggccaaggcgggcggatcacatcaggagatggagaccatcctgaccaacatggtgaaatcccatctctactaaaaatactaaaattaactgggcgtggtgatgcatgcctgtaatcccagctactcaggaggctgaggcaggaggattgcttgaaccaaggagttggaggttgcggtgagccgagatcatgccactgcactgggctccatctcaaaaaaaaaaaaaaaagttctgtagagattgtttcaacttcccttaacaacaacaaaaaggacaattgcaaaaatattctgaaataaattctgaattatttactattatctcagcgttagatgaaagaaaaaaaaagattctgaaatatccattcatgaaaagagaatgcagattttgaaggtggatcatatagcttcagatgcataactagtacttattgcaaagttcaaaagccacactgtaggctgtggctgctattgtcccatcaagatacaggtagtttcagcatgttgtccagggtcttcaaaaaattaaaaagttattaaaaaaaatacaggtaataatggctgaatcacctcctgatgcttttcttttagaatagccaccaaaagttagttaattattaagagttaattgttttactgaattaaatcttcaggtgccaaactgccagaatttgtgccactatcattaagaaactattcccaggccaggcgcggtggctcacgcctgtaatcccagcaccttgggaggccgaggcgggcagatcacaaggtcaggagatcgaggccatcctggctaaaacggtgaaaccccgtctttattaaaaatacaaaaaattagctgggtgtggtggcacacgctggtagtcccagctacttgggaggctgaggcaggagaatcgcttgaacctgggaggcagagcttgcagtgagccgagatcgccactgcactccagcctgggcgacagagagagactccatctcaaaaaaaaaaaaaaagaaagaaaaagaaaaagaaactattccccattttctttctctatcctggtttcattccattatttattgagctcagaagaaagaaatgctaattttaagttgcatctatcctcattgcttataattttactttgaattgtgcaatttatactttttttaatttgtttttattcttgtctgtttgatgttgccctttaaaaaataaaaataaaaaataaacaacaatcaacctaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaaggtaagtggtcacctaactactgtgccgaggaaaattgttcccctctgagtgtcagatagacagatccttgttgctaacagacaacagaatcaggctggtggaattgggaaaaggcaagggaaatgggggagagggtgatttgaaaattggcatggctactctggacgcgctgcctatgggttagccctgctccacgaggagcagccaaaaaaagaaaaaagaaaaggaaatcaatttggggcccattgatgcagacattaacattttgaagcccttttatgctcttacctttcccttccctgtttggaggtaatactctatctacttaggttcttcctcctttctctcagctacctactctttacctatttaagcacttattaaccagtttcctctactccacataccagttagatattcttttttggtataattcccacatcaaatgtaattctttgtctttccctgttatcatcctgcagaagttttatccattactattgtgatataactagttcttccagcttatctcagcatgttccagcatgatgtgataacttactttgctttgggcattaggccacctctcactgagctacttctgaagtcatccagttttccaggtcacccacggtttctgtattgcccagaaactggtcacatttggagcagcattagtgttacagaattgctccaggaggagaggatagtggaggctgtggctgcattccttaacatcttgtgttatttgagaagggcctttaggtcagcctgatagtactctttaaattcatggtacgaaatagtttcccatgttaaaatgtcagtttttaatttaatatggtgaagaaaactgtggaacctaggagttgaagtctaggctgaagccctggccaagaaactgaaaaatcctctcataaactagtaatgataaaatcttgtaaagctttctctctgatcctcatttatccagttggttgcttttcttgatctttagaaaacaataggtttgaataagagggcagaggggaggtgcctggagccctggcagcaggtcctccctgttgcttattcagcagcggcttctggggggtgacagaggagagtaggaaggagaggtgtctagtgaaatttcactctataataatcatataaatgaagtgtagtgtactagttgctgtatatacatgaacttttttttaatttttatttttttgagatggagcctcgctctgtcacccaggctggagtgcagtggcacaatctgggctcattgcaacctccacctcccaggttcaagcatctcttgtgcctcagcctcccgagtagctgggattacaggcacccgccaccacgcctggctaattttttgtatttttagtagagctggggattcaccacattggccaggctggtctcgaactcctgacctcaggtgatccgcctgcctcggcctcccaaagtgctgggattacaggcatgagccaccgcgccagtcctgttctaatctcttttatccagatgaggaaataaagctcagagaggcccagcgatttgccaaatagcacacttagaattaaggggccaaaccaggactgcagctcaggcttctgacccagatttggccagtggcctcttcatctgcagcttattttggtagaaagatttgtagagacagagagagaaaaacctattcagaaaaaataagtagattacgattctggcagagaagaaaatgtaaattgggaaacagcagaatagctccagttaacttctgcaggtttttgaagccaagagcctgacatctaaaagatgcaacatccttttgagatttctatcccacataacttttttctaacttattttatcattattaccctcatggcaaaataataagactatgctagattattctgaataatagtcatagtcttaaaaatttgatgcacatcccagagagcatctggtttagtcctcaaattttagagcaatagaaaagggaatcctctggccaaaatcctacatgtttccagcagagctggtagcagaaccactttccctgattccagccttagcgttcttcacaccatacttaaggcctttatttgtggaaattgtcattaccctacatttgcagagttagactttggatgccagcccttaatttctagtacctccttagctgatttttccatttaacgatatcctgcttgtcgctacctacatactgccctctttatagccacttctcttggaggaagagagctgagcccactgtgtctgtgatttggcatactctcttttgtaatgtggtaatttgtttatcaaaatagtgtcttcatcccctatccccgtagaaaccaggctaaactgattctttcccttattcactagagacgtcattctcagcctccatgtaaaaggaactagagtgacccagatgccaagcatctatacttgagagactttttcccttttgctttcagactgtagctgtgatatcagtgctttttatcccttctgttgatcaggcctgcctcttctcatcgtctctgtgctgagacctttcatcctttatttcctgacatcacatattatcaaagctggtccttcatcaccctccattctaatctctttatcccgatgaggaaataaagctcagaggctcagtgatttgctggagtagggctacagctcacgcttctgtcccagatttggccagtggcctctccatctgcagctcagtcctgttcagcattctctaggtgcgtgttagccaaaagaatggctcgatttgaacataatttttagtttttgtttgtgtatgtttaatctttggtcaagtataatacattagattttattacattaaatacattagtatttttggcatttctacagaggttacattaaaatatatgcgtgtgtgtgtgtgtatgatatatatagcagtagatttggaggcaaacgtaggttgtggtgatgtacccatcagggctgttcattctcactggctcaagttggattgaagtagttttactctctgttgtgtgccctcagatcacatagcaccctgcatggccagtttgttgctttatgtggaggactttgctcttagaaccatatgtattttcctgtcagtagctgctgaacccacagtacctcctgttctccaatacatggttgtatagacacatcttgtgtccaggtgcagtggctcatgcctgtaatcccagcactttgggaggctgaggcaggcggatcatgaggtcaggagatcgagatcatcctggctaacacggtgaaaccctgtctctactaaaaatacaaaaaattagctgggcgtggtggcacgtgcctgtagtcccagctactctggaggctgagtcaggagaattgcttgaacctgggaggcggaggctgcagtgagccgagatcatgccactgcactccagcctgggcaacagagtgagacttcgtctccaaaaacaaaacaaaacaaacaaaaaaagaagcatcttgtagcgtgactccttggggctattgctgacctgcaggcctcattcccactttcctatttccagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactggtgagtattgcctttctctcccatgggaactagggaggggaaaatgggatcttggctttgccccagccatagctctagctagtatcacaaacagctgtgcaggcctgcttacgcaccggtccttagtggactacctggaacagtggtagccctgtgggcctggtacttaacaagccttgatctctgtgtgagcttagcagttgtatgtattcagaaaaatcttgagtgaaggcagaaaaatgtactgctcatgaatttccaggtagaatttactcttgccttagtaacccacagcacctagcacgtggtgctcatgggcttacatgatgataagaagagggcgtggtgctcatgggcttacatgatgataagaagagggctattcaagtccataggcatgtattgacagcctacttttaaggccacatagaaggcttatcagggcagtagagaagaataagactcagtgcctgaccatctaatttaccactccattcccagggactaacacagtccctggctcaaagtagatattcagtaattgttaaataatgaggaatctcactattggatgaactatccaacaggtcagtttgttaaatgttatattaataagtatattttgtacagccattaagactgagggaaaacctgcagaagtcaagaagatgactgcaaagtctgtaccaggtaatagcccatccgccattttgtagagccctaacttgaacccccacctcctctgtggcttaagtctccctttttctctctctccctgaacccgtgttatctctcactcccttctttgcagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggtgggtccagggagcttggggtcctggcatgctggcccctgcatcttcccctccatttccacccactgttcccaggcccaccaaagaagcaggcagtcaggacactggactcagcatcagggtatttcagccggggctctgtagtgggttttgtgccccagcagcagggaggcggggtaggctgagctctgggctttctcttcctgtctcagtaagaaaggctcctgttctagatgttggggtctgagtttacatttttgcttggatgtaaaaggattcttttgtagaagaaacagaggaggcctcagagactctgcaagtgagagagacacttgacatgagcctagtttttcatggttcttagcctgcacagagaatgtcaggataggcagaaggtagaacacctcttacttccacaacccatgacttgagtggaatatatctgaaagaggactagggtgtcctcttatggccaggatgagtcgtgctgtgagcctctggccttcctaaacagcaggactgcactgcatatagtgatggagaaagatcacagtgcttcacttttaggattttccggtggttaagattttctggttgcatcagtcccagaattatttaactgttggtaaccatgggaactctgcgtgaaaaggtggtgatgaaagtccgtctgagaatgttcgggtccctggagtagtgaccatctcatctcctaggtcattcactagctctacaccaccaccaccatccagggcagcatacttaaattgcttaatctggagctgttaagaaattcaggagggacaaaaatgaggtggaatcctggtgctgttggaagacactgatggcaagctgagatcagtctagagaagagcctgagagttgcttgtggtagcgacagtggctctggtgtgcccagcaggcctctgggctgtgctgctgatggcctatctccccgtctttgctcttatggtttcatggtgcaaaagttacaggagttcttgggtggggagttgagtgacttgatctagtgaattgttttctgcttcaacatacctaaagagtctgacactttctatcagtattgacttcctgtgaccgtggcagctgcttggggcatatcaggacatttggcatggggtggggggtattgtaattggaaaatcatgccccagcacactctcagaatcactaatttggttgtcttagccttcctttgtgccttttcttcattagctagtgtcttgatctgttcctcatgtcttaagactatggcctgcagctccttcttttgtggtcctctactcaaggatctttgacttggtctaccctgggaaatgtatggttttgcctaggatcaaaggccacctgcttttgcctggtggcctgacctggatttgagtcccctacagccttcttcccttcttggcttttgagctcttatcctcttggtttgaaatttgccctccctttatctccatccaggccaaagtagagaaaaaaacagaggcagctgctacaacccgaaagcctgaatctaatgcagtcactaaaacagccggcccaattgcaagtgcacagaaacaacctgcggggaaagtgagttttatttagacccacctctgcaaggtgaagatggtaaaatacttcttccagcctgagccacatgccctctcttgcactttttccctttccctaactagtttctacttcttctcccctatattcccttctctgtgcttgatgactcggccatcagaaaattttttgtattaaccttgaaagttaatagagttgggagcccattagccctttggagaatacatatgtgtataatttttggctggataaaatggatccaaagactttcattcatttccttcacactgaccttgatgtgaaacctacctggtatggatgcaaatacagtgcacccacattcgttatcaagaagacatggcaggggtaatttccaccacctggaaccctggagcccctgtgctttaccttgaagtagaagatccctctcataacgctgctgggtatggagataacttcatttgtcctggttccccgggtcacctcttaactgaaagttaggatgctcattcccaatggaaacccacttagtataggtatgcagcatcaactggagggcagaggtaagctgaaaccacaggttctttccccttgcctctgtaaacctggaaaccaggcccctcctgagtgcttgcaacacctaccttccttagctgtagcaggtaggtgtgcctctgccagagaagcccgcactccagcccttagggaccagcatgggaagtctcagcctagggcattcctacagtgaagaaagctgcaccgtggcttctgggtgactactagaggtcctaggttcagaccaaggctcattaagtagtttgctaaccacttggttaccatcaaagttgtgaaaaaggctagaaatgagtaggtacaatgaggtatatgggttggagtttctcaggatttctgtactctgtggagaactcttcagcctgggacctgcatcatttgcaaagaaaggaagttggcaactattccttcttgagaaggtcctaggattctttgttccagactcttagagccagggccttggtgtttctcagttccaggggaagccattcccgtactatacagtgtggttgtgcccccaggattgggcgtccttgctgccctgcttagagcctgttctttccgcatgggcatctcacagggcagaggattaggcatatggaggattcaagaaggtattttacccttgagtcaaaaatactatgccttctcgagccctgagacaaatgggctaagtgtggaggctgtagccgctcccctggtgttggagattctgtatccatttgtatgcacatctgagcactggcccctccttcctgttagtatcatccgtgcccttgttgccagctgcccagtgcttctcagagcagcctttgcttctgagagtgggtctggctgcagccattccagggcccagatttaagggaagcaccctctttgggtgagaacaggtccacatgataagacttgcagagaagagccaaggacactgtgcccagctcttgaggagggagcagagcaaggaggtagggctgtgcctggttgggcatcaggttaggctgctgcctgggccttgtgaaccacaaccccgcccccaaaggagcggtgatgaccaacatgcagtgcctgcgcagctctgctcctgtcgttgtgttgtctgttcacgtttttcactccccttcttgctctttcacatttcttttcctgtgcttttccacatctgttctgtagaaggtgggggtggaggtttaacaacactttttgttggtcattgtgatcacgtgtggactcactgccttccctgtgtcggttctaaccagtcctctccctttgtgttgttttttctattttctaacactccaggtccagatagtctccaaaaaagtgagctacagccatattcagtccaagtgtggttccaaggacaatattaagcatgtccctggaggtggtaatgtaagtataagctctggttagctggcatctgagatatagcccactgtggggtatactagggagagagccaggtgcccatgtagatagaatcccagtgacctgagctgtagcgttctgtaagaagcagactagcaaagtgaggggaccttgatgctcccatgttagacagggtgtttctggtgagcccctaaacaccagcatggtgatatccactcagtatctttttacccatatgggtgggaggctttggatttttctccagctatgtcagagcctgggtctgagcacagtggtcagcagcagacctgttgcctgtctggagtccgttcctgggatgtgtatgtcggtctgcatgcccttgaattaccgtggaagtaacttctctgagacagatgtctggatggatctttccagagctcatctttgaatccttgttattataaaataagaattaatcaacattttcttcctatcccttccccacgtttttttgagatgaagtctcactttgttgcccaagctagagtgcagtggtgtgatctcagctcactgcaaccaccacctcccaggttcaagctattctcctgcctcagcctcccgagtagccgggactgcaggtactcgccaccatgcccggctaatttttgtatttttagtagagacgggatttcactatgttggccaggctggtcttgaactcctgacctcatgatccacccactttggcctgccaaagtgctgggattacaggcatgaaacactgcgcccggccctcccatttccctttctgctctccttttttttgtccattttctaatcccttcctcctttttcttcccctccttttttagtcccttttcctgtttttttgtttgtttgtttgtttgtttgtttgttttgtttttgttttgatacagagttcactctgttgcccaggctggcgtgcagtggtgtgatctcagctcactgcaacctccacctaccagggtcagtcaattctcctgcctcagcctcccaagtagctggggctacaggcatgcgccaccacgcccagctaatttttgtatttttagtagagacggggtttcatcatgctggccaggctggccttgaactcctgaccttgtgatctgcccgccttggcctcccaaagtgctgggattacaggtgtgagccactgcgcccagactttccctccttatctttttgtcctctttcctcttccacccaaacatccttctttttgtcttgctgccattgtgtgccagctctatgatgtgtattagggacacaggtgatcccagctcacagggaggttctggtctagggagagacagggcgaagtcttactatcgtcgagtgtgtgaagaacaccctgtgtgctttccgcttgtcactgtgacagtgcctagaaaagtggtactctgtggagttgtgccagaggcaccagaagccgccatgtacagcccctgccctcaccgctcccttccaggccaagtgagacagcctgtcttgcctccgtttcttttgagttcattcggttctttctccttactgtcctgaaccggactaggtcctgctccacttacccttatcatttttagactctgttaacactcctgcctcctccttggtgatcatgacatcctgcccatggcctacagatacccccagcagttgtatcatgaggaatgcggccatgagctttcattcttgccccacacaactccttcctgcccctccttcctggtcatcttctcaccactgcctcttcctggcctgggtagaaatggcatcctttacactcgggtggaattgcttgaccagactaattagtcagcctggaataggatcagctgaagtgaggtgacaaagatccagcccacgaggggcccaggcagctgctgagcctggctttgtcctggatgaaaacagaaggtgaacaggggttctgagggaactgggtcacttgtgtaggtgagacatagagatatatttgtgtgtgttgtgtggtgcatataagagctctgaaaatagtcatcattaatgtatcacctgctgtgatctttccacactgcctacacatgacctcacatgtgtagggttttttgttttgttttgttgttttgagggtgaatgtatttttaaagccttttcactttaggaggcttccttaaacagagaattagggagactactgtgagccatctttcctggtgggaagatgaggataaacaacagctgaccacagctggacccaggtgctttgtttccttccataatctctgtcagtccctccctaaagccaccacaaggaaatgtgcagtttaaaatgatgagccccccagctgggcaccatagtaagacccccgtctctacaaaaaaaagtcttgctctgtcgcccagcctggagtgcagtggcgtaatctcggctcactgcaacctctgcctcccaggttcaagcgattctccttcgtcagcttcccgagtagctgggattacaggcacctgccaccatgcctagctaatttttgtattttatgttatgttatgttattattttatttttgagacggagtctcgatctgtcaccaaggctggagtgcagtggtgcgatctcggctcactgcaagctccgcctcccggattgatgctattctcctgcttcagcctcccgagtagctgggactacaggcgcccgccacaatgcccagctaattttttatattttttagtagagacggggtttcaccatgttagccagaatggtctccatctcctgacctcatgatccgcccgcctcggcctcccaaagtgctgggattacaggcatgagccaccgcacctgggctaatttttgtacttttagtagagacggggttttgctatattgggcaggctggtctcgaactcctgacctcaggtgatccacccaccttggcctcccaaagtgctgggattatagcaagagctactgcgcccagtcccaaaaaaaatatcttttaaaataaggccaggtacagtggccctgggaggcccaggcaggaggattgcttcgaaaccagcctgggtttcaaagcaattttaaattagacatgtgcctggcagcattaggtggcatgtgcctgtggttccagcttctcaggaggctgagaggggaggattccttgagcctgggtagttgagactgcaatgagccgtgatggcaccaccacacttcagcctgggtgacagagagagacactgaaaaaaaagggaggaggacctgctgtgcagacagaacagcattacaccccccaccactccccacacacacacacacacccacacccacacacacacacacagaaataacgcagttaccacagggatgagaggctccaaacaggatcctagttagtgctccaaaaatgcccccgacagacagacagacataccccttgatgagagccaggaggacaccagcggaggggagggaggggagtgatgagccagtgccaatgtagtggcttcttctgtggctggtcccagttaagattttgtgtccgttttggttccatttcacccttgcaaggggctgtgcatgtgtagtgggcactgagacctgctgacagcatgttttggtacctggagtgtgcctgcaggctctcatagagcggcaggcagcctgtgtaagcacaagcagagcaaggtgtgtgatgccgtgattgctcctaggaccacagagagccagcgtggcttctgcagtccccgaggaggggacacttgggccagcccatgaaggaggcgccgcacatggttccctgaggctggagcatagagtggaggcagggtggtgtgggggaatcgtttggaagcagattgtagactcctccacatagccacctaaggagggagagctgtagcctagaggtggtggactttattaaagtgagtgaggctcagttaagctttttaaaactttttactgggctgggcacagcggctcatgcctgtaatcccagcactgtgggaagccaaggcaggcagatcacctgaggtcgggagttcaagaccagcctgaccaacatggagaaaccccgtctctattaaaagtacaaaattagccaggcctagtggtgcatgcctataatcccagctactctggaggctgaagcaagagaatcgcttgatcctgggaggcggaggttatggtgagccgagattgtgccattgcactccagcctgggcaacaagagcgaaactccgtctcaaaaaacaaaaaccaaaaaaaaaaaaaacaactttttattgtgggaattttcaaacacagacaagtagaaaaaaacagtaaaatgaacctgatgtaccttttaccctgcctcatttactatctacatgagcagtcttggtttatctgtatatgcctatcccaagtattttgaagccagtcctagatatattatttatttgttaatacttcagcatatagctgggcgcggtggctcacacctgtaatcccagcaatttgggaggctgaggcaggcggatcatgaggtcaggagatcgagaccatcctggctaacacggtgaaaccccatctctactaaaaatacaaaaaatcagctgggcgtggtggcacgtgcctgtagtaccagctactcaggaggctgacgcaggagaatcacttgaacccgggaggcagaggttgcagtgaggcaagatcacgccactgcactccagcctgggtgacagagcgagactccgtctcaacaaaaaaaaaaggaaaaaattgatccatatatttaaaatagtaacactaataagataatacaagctataactcttttaatcttaagctgtttttactctacaagtccccactccattctttttttttttttttttttttttttttttgagacacagtctcgctctgtccctcaggcatgaaactataacacatttaaaatcatatttttgtataaatagctttaacatttcaagttatttctctaggatatattcctaacataggactcttatgtcagaaactacatctgtttcatggtgtgggctacctaggtttttttttttttttttttggagacagagtctcgctctgtcacccagactggagtgcagtggcgcgatctcggctcactgaaacctccgcctcccgaattcaagtgattctcctgtctcagcctcctgagtagctgggactacaggcacccgccgccacgcccggctaattttttgtatttttagcagagatggggtttcaccgtgttagccaggatggtctcgatctcctgaccttgtgatccacccacctcggcctcccaaagtgctaggattacaggtgtgagccagcagctttttttgttttgttttgttttgtttttgagacaaagtctcactctgtggcccaggctggagtgcagtggcgtgattttggctcactgcaacctccgccttctgggctcaatcaattctcctgcctcagcctcctgagtagccaggattacaggcgtgcaccaccatgccctgctaacttttgggttcttgttcttgttgttgttgttgttgttgttgttttaaagacagagtcttggctgggcgtggtggctcacacctgtaatcccagcactttgggaggctgaggcaggtgggtcacaaggtcaggagttctagaccatcctggccaacacagtgaaaccccggctctactaaaaatacaaaaatcagctgggcgtggtggtgcgtgcctataatcccagctacttggaaagctgaggcaggagaatcgcttgaaccaggcagtcggaggttgcagtgagttgaaatcatgccattggactccagcctggcgacaaagtgagatttggtctcaaaaaaaaaaaaaaaaaagacggagtctcgttttgtcacccagggtggagtgcaatggcacgatctcggctcattgcagcctctgcctcctgggttcaagaattctgtctcagcctcccgagtaactgggactacagtgcccaccaccacacccagctaatttttgtattttttgtagagatggggttttaccatattggtcaggctggtcttgaactcctgacctcaggtgatccacccacctcagcctcccaaagtgctgggattacaggcatgagccactgcgcccagcctaacttttgtattttttagtagagacagggtctcactgtgttggccaggctgttctcgaactcctgacctcaaatgatccacccgcgtcagccctcccaaagtgctgggattacaggtgtgagccactgtgcctggctcattcttttttttactggtaatttccttgatgggtaagctcagtggtttgtcctagaatctggattcttctaattacatcctcatggttttaattaacatattctgttgtccctcaattttctttaaatttatttggttttggttttttccccacatgctagcatgacatgtaagtaggtaatgaggtttattctgtgagaaattacattcatgtctcattcttcggttgtctctttttttgtgatgttggcaattcctggacctgtgggttcagtaggcatatgccgtggtaagactaattctagcattacttcttcatttaccagctggaatacatccataatgtgaaactgactgcccctcaactattctttaattgcatactagacaaaaggtcaagagatagaggcttcaaatatggaacactgtctagaaatctgtggccctggccgatgcagtggctcacacttgtaatccaagcactttgggaggccaaggcaagtgggttgcttcagcccagaaattcgagaccagcctgggccacttggcgaaaccccttctctacaaaaaaatgcaaaaattagctgggcatggtggtgtgcgcctgtagtctcagccacttgaggggcttgagcctgggaggttgaggctacagtgagctaaggtcatgcctctgcacttcatcctgggtggcagagtgagaccctgtctcaaaagaaaacaagaaagaaatctgtggctctacatcttggtgagggccctgggcttggagagtgactgttaacttcttgcaggtgctgttgtggttacagctaagatgagcttgtcaccattgcttgaagacccatgttgggttggtttaagcagctaccagatctttggctggtaaaagtacccttccctatgccctctcttatgggggataaggatagggagatgtttggatgaggtcttcatgtctccctcttcttgaattggccatttcttcccctaacaaataacaagataccttgttttaaacccagataaagcacttacagtggtgtcatcagcacatacttaggaggaggtatctgtgctgtatcctaaacttccattttggagatgcctataaatatctgtataatgaactatagattgaggagaaaagaaaaaaatttctatctagggaaaattgcagactttttggaaagatgagacaaagtagaggctgtgtgttttcacagtagtaactactctgtatgtaattatcaaacacgtgaagccattatggtatagttcctggtggtgtcccttcaagagatgatatgagaaagagacggattgaagcgagagctatgtgaggccgtatggaaggcaccttttgagctgggcattgaaggatggggaagaaaacataatgggtttgctgggttaggcatgagccaagttttagaggaaagattgagaatggctctggcaagctggggattgtgggtagttattctgtgccaggccttgggctgtgggtgcaaatacaaaaatactggtggcattatatctgtcctctggaaacatggtgaagactatatttcctgacaccaaagaagggaaaacagggctcaagaaggtagctcaccatttaacagcttgtggtgaaacccaccagaatggtgcaacactgcatggagttgatgtgttggaaagtcaggctctcccacagtacctaccagaggacagcggggccgctcacaggaatgctggaatccccatccagcaacccagagggcatgcatggctatagacttaaagatgcaccaccttttttttttgaggcggagtctctttctgttgcccaggctggagtgcagtggcacgatctcggctcactgcaagctctgcctcccgagttcatgccattctcctgcctcagcctcccgagtactgggactacaggcacctgccaccacgcccggctaattttttttgtatttttagtagagacggggtttcaccatgttagccaggatggtctcgatctcctgacctcgtgatccgcccgccttagcctcccaaagtgctgggattacaggcgtgagccaccgtgcccagccaaggtgcaccacctttaaatgcaaatttttgcatttttagtagagatagagtttcactgtgctggccaggctggtctcaaactcctagccacaggtgatctgcctgcctcagcctcccaaagtgctgggattacaggcatgacccactgcacctggctgggaaaattgttataacatggattaagcaggaatactatgattacacacacacacacacacacacacaacgcgcacacacacacacacacacacacacacaccaccccctcacctctcccaaggggaaaatgcattgaaaaggactagaagtaaatatgttattccaggttctctgggcaaggagttgataggtaaggatttgagatggaataaaggggatatttcatgggagccttggtgctggtgtttggacctggtgaaatgacagaagagctgtctggagcatgcatggacagggtctgcacagaaagacctgtggggtgtggaaatggtggtttggtctggctggaggtggggttagaagtgaaggctggtggccgggcgtggtggctcacacctgtaattccagcactttgggatcctgaggcaggcggatcacctgaggtcaggagttcgagaccagcctgaccaatatggagaaaccctgtctctactaaaaatacaaaattagctgggcgtggtggcgcatgcctgtaatcctagctactccagaggctgaggcagaagaatcacttgaacccgggagatggaggctggggtgagccaagatcgtgccagcctgggcaacaagagtgaaactctgtcttaaaaaaaaaaaaaaaaaaagtgaaggccaggcgtggtggctcacgcctgtaatcccaacactctgggctctggaaatctgaggtgggtggatctcctgaggtcaggagttcgagaccagcctggccaacatggtgaaaccttgtctctactaaaaatacaaaaaattagccagatgtggtggtacacgcctgtaatcccagctactcgggaggctgaggcaggagaattgcttgaccccaggaggcggaggttatagcgagctgagatcgtaccactgtactccagcctgggcaacagagcgagactccatctttaaaaaaaaaaaaggaagtgaagagcagggccagggtgggtcgagggctcttttaagtacttagggagatgaccttgtctttgaccagactgagatagcagcttacagagggagcgagaaaccctgaacatggagaagatttaaaaggtagcatggggttggctctgacagtataccttctctctgaatgagtcttttgtgtccttctcttcaggttcagattcagaacaagaaagtggacatctctaaggtctcctccaagtgtgggtctaaggctaacatcaagcacaagcctggtgagtggtgcctcccttgcccactgggtctccagggtatgtcgtcctgccatgggtcagctgggcagccagctggctggcaagggtttcatctctgtgcctttagcatcccatgaagactacccaggacaccacagtcctcattctgtcagggagcaggagttcgggtgctaacctctaagtggaggaggagcagtttcttacagcagccatctgcacaggcattctcttgagtacctactgtgtgtgtggaactattgagctaggcctggggaagtggtgcactctgagctgagaacctggattggctctaaacgaggattacagaagctactgctgaaggagctgtatagagggcagtgttcaggtcccacctatcagatgcaggagcaaagggtgctcccaaccagtgaagcatcagccgctagccctggcaggagaatgggaggcgttcagcaacttgcactaatgcagtttccttccagcaacatggttggcccagcgcccctgtggaagtcgctgtgcggaggctgggctcttgccttgggtagtcccctagcagcctcgtgtcctagttcctgggtctacagcagatttgtgagtaggactgctgtagcagcaggcacactggctggcagacctggtatcccagaaggctagccaccacaggccagataaggtgaaggcaaaactctcttccctcagggcgggcgcggtgtctcatgcctgtaatcccagcactttgggaggccaaagcgggcggatcacttgaggtcaggagtttgagaacagcctggccaacatggtgaaaccctgtctctactaaaaatacaaaaactagctaggtgtggtggtgcatgcctttggagaattgcttgaacccaggaggcagagactacagtgaggcgagagtatggcactgcactccagcctgagcaacagagcgaaattctgtctccaaaaagaaaaaaaaaaaactccctttccctctcagcgaagagcatgatccagtttagaatgtgttctatttagaaagatcaaaacagttctgtccttaactaaccatttttttccccttttatctgggaaatctcctatcagatacttccttctctaatgacactgagtcacttagggtctagtttttgccagggctgggtttcccaatatgggacaccgggagacctcggccagaagctgtgcgtggaggtctgccatgtgagctgagaggagatggaagaacaggagaaggggcccaagggaaaccacgctgctgggcgcgggaggggctgggtactcattgagggcagctcgtcccgcacccttccccttggtctcatgggcacactctggccagtgagctctgaaccctgggcgtgagttcagaccactttccctccccgtcctagcctgaggtcactagatcccaggcctgccttggtccatgtctttccttcctcagcgcacagcctcggggccactctgtcctttttattattccttctttttgctagagtgtggtacggtttagggtctcagacaattttcacaacctgtcactgtcaatcagcagattggtggtaactctgggtgagtcccttctcttttgcagcatcagttttaccggctgggaagcagggaccgtggccgtgatgacagggcattcatgagaattcagtgaggctgtgcctgagaagcactgcatggcccagttagcgggagggcattcccacacagagtagagaagcagaggcttcgccctggaggctgtgctcggagccccaggcctgcccaagcctggcctgcagctcagtggctgtggcatggggtggtggaagggatggctttccttttcttggaggtattcccactggctggacggagagattgtctcagcctcactgtgatatgagaagtcctctttagacaaacgtgttcactgttcttcatttgccacccagaacaggtcacgtctgtctcatttctagattgggcatatcgctagtcctggttttgcctgcagggatattcctctgccaccctaggtgaccagttcctttgtggttccaggtggaggagatgtcaagattgaaagtcagaagttgaacttcaaggagaaggcccaggccaaggtgggatccctcgataatgtgggccacctacctgcaggaggtgctgtgaaggtagcgagtgggtcactggggagacacagctggggaggggtgggaactatgcagttagggtcagggtcctcacaggtaggcacctgtcaccgcccctcagtctcttcaggagtcatgtcttcacccacaccattgccgttttcccaccgtgtatcatcagtcctgactgaggcagaagtgaagaggccccagcccagccacccctcacctgtcagctggaggcagaaccttgctcctgagagccatggccttcctaattgagcccatccagccatttgagaaggccacggactgggacacagaccacccccaggcgagcgggggttctgcaccacacagttctccccagctgtctcgcgccaaggggaatgtgggttcccgccccatgtcaggctccgctcctgggttaggagcaggacagcacattcttagctgccagcgacagcaggctgcctggggcctccctctgcagggcctgcctggggcctccctctgcagggcctgcctggggcctccctctgcagggctctgggacagagctcaagtggcagaggttcccatcctcacgactggctgggcctcttctcccttccctctctcctctttcctcccttcctccttccacagtactgtgagaccttttgtgtgccaagatgctgtctgtcctatgttccatgtcatccgtgggtggggggcccatgaggggcatcttgcagaccccgagcacaaggatggctgctgctgctcgggttcaggtgcgcaggggagaggggccaggagccgctgccctgggccttcccttccatctctgctccccagtgccagccactgcccagcccgtcccctgtcccatcctctcctgatgctctgactgaagccttgatcagcttccaggaacatctgggggggtccttgctgccacaggctctcagttcgtgccccccatacctcgtgaggatgccgttctcacgcccgtctcagtggggcgttaacttggctttagtctcttttccaaggacacagcgagcgagcgtggaccaggattcacatctgggcttttctgaccctaagccttgtgttcttttccttgttcacattatatccctttattagttctggaattattgtttttaatcgaggcctatttctcactatgccgattagaaaccacttctcccttgtcactttttgggtatttggcgacacacgctttccagctccccagtggcctctcgcagctgttctctcttctctgccttcctcacactgagtgttccatgtcccccaaatgtcctcctcctatgacgccctccaggcctccacagtgtccctgggttatacctccttggacacctttctgcctcccatggacccctggtcccagaatggtgccccgcacagacaaggcctcagcacctgtgttcctgaccagacagatgtgcaggcagggctgcccgggagctactgaggaccccactctgtgtgcagggggtggcctgggttcagggagggtttgggagggtgggctgtacccttcagggggctacccttcaggcttattgcttactgttgtcatggctacgtctttggtaccagcctgaggcctggcacctctgccctcagagaggcttcatcagagcctcacatgccacagaggggctctgagagtgtgtcactggtccagctgctcctgaccctcgggagtcggtctcccaggtgaggtggggtgggtggggccggggcacctgcctgggattctccaagcgactgtgccttgagccagtgggtgccagggcagcaagggtgggggctgtgtgtgaaacccaccaccatcaccccatcccactccccccctcgactgaccctgcactgtctcccccactgtttcattgtagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagtaagtggctgggctcggcctaagggccagccaggggccctgccactggccgcaaattgaaactcctttgtttttgactagagtgtggcctaaattttaatgaagtaaccttttattttccaggcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatc

SEQ ID NO: 37740 - DNA, 238526 bp, Homo sapiens; identical to SEQ ID NO: 37739

SEQ ID NO: 37741 - DNA, 81813 bp, Homo sapiens; identical to SEQ ID NO: 37738

SEQ ID NO: 37742 - DNA, 42785 bp, Homo sapiens
cgcccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcaggtaagcgaagtggttcccgagccgggctgcgggcgccggagaccgtgccgctggacatgcccccagttgcagctaccgcgaggggcgggccgggaacagcaatccctacgccttcggtgccttgggccaagaaacccgggttccaggtccaccctgttgcgtccccggagttagcctgcctcgcccctgtcgagctacaataagagcctggcgatctgcgagccttcacttcatgagctgcagggcgggaggtcccctgtgggaggaggttctccctgcatttctgagcagacatccgcagtgtttcattcctgaatggtgaagagcttgatacagagaccctggagaccgttcagatccgcagaaagcctaggctgggcgctcacaggccttcgtgcaacttattgccatagcactcatttggaggtgggtaggtgggcattttcatccccattttacagaagaggagataaacccagggggtgaagagacatatggaagactacccagttagtaagatggggcaggtctctgtctagaaattcactgccttttctactaagtaaagcttctcttctgcagagctcatcctagcctgaaaatccttcctctaccacggcgttgagtaaattcgatctgcggttgtgttgaattagaacaatgaaataaagatacagatttttagaaacgcaatggggtagttaaaaatgatagggaaacattgactacctccaactgatggaaagataagccagtttttcctgactcctcatatctatattatcataccactaggaaatcgtgtcacctctcatggtgttctgtcccgtctggtaaaggtgaccaaacacttgagaagccctcagagtcttccgaacctgctggcctgctcttaatacctctcctcagttggcctcctctctagaacaccctgccagactcccctttgccctctcaccagcctcccacccctgcccaggctgctgggggaagaactgacccaacgctctccctttcctgacggccacagctgcccaggaccacaccagtggacaggaggctggctttcaggtgctttattcagagcctgtgggttgtaatctcattcagatatttctagctctgaggtcttggccaggtctcaaacaatctgcacctagttttcttatcttcctcacatccttccacctacctcaactgttgataacacttgtcgagatcaggcatgtgaaaaagacgttgtcagttgcacacacaagacacatttaaatccaaaattagttttccaccagctgcacccctagagctcacagggtgttccccacctctcatcttgcattgtgattgtgtgcctgcgaagaaaacaaatgagctagttctttccccttgatctcatggacagcttggggagacagaacatacgtctgaggaaatcatgggaatggatgctaaacaaatttcagttaaattcagaacacatttagtgactcctgctgtgtgccagatatttgggaccaagagatctgagtgcagttctggaacaaaggctacctgatctgcaggtggagtttgctgggtggagaggtggtgtagtatctgattagagccatgctatgtgggttcatatcctagttgctccactgactagctatgaacttgggcaggttaaattggagataatagcatagggtggtgtgaagatttaatgagttaccatatataaagttctcaggtgtgtgacacatgagtactaagtactagctgttgctatgacctaagcaaaaaaccataatttaataaaggtgaacaaagtcctattagatttaatctgtctttgaggtgatggaagcaagccttagggtcaggatgacatttctgctgtgtgtggaaagataaggcagagtttagaagggaggcaaggaggaggacatttcaagcagagggaacaaacatcatgagtgagaaaggcatggcagattcagggatttgtgcgtgaagaagttggaacaggtaaactaatacaaatagatgaatgcactcaattgctcagaataaaaaggaatcatggaagggagggatcaggtggggaggagccaccaaggaaggcttagggaggcagagccatttatgcagctagggaaggagtgagtcgtaaaggagcatagtttgacagaaagaagtacagggaaccaggtaacatggagaccctgggtgagataatgaggaaggggactgtggagattaaagaagatgggaagggagggtggaaatagttacaaatggcagcttgagaggtaagatgtacagcggttctgaagagtacaaggggcctgagttcctgctgtgctgagaggtcagaatggtcactgtggctgagcactgcaggatgcttttccctgcaaggtggctggcctcccacatccacccgctcgacctcaagtcaagtcagccaggatccagagagtattgggagagagggagggaggaggaggtgtgaggtgcagctgggcctggagtgcactgcagcaaacctgcccccactgttgcctgctccctgaggccctgcctcccagccaagatccccactgcagaaagatgctcagggctcaatgtgtacccttggcggcttccaagcattttataatgctgagtctccttgtacccacatcacctttttatgaggtcagtgttaccaagaggacccgcacacaggggaggaagaggcaggagaccaaaggaactcagtgcttgcctccagtgatgagtcaggcagggcagcagtgacactgaattcccaaagcccagttcggcagcttttgagtccacactgcagtttccctttgaaaagaatctcctaagtcaaagatcacagaaacttagtcactcttgtgctgaaaatctgtaaagtgttgcctgcccagcccctacaggacaaagttcacactgcagaatgcagtttacaggctctccatagcctagctcctgtctccagctccaatctagtttctcaccatgctccaccctcatattttatgttctagcattatccagctgcctggagttcctctcataaaccagactgtttgtgatgtctgtttcttagctcatgctgattccctttgcccaaattccctttctacacagaccccatcttatccttcacttcctgcccttactccatcctttaagactctgctgaggtgtcacctcctccagaaagaattccccacctgaactgtatccacctcccaagttaggttcaccccttcagtgctcttatagtttttctattttcatacttaccatgttgttttgtaattatctgcttatgtatctgtctccccaacttgagcccttgaggaatgatgattgcatcttactcattcttttcctagtgcccagcttatagaaagcacgcgataagtgttgaataaaataatttgatgttgggaggatcaatcaggcaggagcaggtgagatgttctgcttcagttttctcagtggggcgcttcctgtttcagaagcttgcaccagggctggccagcagcaactgttacaaacatgctccctatgcagagctggaaccctgctctgcagccactccatcagtcttagctttggcctttgaaactatcccaaatgattttgatctctgctctgcctacaggagatggtttggaggagttctagtcaagactccagaaacctgagaactggattctggtttagtgcaggaagcctcaaaccttttagtttgttgactcctttccacttaatggaagaatttttagataagatgccaatgatacctttctaaagtgcattgctgatttatgccagaagccaacatataaagctctatcattttataaacatggaaggaactgaatatataaattatataattaatatattatacatattaattatataatatataatttatatattcagtaacaatagtgtatatttgttcaatcttaaaaaatactgtgaggtagatattatcttcattgtagaaaggaggaaactggctaagggaggttaactgaggtgttttagggtcacacagcttatttttgaactcattactgattactcttctgatacactgtggagattctttgatctcacaatggatccactgcgctaatggtcttaggactctaattttcatcttttatgtgagaattctaatttctactccacttctattttctgacagtcataggacaagtgggagcacttacttggctgcataaaggttgctcaagtgtcactttactctggaatgaaggggatattctggttaactgcaaaaacattttcctggagggcacagtgaggtcttacttcagatcttagtaaatgcaaatggttgtttcaagttagaaccttgattaagtccttgatttttaatttccatccatggcttatacaacctgaaacagaaatactgttcaatttgttccaacctcagccttcttttcattgtgtcagagaacagatatatagagcatcatacacttaaatctctgtgtaaggaatgcagtgaacaggacaatcctgattcttactccttaattaagagacttaattcagatccctgctcttccatttacaagctatgtgacttccagccccattttttggatctgttcattaaaggttgtaaaagtgtttatagagaggttgtgacaaataaacaagataacacatgagagcatgtggcatggtacctggaatatggtaaactcttagtaaatattaatatgtatataaggtgttacttcagtaggtgctaggcgtgtgcacgcacacacacacacacacacacacacacaaatggaatgttggattagataggtgacatctacaattctgcaaatctctcctaaaaagtaaaatatctatccatgtatcttctcaaatgcttggtgtatgtcccacattcatacagtagctgcttcataaatgcatgatgagagatgaaatgtgtggaagattgaatgaatggatggagggtggatttgagtgattaaaagcaaaaacaaaccaaacaggtaccaaagacatctccaccctctctgtcctggaaaaccaagaagtgtgttgtcagaaaacagtgagcaatggcattccagtctattgtgctgagactggataagactgggaagtgcctgacccaggggatggttccaacctttgttgaatttttcccttctggctttttcttcatctttggatttagtgtttccttttgttttgcaggccattctcaggatcaagttaaggtatttacctgcgttggcagaatatttcagggacatctgtcctgaagcagtccagtggtgacaattccctatactattctttcagtttagacttatatctggacaatctaggcaaggaactatcatttattgatcccttaccatgtcaaaggtcttcacattctaactcatctcatctctataacaactctaggtattatgacttgtgttttatagtttaggaaactgaggttcggagtagttaagtaacttatccaaggtcaaacagcttctagatggcaaaacctggacaggagtttatgactgcccaaatccaaagctcttaactctctttattctctatcacactattttctaactaaaatgttagttttttctctccagaatccaaactggctgactagacttgttattttatttttaatccagttctttggatggtttatggtttcactactaacataccattctgtatgtaaatgccagcttcagatttcttttagctccgttactggtgattcatggtgattgaatggagctttccttagggaattgagattttattctttgggcataaaatttctcttccttttaaactctcatctctgaaagtgaaaattttagaaagtaaatcctcttatttgccagtagcatttgttttcagttatctggtctatcttctagaattactgttagtcaagaaagctttttttttttttttttttttttttcaaatttcctccttcaagatgcatgttatatcttctgaatggtgacttaccctttcattttcatgaaacttaacatctgtcatagtaataattcattgcctgtcgatatatctatttggccactgaaaggaaggagaaatgaaaaagaaactgactcataggctgaaccaagaatagaagcaccgtttaatattccagtcatgcttcattgacctagtgctgaacagaagtgtggctcaatcaaaaggtcaaacagagggtagtttatatttttaatcaaagctgaaaatacgggtacattttactttgtagaataaacagatggctgaaatattatttgaaaatataaatgtaattacatgtttcagttgacttatactttaagggctgattggtcttcagtttttattgacttccagttggcagggacacctaatgctttaagaaagccctgagccctctgtcaattcattttagtcaacaaatctttattgagcatctgctatgtgtgaggcactattctaagtcctggaaagagagcagtggttacagacaaaaatacctactctcatagggtttatatctaatagagaatatagattataaaataaataaataaaagacaaggtgccaagcatggtggctcatgcctgtaatcccactactttgggaggccaaggcggtctgatcatttgagcctaagagttcgagaccagcctgggcaacatggcaaaaacccatctctacaaaaattagcgaggagtgctggcatgcacctgtagtcccaactactcatggaggctaaggtgggaggatcatttgggcctgggaggtagaggctgtggtgagctgagatcatgccactgcactccagtctgggggacagagtaagaccctgtttcaaaaaaaaaaaaaaggcatattagacagtgataagtgttaaggagaaaaagcaaggaaggaggctatgagatatcaaggaaaaggtgaagtttaaaacaaggtttccatccagggaagagatcactgaggagttgacttttgggtatagacatgaaagaagtaagaaagccaattatgcaggcatctatagagggggaaaacgttctgggtaaagggaatggtaattgcaaaggcctggaggcatgagtgtgttgaggaagaactaagaggctggtttggctagagaagagtaaatgagagtagcaggagatgaggtcagagaagtggggaaggagacggcagatcatttagattcttctgagctatttgtaaaatattggggttttactgtgtgtgaagtgggaagcaattgtgcagggttctgagcagagagcttcgatgtgatctggcttacatttaaataggaccattttggctgctgcattgagaatagacatgtggtgttaagggcagaagcaaagaaaccagttaggaggtttcagtgatctgacaagacagtagtatcttggatcaagatgatagcactgtatattctggatatattgtgaagaaagagctcatagtctttggagtgagagaaagggaagagatgactccaagggtttgggcctgaataatcagaagaatggagttgtcatgaataagacaaggatacaaaaggaggggctgtttgggggccatatcaagaactcgcttttgttcataagagcaagaatataatactggttgagtatccctaatctgaaatgcttgggaccagaagtgtttcagtttgaagatttttttttggattttggaattagtggctgaacctcccaaatctggaaatctgaaatctgaaatgctttaatgagcatttcctttgaatgtcatgtcagtactcaaaaagctttggattttggaacatattggattttggattttcagatctgagatgctcaacctatagtggctaccaggggctgaggggtggggaagatgaggagctcttgtttaatgggtataaagtttcagttacatgggataaatcagttctagagatctgctgtacaatgtaatgcctatagttgatgatattgtattgtgcacttcaaaatttgttaagagagtagatttcatattaagttttcttaatacgcacacaaaacaaacaaaaggacacaaggaaagtatgggaggtgttggacatgtctccctccttggttgttgtgattgtatcatgggtatttgcatacatccaaacccagcacattaattatgtgatgggttattacatatttattgcacatttaattcatcacattaaatatgtacaattctttgtatatcagttatactttgatacagctgtaggaggaaaaggtactccgttttgggcactctgagtgcgagataccttcaggtattcaattgaccttcaagtaagtacagtctagagctcattggatgcttatcatatggcaggaggcacttttctagtgttttttttttcacatgtaatttcatgtaatcctcagcatcgtcagaaataggtactattattatccttcttagaggaggaaacaggcccagagaggttaaactactattgcatttttacacagctaagaagaggtggggctcgggtttgaacctgagctgtctgacaccagagcacacatggactgcttctgttgcaaacctgttgatgtgttgggtgagctcctattgaatgctcttgaatgaagtttatcttttaaaagttcacatgttcatttaccaggattttatagagggtgtgtttctagctctggcagtcacacgcccatgaatatcagaggctcaccacctccaggtgtacctttgtggctataggaagggtggggttattgcaagtactccattgggccgagggtgctctgcccccttgtacagtcttgttctatactgatccatcttgagctcttcctattatccttatgcaagcagacattttccataaggcaccaggttagagctgggaaaaatggatcacccaaaaactgtgttaactctgttgagcaacagattttgtcccctgcatctcagtgagtagcggagataagagggtaggggatagagtcttgcatctctgggcgtatggagacattgctgccagacaggctgttggattggatgtggtgcatgagcctgaggagagcccatctcctgtctcaatgccagctgtccctaggggtgggaaggaggtgcccaggccgactacaccctccagagctccgctccttgagcagaggtggcagacccacacatccatcatccagccctagtctgttcaggagctccttctctgcagccagcttggctcccaggaaggaagaccagcagaacacttaaacttaataacccagtaatgcagtaagtcctactttgggacaagaggagggactttgctctaactcagaacgtatacctccttgaacgtgccaaaattcctttttcctttatgactgtttagtaagttaaagtccttcatctttgcaggttcttgcatttgtccctataccgactttatcacagcttggtaaatgtgccttccctctatgtttgtgagatggcagcactggtttcaggaaatctgcttgctgttatcttagtgtttataactaagggatccaagtcaactttgttgattaaatggaccaggatgcatggttaaataggaaccccataatgaaatatctacggttgatgtttctgaaagattgggcatccactatgttctcgggacacgcagaaacacagggaaaagaaagccaagtttgtgaaccataaaaaacttttattctcattcttggatatctccattgtatctagagccatagtatccatcatagaaccagatataactccttcatagacatgaggtgtttggggtggttgatgaccttactttctgctccttagtggacagacttccctcctatacgagtcctgcacagacttatctgaactctagggcccaagttcccatcatctatctaagtctctgcaagacagcttcctgactggttaacccattccatctggttctcctctatcctttctctactctgaaggcctctttggaaacccttcaggactccccagtgctcttcagataaggacacagctccttatcgtgctctacacagctccttatcctgcataatctgtgtcccttccctttccagccttatctggtttcactcaacttgcaggtctttaactctggccactttggcttctttctggtttttattattattattttttgagacagggtcttgctctattgcccaggcttgggtgcagtggtgcgatctcagctcactgcagcctctgcctcctgggctcaagcgatcctcccacctcagcatcctgagtagaccacaggcatgtgccaccacgtctggctaattttatgtatttttttttttgctttttgtagagatggggttttgccatgttgcccaggctggtctcaaatttctgagttcaagtgatcctcctgtatcggccttccaaagtgctggattacaggtgtgagccaccatgcccagcctactttttttttttttctttttaaaatgtccatgttctctcctatcatagatctttgtacctgctgggtgtttttttttttttttttttttgccttccgtgatattcccaagtaggtcaactgcccatgatactctctagtagcaccaaacacacctttctttgctaataagttgcaattatacattcatttgtgtgactaattgagtggcacccaactagattctaagttccctgaaggcaggggccaggactattggtgctcaccattgagtcctggttgtctaacacaaagacagcaaacttgttctgtgaagggctaaatagtaaatatttcgggctttgtgggccatattgtctctgttgctactattcaactatgctattttagtacagaacagccacagacaatacataaatgaatgagtatggctatgttccaagaaaacttaatttatgaaaacaggtggtgggctggatttggctcatgagctagagtttgccaaaccctggtgtagcgtaattccagcacttagtttgtgatcaaaaaaatgttgttgaacagtgagcacttggcaaatatggattgagcagtggcagtaaaatgtgcgaactgtgcaatcctgttcttattatggcacagcagcctagatgtacacgtacagacagttttcaactaatctttttattgtctcggtggtagtggttgttatttacaatacttagttttttaagattataaaaataacatatgcttatggtgaaaatttttttttagcatttcagaactgtataaagaaaagctcccacttctgaaagatactcagtctttacaatttgtgtgtatttatgtaacattctagaaatttccataacacctagagacacacggactatttcataacttttattctagttcccaaggttcagcatttctttgaactctatgaggccacatctaataagcccctcaaacaaccaccataccaatggagaagagtgtagggacccctttagtaggtgagtttgcacataaatgtgaacaatttattttattaagcattttaacttagaaatagaagacctcaggacttcaaatataaagtctacctcatattttcctttttaatttttctttaattttttttcttccacagacattttcagttgtccagctacattgcatatttctttcaagaatatataactcacaggtggcttgaaaaaatctgaccttccttctccttccctgttcctgcacagaagggcattatccttttcctcttaaaggagaggaggcagaggcccagggagtcactggtctgcccgaagtcacaaggccagtaagcagcagagctgacagatctccacatttctaatctggtgttctgttactaaagcctactgccatttggcctcacatttagagggccttgaagaagagctaccttcttaaagcccaggagaaaacccaggagaaaaaaagggaaattattttgcctaagggtaaattttattaacctcaaattatatttattacatatcatcgtgaagcagatggctctttcctgcttaaaaaaaaaaaaaaaaaaggtgggcaggcatggtggctcatgcctgtaatcccagcactttgggaggccgaggcaggtggatcacctgatgtcaagaattcgagaccagcctggccaacatggtgaaaccctgtctctactaaaattacaaaaattagctgggcgtggtggcacatgcctgtaatcccagctacttgggaggctgaggtaggagaatcccttgagcctgggagacagaggttgcagtgagctgagatcgcaccactgcactccagcctggctgacagagcaagactctgtctcaaaaacaaaaacaaacaaacaaacaaagaagtgctaagcttaaataacttgaggaggatttaggttggatacaaaaatgagagttattatgttacggaaaagagttaagggctgttaagtccccttctctaatgctctttaagatctttaaaatgaagggtgaattttgccagttggctttggagaaaggctatttattatggttataatcttgtatagagacaggctgtggactttcccagttttcagatgagagcgactcataattgagttgacagtgatgtctctcagactccaattccatgcccaggtagcttattggccaggcttgttactgctgttgctttcactgctgtcaatattgggtaccattctatttttcaatttctcccacagttaaagaggaagctaaggaactaggcagagtgggtgtgtgtgtgtgtgtgtgtgtgtgtgtgtgtgtgtgtttcctctcagtgagtctaaccattcatttctacaataaatgtggtcacaaccaatcaaagacaagagtttatcatgactttgttcccttctctaccagtgaattggggtttaagaagtaggcatggaattacaaggagcttcagtaacggaaacaaactcaccttgtttatttgtttgcttggttatctttttatttatttattcattcctggtcagcagctctagactcatagtgttgcaaaggattagtcctcagacatccagctgctactgatttcatcagtgttgtcattttcatcagcatgaaaaccgtttattgagatcttaggactaaatcaagaaataggaatccaagatgtcgtcctggaacaagacacagtccctgcccttgggtgtcttattacttaatcggaaaggcagatcatgaccaagaactggtttacttaactctctctcactagattgttagccgctaaggggcaaggattaaacatgcagagtggttaagaaaatgggttttgtagtgggagtcccacctctgccatttatcagctgtgtgaccttggaaatgctaccaaatctcttagagctcagttccccatctgtggcatgggactaataaattgtccctctcctacagaggagttaagattcagggagacaatgtgtgcaaaaagcagtttgcattgtgcctaaacactcggcgcatatatgttaagcatgttgaatgaataagtagcctttgcttcccagaccgtgtctgccttgtggacagctaggatgagtgtaatgctcctgtgtctgtggggtgttattgctgcagtgcccttcgtttcacacctgctctgtcaccaccttgctcgtgactgcccacagcttttagtctggattcagtggctctgtgctatcctctgttattgttacccctcttctctttagaataatttggtagaaatttcttctctttgtcccctgggttgccccctctgatctgctcccagacttacgggatcaagacaacttgtcccaggtgggtgcagtgcctcacacatgtaatcccaggactttgaaagaccaaggctggtggattgcttgaatccaggagtttcagaccagcctggatgtggggaaaccccgtctctactaaaaatagaaaacattagctgggcatggtggcacatgcctgtaatcccagctcctcgggaggctgagtgggaggatcacctgatcctgggaggtcgaggctgcagtgagctgaggtcgcatcactgcactccagcctgggcaactggagtgagaccctgtcttaaaaaaaaaaaaaaaaaaagaaagaaggacaacttatctcatcatcttcatttgttccccagttttaatcctggagtttagaaggttccattgcttgcaagattcatatccctattccctcaaaggccttactgggttctcataaggatggtatttctgatatttcaaattcattgatgcatgaatcataaaacttatccaagcttactcaagggaagggcagggctgttgaaagatatcacaggtagattcacaggcacgggaaaagagatacacactgagctcaaaggaaccagacttgggaaccttctagaaaccaaagggtcccacagagtcttcagggtctttttcctaccctgtctgtatcttctctcttttaaacagtttggctttcccatggctcagcctggctgccaaccccaaagtgcatctaggagccttcacacccttcactggctgttgtcagtcactacgtttcttacactgaaaacccaagagagccatatggttggttgctggccagattgggtggcccttggttgtgactggcatggaggtgggtgggagagggtcatgtgtaagaaatgctactctatcagagacagtgttagaaatacttggttgtggatatatctcccaggaccgggtgagttgagccttggaaaagatttcactggggccgtatcagtcaggggcctggctggaaacagatggcactctcaaaatagtctaaccaacagggtttaatgaggaaactacagttgtttcttggtatccatgagggattggttccaggactccctgtggataccaaaatccttcatgctcaagtcccttatgtaaaatggcatagtatttgccataacttaggcacatctacttgtatacttgaaatcatctgtagattacttataatacctggtacaatgtaaatgctgtgtatatagttgtaatactgtcttgttttatttttttgaattattctattttttttaagttccggggtgcatgtgcaggatgtgtgtttgttacataggtaaatgtgtgccatgtggtttgcggtgcctaacagcccatcacctaggtattaagtctcacatgcattagcttgtttccttaatgttctcccctcagcccacccttccccagtgagtatttttcccctccctgtgtccatgtgttctcattgttcagctcctacttataagtgagaacatgcggtgtttggttttctgttcctgcgttagtttgctgaagataatggctcctagcttcatccatgtccctgcaaaggacaagatctcattcctttttaatttgcattatttttattgttgtattattaaattttttccctgaatatttttgatccacagttgtggaatccatggatgcagaaggcacaagaattaagagagccaaccagttatggggatgcacctagggactagcaacagcaggaagctgtgaccatcctaggcctgtggggtaagggtaggagcctggtgagagccgtgtctgtacaaaaattcagccagagccagagccacagcagccaggcagggaagcaagggaatgaatgtatgatctggtccctctctcttcccgccttcccattgatggctccagtcagaagccagagggcaacggggctcagctgatgtgattcctacaagtcagcctcccataaaagtcagcctcccatctaaatcaatcagcctccccagatgcagagtagggcagagaagaggggagatggatctggaagacaaaggatggacacccagcacaggagctgtgaggtcagagctgaggcttggcacccagataggatttaggtagcatagaggaatggtgaaagcatccccagctggtagtgacaggggcagttgtagagagaagtggggcgcatttacattacagccatgtaactgacatggatgagtggggggattgacctattctggttgaatataaaggaaggtttgagagaagaagttggagaaatttggcggggaggcctatgaatatgccagtttgtcatttaatcaggaagtaataggatgttattgaaggtgttagagtagtgaaatgttcaaaggaatatgcatagcaaaagtagacttctcactccacctaggactgaggaaggaagtccttgcttacacatgttacatgatcagaatattagctgatctaataggtggaggatccaaaggacccacagtattttgttctctaccttggcattatgacagctcttgcgatttgtggataattcctctctcaatatcacgggaataaattaagcttagccagggcactccccaaaatgatttaaacatttgtttttcagcgtgaggttcatagacacccccccctttcccccgtcagcatcacctgggatggtggtgaaaatgcatatggaggtcccaccccagacatactgaatagaatgtatctctgtggtgaagaacaggagtctgcatttttgacagccactgcaggaaattagtgatgtctccttaattcagttgaatttgagaactattgatttaaggagacatcactaatttcctgcagtggctgtcaaggtaggggcttaattccttcagagagtgatcaatgagaacctgatggagatctagccccatggttcctattacaatcgtattagaatcacctggggaaatttaaaaacaccctgatgctggggttgggtggaggggaactttttttttactggtttaagaagtctgggttgtagtcccagctactcgggaggctgaggcaggagaatggcgtgaacctaggaggcggagcttgcagtgagcagagatcgggacactaccctccagcctgggcgagagagcgagactcagtctcaaaaagaaaaaaaaaaaaaaaggtctgggtgaggcctgaggatatttttaaagctcccaggtgattctgatgtgcagccaggcctaagaacctttgatcttgtctgaactcagaaggtggaaaaaattagaaatggagccttctcaatgtaagggactcctctgaattctgtaccacacagtcaatgctaagaataattgctctggaaaggatagcagagtggaaaacaggcttctgtgagtaacgtggaaggaaaccaaagaagaccagggctgatgtaacctgagaaggtactgcagtctggaaaggtcttaaaggagtccgcacacttttttttgtttgtttgagacggagtcttgctctgtcacccaggctggagtgcagtggcgcgatctcggctcactgcaacttctgcctcccgggttcaagcgattctcctgcctcagccacccgagtagctgggattacaggcgcgcgccactccgcccggctaatttttttgtatttttcatagagacggggtttagtagagaccgtgttagccaggatgatctcgatctcctgacctcgtgatccgcccgccttggcttcacaaagttctgggattacaggcgtgagccaccgcgcccggccggagtccgcacattttcttaggctccctggaggagcttgaaactcctcgctgtgtgtgatgagcagccagaggtgtccccgggagagtctgtttgcccccaggccacccattggccttcacacagggctttcttgcctgcatttattgccagtttggagttggtgaatttaaagaattcctccttttatttttattttttcaactaatcaagaaaaagggaagtctgaaatgcaagtagaacacccaccctttcgaacgttttatcttccgttccaccgtcttctgactcgggagagagctctttagccatttgtctttgttttcccacagtttgccaacacctacgggtgtgcacagcacaggccagagctggaaatgcgtccttcttcccacagccaggaaggtgtgtgagtggtgctgggagcccagaggaagggtgattcactggaggaaggcggagaggacaaggacatgctctgctaaaaggcctttcaggaaatgaaaagctctgcatttctcttttctaaacacacacacacacacacacacacacacacacagacacccaaaaaaagaaaaaagaaaaatgagcattcccctaattcttctaaagcggtttctattcccaagaggataaagagtattttagatgccaagcacggaagatttttttttcctgaaatgggtgggttggcactttctttcctgagagctgaaaaggcctcatgctttattcctcctcaaatgtccttaatctgctgtggccccaccatcctccccctccattgttgaaaggcagcagctccttccctcgctgggtatttcccatggtaagtaggttctcctaggactcacccgagcctcagattgagttcatcctactgtgtgtgactgtgcagaggacctttaggcccctgtaggcagctctgataagattatctgatgttctcattatcagctgcacccacgatcttttctaaggaggggctctttgacccacctgatgatggcagcaggggtgttggcattccttttacatcccagtgtgtgtgggtgtgtgcctatattgtagttcacacagcagaaataaaatgggaacacccactgttcagctcattctattattttaactcttgttgaaaaataaaacaaacccctaaggaaatagcgtctttgtccccacggagttggatagctccctaggtcatctcctgaccacaggatcttgtcggaatcatcccctacatgtgcttatctagcctcagcttaaaattctccaggggaaggaaactccaccctccatgagtcagagtcattgagagtttaataaccactttgatggtctgttgtcaggaccaccttttccttgcagcagatcaaggagcagaattagaggagagccagttctctctggagactcatctgcaaattggaggaaatcttatgtgcatcagaagattgttgtggagctcaaatgagatcattctttcaacaaatgccagtcactccctggtgtgcaggaccatcatgctaggtctgggaacacagagataattgggcactggccctggcccttcaattcagtggttcagactgatggataaacataccgtctcagtgcagtggcagactcctctgctttgtctttggaggtcagcctgccaaactcggctgcccacttgtgtcccacactctgaggcgctgtctccactcacaccagttgcccatcagcagcagggccacacctggcctgctacctgctgccatgctgctccttcgagaatccacccttctcctccccatcaccactgagcctgtcttgctctttacctgcacctgcactgctcagtctcttcacatcagcggtgccattagcacctgcaaccttgggcccatgcccacctggatttggaggtcaggtacttcaatctgtttgcagggacaaggctgccagggttcatatccaccacacctaggccagttctttttctgttcttgtctctggactgcagatcattgctgggggtgtaagtacaaaaactcaaaccttggcctcagcagagctgccctgccccacttgtcctggctgacatccatggggcctttcttttcagtggtctttttccctcttctgtaaattccctggcatggtggccttcggaggctaaagacattccgaattttccctatgctcttggcccctggccaccatggcagagaagcagatcaccacttccctgagtaattgccaacaccagccctcatctgccctcctttcatcctcccctgcattctcagaagaggttctcagaagacgctgactcttctccatgggatcccaatatcatccccttgctctgcccatcttcttcttccattgatcccatcatggtcaccagtgtactgattagcagatacctaccaagaacctaccatatacagagtctctattatgacttaggcagacaaggagtacaagagatgatcccaacttttgaggagcctacagtctgtaaaaaataccagaggcaaatgcacaggatccccctccctggtacactgggttcccttctctctgacaactcttttttgctgactttcaagtccgtgtatgtatgtgtgtgtgtgtgtgtgtgtgtgtgtgctttttaaagccaatgaccaacattagtaacacattacaagcctctctccccttttccattcttcccagtcagtcattctagccctctgcagagactccttatcctcctgtacattctaagacattctgtcacttcctttctgctctcagggctactctcactccattgtcccatggtgtagtcccctgactggtctcagctgggacacctgatctctttcttagtcttctggccctgtgggatcctctgtcacatcaaaacacttgcacaaggttgatgctgggaagggagttaaaggaactcccttgtccctgtcatgtctctgagctatttcagagaaacggcttgtgaagatgacatgattctagctctagagaagttgagaaaagagtgcttgggccaaagaaggacagaaaaggagtggaggaggccagcgagcagtgttggtactggcaggctccaaatcttcatgcttatgtccctgaaggccacttcccacaaacagctcctcctccctcctcagtgacaaactccctatggcaaatctgcactggtgactctggcccctgacatttgcatagattttgcagcccagaagtcctcagggatgggagtccgttcagtgccttcctgctcctccaacccattgccttctgagcattccccttgggatgctctagagtagaagtccccaaccttttaggcaccagggacaggtttcatggaagagaatttttccatggaccggggagcagggggatggtttcgggatgattcaagagcattacttttattgtgcacttgatttctatcattgttactttgtaatctataatgaaataattatacaactcaccataatgtagaatcagtggaatctctgagcttgttttcctgcaactagatggtcccatctgggggtgatgggagacagtgacagatcatcaggcattagattctcataacgagcacacaacctagatccctcacatgtgcagttcacaataaggtttgcactcctatgagaatctaatgccacagctgatctcataggaggcagagcttagacggtgatgcaagtgttagggaatggctgtaaatatagatgaaacttcgcttgctcacccactgttcacctcctgctgtgtggaccagtactggtccatggccctggggttggagacccctgctttagagcttcaggtaacctgccctaagatgctatgtcatgcagagactcaagtagccccagcctcccagtgttccctttaccttgcatggaagacgatgtttgtttatccttgtaacctgcttatctctcaaggccgaggtcctctttctctcctgcctctacctaaagacttcttaaacaagaggcctcttgctgcagtctcctgttgctcatacccagtcacttccaccagctgtcttctttcctgagccctctgtcgctactggtctctaatcaccaaaggcctaggccttaacttcatctttctctttcctctctgcagcaggtggcacacactgttgatcatcccctagccaaagctttctcctcccttgacttttggcatgaccctagacaactgattctccttatagcaccatttttgtctctcatttgttcctttatcctcctgttctctcacagtgtctgctctgtggctgtcagcattcccctcctcattcagatacttgggatgctactggcatgtacttaggagctttgaaatcagagaagctgggcttaagccctggttcttccacatgcttgtttgatgactttgtacctgccattcatctgagtttcagttttcccatgtctgacatggagatgataatgatacctatcttgtagggttatgtgaagggtaaatgggatgcaacaatgtttttgaaattttcgtctgatcccctgctgccctttccaagtaacctgtcacttttccttacctagtgtcctattttcacaggctgcctgtttctgccttaaagcctttgtgtagaaatcttgctaaagctttactgacctatctgtttcaccaaatctgtcaacatcttgcatatccttcaagttccacttcaggattgtttcctccagtgtcttccctgactgcactcattgtgcccttccttcctctgaaattccgttgcttttctttctaacatttatttagcagttgatataaactggattatgctgttgcttttcttttgattttctgtttaagtttgtatgtatctgccttgtttccgtaaatagatggtgactttattgatgcgaaggcccattttgaggcatatgaaacagtgattaggaacattagctatggggctggacttcctaagttggcacgtggtcccgtcacatactaaccatgtgaccctgggcaaattactgaagcttttttttttttaatttaaatttttttgtgggtacatagtaggtgtatatatttattgggtatataagatattttgatacaggcatggaatggtacatagtaggtatatatatttatgggtaacatgagatattttgatacaggcatgcaatgtctaataatcacatcatggaaaatggggtatccttactctaaagcatttattctttatgttaccaacaatccaattatattattatagttattttaaattatacagttaaagcgttattgactatattcaccctattgtgctatcaaatactgggtcttatttattattctttctttctatttttttgtacccattaaccgtctccacctccccaacactccccactatctttcccagtctctggtaatcattcttctgctctctaactccatgagttcaattattttgatttttagatcccacaaataagtgagaaaatgcaatgtttgtatttctgtggctggcttatttcacttaatgtaatgaccaccagttccatctatgttgttgcaaatgacaggaattcattcttttttatggctgaatagtacttcattgtgcatatgtatgtaccacattttctttattcatctgttgaaggacacttaggttgtttcaaaatcttagctattgtgaacagtgctgcaacaaacacggaagtgcaggtatctcttcgatatactgattttctttctttggggtatatactcagaagtggaattgctgcgtcatattgtcactctatttttagtttttttgttctattttagtttttagttatggagaaccaaagtgttctccatagtggttgtactaatttactttcccaccaacagtgtaagagggttactttttttctgcatctttaccagcatttgttattgcctatcttttggatataagccattttaaccagggtgacatgatatctcattgtagttgtgatttgcatttctctgatggttgatgatgttgggcactttttcatatacctgtttgctattcgtatgtcttcttttgagaaatgtctattcaaatcttttgctcattttttatgtttcattgattgatcaattaactgattgattgattttgagacaggctctcactctgatgcccaggcacaatcttggctcactgcagcctctacctcctgggctcaagtgatcttctcacctcagcttcctgagtagctgggactacaagtgcacaccaccatgcctagctaattttttgtagagacggggtttcactatgtcgcccaggctgattgcccatttttaaattggattattagatttttttcctatggagttgtttgaacttcttatatatgctggttattaatcccttgtcatatgggtagtttgcaaatattttatcccatactgtgggttgtctcttcactttattaattgtttcttttcctgtgtagaagcttttttaacttgtgatccatttgtccatttttgttatggttgcctgtacttacgggatattactcaagaaatttttgcccagagcagtgtcctataaagtttccccagtgttttctgtagtttcatagtttgaggtattagatttaagttttcatccattttgatttgacttttgtatataataacagattggggtctgctttcattcttctgcatatggatatttagttttcctggccccatttattgaaaagactgtcttttccccagtgtatgttcttggcaccttagtcaaaaatgagttcactgtaggcgtgtggatttgtttctgggttatttattctgttccattggtctatgtgtctgtttttataccagtaacatgctgtttaggttactatagctctgtagtataatttgaagtcaggtagtatgattcctcctgttttgttcattttacttaggatagctttggctattctgggtcttctatggttccatatagattttaggattgtttcttctgtttctgtgaagaatgccattgatattttgatagggattgcattgaatctgtagattgctttgggtagtatggacatttgaacaatatcgattcttctatgaacacggaatatttttcctctttttgtgtgtcctctttgatttctttcagtagtgtgttatagttttcattatacagatcttttacttctttggttctgttaaatcctaggtatttactttgatttttggctattttaagtgggattacttttctgttcctttttctgattattcgctgttgatatatagaaatgtgactgattttttgtagtttattttgtgtcctacaacttaactgaatttgtttatccgttctactaggtttttttttttgtgtgtgtgtggcgtctttaggtttttaatataaggttatatcatccacaaacaaggataatttgacttcttcctttccaatttggatgccctttatttctttctcttctctgattgctctagctaaaacttcctagctatgttgcataatgatggtgaaagtgggcatccttgtcatgtttcatatcttacaggaaagactttcagtttttccccattcagtatgatactagttgtgggtctattatatatatgttgaggtatgttccttctatccctgcttttttgaggtcttttattgtgaagagatgttgaattctatcaaatgctttttcatcatcagttgagatgataataaggtatttgtccttcattctgttgatatgatgtgtcacattgattgatttatgtatgttcaaccatccttgcatcccgggaataaatcccacctggtcatgatgaatgatctttttaatgtattattgaatttggcttgctaatattttgttgaggatttttgcatcaatattcatcagagatgctggcctctggttttcttttttgatgtgtctttatctggttttggtatcagagtaatactgacctcatagaatgtgtttggatgtattctcttcttctctgttttttggaatagtttgagtaggattggtattagttcttctttaagtgcctggtagaattcagcagtgaagtcattaagtcccaggattttcttcaccgggagacttttttattatagcttcgatctcattacttgttattggtctgttcaggttttggatttcttccttgttcaattttggttggttgtatatgcctaggaatttgtccatttcttccagattttccaatttattggcatacagttgctcatagtagccactcatagtagatattttgaatttctgtggtacagttctaatgtctcctttttcatctctgattttatttatttgggtcttctctctttttcttttagttgctctggctactaagtcagttttgttcaacttttcaaaaaatcaactttttgtttcattgatcttttgtattgttttctacatttcagtttcatttatttctgctctgatctttattttttcttctactaattttggcttggcttactcttgcttgtctagtactttaagatgcaacattaggctgtttattcgacatttttctactttttcgttgtaggtgcttatgcctatagacttccctcttagtattgcttttgctgtatcccataggttttgttatgttggaatatgtttccattattatttgtttcaagaaatctttcaacttccttcttaattttgtcattgacccactggtcattcaggagcatactgtttaatttccatgtatttgtatagtttccaaaattcctcttgttattgatttctgtttctttgtgttcagaaaagatgcttggcattatttcagtttttttgaatgttttcagatatgttttgcgacctatcacatggtgtatccttaagaatgattcatgtgctgaggacaagaatgggattaaatatctattagatccatttgattatagtgcagattaagtatgatgtttctttgtctttgattttctgtctggaagatctgtccaatgctgaaagtggtgtgtagaaatctttagctattgttgtattgaggtgtatctctctctttagctctaataatatttgcattataggttgggcacggtggctcatgcctgtaatcccagcactttgggaggctgagtcaggcagatcacctcaggtcaggagttccagaccagcctggccaacatggcaaaccttgtctctaccaaaaatacaaaaattagccaggtgtggtggcatgtgcctgtaatcccagctacctgggagggtgaggcaggagaattgcttgaacctgggaggcagaggttgccacgagctgagattgagccactgcactccagcctgggcaacagagtaagactctgtctcaaaaacaaaaactttgcattatatatctgggtgctcccatgttggttacctatatatttaaaatttttatatcctcttgctgaattgacccctttatcattatataataaccttctttgtctcttatagtatttgtcctgaaatctgtgttgtctgatataagcatagtgactcctgctcttttttgatttccatttacatagaatatctttttctatcctttattttcagtctatgtgtgtctttatgggtgaagcatgtttctagtaggcagctgatcaatgggttttgtttttacctccattctgcccatttgtgtcttttgattggagagtttagtccatttacattcagtgttattgataagtaaggacttacccctgccattttgttgttttctggttgtcttgtggtcatctctttcttctttcctttcttcctgtcttccttttagtgaaagtgattttctctggggatatgatttagtttcttgctttttatttttggtgtatctgctgtatattttttgatttgaggttaccatgaggcttgcaaatactatcattattttaagctgataacaatttaatgctgtttgcataagcaaacagataaacaagcaaaaagacaactaataaaaactctacaccttaacttgattcccccactttttcactttttattgtttctatttatatcttattgtactgtctgtgtcctggaaagttgttgtagttacggtttttgacgggttcatcatttagtttttctacttaagattaagagtagtttacacaccacagttacaatataataatattctgtgcagttactattaccagtgagttttgcaccttcagatgattacttattgctcattaacatccttttctttctgattgaagtactccctttagcatttctttcaggactggcctggtgttgctaaaatctctcagcttttgtttgtctgggaaagtggttatttcttattcatgtatgaaggtattttcaccaatgtactactcttagggtaatagtttttttcgttcagcactctaaatatggaatgccactctcccctggcctgtaaggtttccgctgatgaaaagtctgctgacaggcatattggagctccattgtattttatatgtttcttttctgttgctgcttttaggattctttctttatcattgacctttggaagtttggattaaatctcttagtcttctttgggttaaatctgcttggtgttctataaccttcttgtacctggatattgatgtctttctctaggtttgggaagttctctgttattatccctttgagtaaactttctacttctatctctttctctacatcctctttaaggccagtaattcttagatttgcccctttgaggctattttctagatcttgtaggtgtgcttcattgttttttattctttttcttttgtctcttgttactatgtattttcaaatagtctgtctttaagctcactaattctttcttctgtttgatcagttctgctattaaaaagactctgatgcattcttcagtatgtcaattgcatttttcagctccagaattcctgcttgattctttttaatgatttcaatctcttttttaaatttatctgataaaattctgaattccttccctgtgttatcatgaatttctttgagtttcctcagcacatctattttgaattttgtctgaaaagtcacatatctctgtttctccaggattggtccctggtgctttatttagtttatttgatgaggtcatgttttcctggatggtcttgatacttgtagatgtttgtctgtgtctgggcattgaagagtgaggtatttattgtagtcttctcagtctgggcttgcttctacccatccttcttggaaggctttccagagatatgaaaggacttgggtgttgtgatctatgctgtatctgctttagggggcatcccaagcccagtaacactgtggttcttgcagactcatagtggtaccactttgatagtcttgggatgagatcagaaagaattctctgggttaccaggcagagtcttttgttctcttctcttactttctctcaaacagacagagtctctctctctggtctgagtcacctggagctgaggatggagtgacacaagcacccctgtggccaccaccgctaggactgtggtgggtcagacctgaagccagcacagtacttggttcatccacagcctgctgtaaccactccctggctactgcctatgtttgctcaaggacattgggctccacaatcagcaggtggcaaatccagccaggcttgtgttatttcattcagggcagtgagttcccccaggccctgggcatgtccagagatgccatctgggagccagggactagagtcaaaagccttagaagtctacctggtgttctagtccattgcagctgagctggcattcaagccacaaaaatgcagtccttctcactcttccctcccctttccaaaggcagaggagcctcaccctgtgggctctgacactgccaccacagtctttcagggagtactgccagaacaccccgtcagtgttccctcaaagtctctttagtcagcttgtggcaaatgttgcttggcctgggacttacctttgagggcagtgggctcccctctgacccagggcaggtccagaaatgccatccaagagccaagtcctagaatcgggggccccaagagcccacttgatgctctctgtggctgagctggtacctgaggtgcatgatagagtcctctttactttttcctccacttttcttgggcagaagaagtctgtccctgtagccaccacagctggtattgtgctgaatctcacctgaagccaggaagtctcagagtcgcatctaaggcccatgacatgcttacctaggtattgctgctgattattaagggcccaaaaggtcttcagttagcagatgatgaatcctcccaggactaggtccttcccttcaagacaacacgttttcttctggcccagtgtgactagaaatgtcatccaggggctagggcctagaaacggggcctcacaactctgaccagtgccttatcctgctgtggctgagctggtatccaaaatgcaagacaaagttctttccactcttctctctcttcttctcaagcagaaggaagaggtttcttttggagctgtaagctgtgcaacctggggttaggggaggggtgatgccagcactcccttagccaccttggctggtgtctcggtaggtcacatgccctctagatcactggttctggacccagttcagcactaggactcacctaggagttgcagtccctgtggcctagactgcctttcatgtttatttaaggtccatagcactttagcctacagtggcgaggcttgtggaaaatcaagttccaaccactgggattggcagcttttctctggctagggctggtttaatgctctccctccgtgggcaggcattagctgagtttggtccagttttgcttcctgctatgtagcaagggcagcactgagttcaatgcctcgcagttgctgtactcccctctccccagtacatagaattaccctctgcatagaatgccagtgctgctgtgggatggtggaggggtggtgttgctcattcaagattggttttcctatgtttttagtacctcttttagtgatatgaagttaagaccaggtactgtgagtgcttacctgatttttggttcttatgaaggtagttttttgtgtagatagttattaaattggtgtccttatggggaaatgatcagtggagccttctattctgccatcttgctgtgctccctcttcattttcttcttcagtgactgaatctcaatgtgcctcagtttcctcacctgtcttgtatgtggtagtaataatacatagttgttgcaagtttaaatgagagtatagttagctcagccccttcctgatttattaataatacatgtggagctcatagaagagtgtttggcatacagtgcttaagaaatgatgattgttgttattattttcagtttcaatgcctcctcttgcagtgctagtcatccataatataggcttaacaatattgtggaatgggtgaatgtttcccctccaatactcttttcaatttttcattgttttccttacatgcatattatcataaaaatttagtttcccctcatttaattctgaaacaaacaaaaaaactacctatggatttaaataggttttactgtctgatataaggaaacagatcagccctttgagataaatttttttcttggtactaaatttcaaaatgaatttattgtaagattatttatggggcaggaggctagtagagcgaagacagctcatttttctaaaacctacttaacatgttgagattagaaagaaatttttccattgaatacaggaactgtatcaaattacattgacagtccagggggattaggtcagctgggaggtagataagacagagctttgtgtgttcccctatatttagagattccactgggatactaaagaggaagatcagtggtgtgtgcaaatgagcaggtataatccagaaattgccatctgaaataaccttttacatcataggtttatttttgtctttagggagcaatgttgtcagtaatttactataattgcaataaccagatcattaaaccatgtctgtagagagcatggaaaaatacatctactctttaagtgacaatgtatcaaagaatatactaagactattttaatcaaatagtattactattgttatttttctatatatttttttcagtttttgagacagagtcttgctctgtcacccaggctggagtacaatggcatgatcttggctactgcaacctccacctccctgagttcaagccattctcatgcctcagcctcccaagtacctgggactacaggcacatgccaccatgcctggcttttcttttttttttttttgtatttttagtagaaacagggtttcaccatgttggcaggctggtcttgaactcttgacctcaggtgatcaagttccaaccactcagcctcccaaagtgctgggtttatatgtgcgtgagccaccatgcctggcctattactatttttaatacagtttcctatagatgaagtgggcatttaagttacacacacacacacacacacacacacacacacacagacactttagcatcccttcagaaaatgagagcctaccaagacatacttagttgttttgtagagttaggtgagcatggtaatgatgggggctggtatactgattttatttagatttttcagatgattcttcaacaaaagctattaaaacatgagtcatcttgggatcaaaagaaagttttgtcataggttaaaaaactggtcttaaacagggagatagcatagtgagcaaatgggcattttcctcagtggaaatcagttagtatggtattaaaaggtcctaggggccgggcgccatggctcacgcctgtaatcccagcactttgggaggccgaggcgggcagatcacttgaggtcaggagttcgagaccagcctggccaacatggtgaaaccccatctctactaaaaatacaaaaattagccaggtgtggtggcacgtgcctgtattcccagctactccagaggctgaggcaggagaatcgcttgaacccggtaggcggaggttgcagtgagccaatatcaggccactgcactgcagcctgagcaacagagcaagactccgtctcaaaaaaaaaaaaaagtaaaaataaaaggtcctaggatttaatatatttttataaatgatgtgttaaagtgacttcataatgtaatgtccggttttttttttttgacaactccaagttgcaaaagataaaattgacagaaatgaatttcagggagatagaaatacctgcatgaacagacaaaagagttgtgggtaatagttaatacaaaggaattagtaagaaaacagaatcagattgtttacaacgtggccaatgtgatttaggaaagggctgagagtccctgtagcccattgttagtaagaggcttcagcctatatagttcttgttaccatcagtaaaagtgttgaaacatactgccctactcataccaaacattgattcaggaggtagtataaataccaaaaaaaaaaaaaaaaatttaagcaaagcagatacattttgggatgataaatctataatgagttatgaaaggaaacaaggcttgctttaggagaaacgttttaagcctgagacaatggagaaaacatctggtcaactgagcagatgtggaattcctttcctcacactgcaaacacatagaatattggataaaatgtagcatttttccggctgggcgtggtggttccatatttgctcttctttctccatgtgaaaaccctgaactgagaaaataactcagaagctggtcccaattcattgaatgctgtaggggtctggcaggggcaactttgaaagcaatcctgttgggtttttttttgttttctgacaaaataccatggacctctcatgatgataaactcatcagcagaaattgcaaagtacttaactatacacactccttgaagtcaaccagtagaagcaacaaaataaactgaaaaaccaaacagagaaatcttaaaggaactttaaaaatcaatgtctaaactattaaaagataaaaaaggatttcccaagagagagaaaaaaaggagaatttgaaataaaacaaaatagagatgctagaaaaaaaaatcattgaaatggaaaaagttccattcctgctactaattattggaatactggaaaattttcttcatcattctgtgtcttggtttccctatctgtaaaataaagtaaaaatgccttccacataatgttgtattgaaagcattaaattggtagttcaaaaaatattagtctccaatccatctccccatcactatacaggtatagtagccagatattctgtctcaattttaaacactatgttctatcttgtcatcaaaccatagaaccaggtttggagttcataagaatatagtaaacatggatatgaggttctgaagaaagcaggggaaggggagggaagatgtgccccaagctgcctgtatttctgaagcatatggtttagttactgctttgccttggaaggcccagggcaggggggtgcacaggacccagtgtagaattgggccacggccttcccagccaccttggttcgatcctggcttatttgccatgtaagtgtatgggaaatttccctgtggagttgggcagaaaaggccttacctggttgtcaggtgcaaggccatggctgaaatctgaagccccatgaacttaagtgatctaagaggatgcagaaacacccagcttagtctcctctgattgcagcactggaagaccacgcatagcagtttgggagtgtatcaacccccacagtcctttataagtccattgtaagtcctggtttctgcttaacaacaggacacttggtctcttacacatgccatgcacgttctctctcatttacttctctctcatttgcttcccttttttatcctcccctgttctccttctgcctctttctattgcttcctccccttcctcatccaagtccctcttctctgctcatttttttaggccttccatcaacccctgtaggcacgtttcacccttgggtggctcttgggctagagacactccagcatgctccccctatgctctgccacagggttatcaattcaaaaacaatctttagattcccctagaaggaatgaaggcactgcaccaggttaagtgcatacaaaatgctccagtaaccatggagaaatgtgcatcttaaaatcccgaccttacacccaagtctccatagatcttggctctgctatatcctgatcttatgattcaaaaatgaggctgatgtttccttgggatgtatctttcagatataagagagcagagacagcagcttaaccaaatgaatgagcttctttattattattattattattatactttaagttttagggtacatgtgcacaacgtgcaggtttgttacatatgtatacatgtgccatgttggtgtgctgcacccattaactcatcatttagcattaggtatatctcctaatgctatccctcccccctcccccaaccccacaaccatccccggtgcgtgatgttccccttcctgtgtccatgtgttctcattgttcaattcccacctatgagtgagaacatgtggtatttggttttttgtccttgtgatagtttgctgagaatgatggtttccagcttcatccgtgtccctacaaaggacatgaactcatcattttttgtggctgcatagtattccatggtgtatatgtgccacagtttcttaatccagtctatcactgttggacatttgggttggttccaagtctttgctattgtgaatagtgccacagtaaacatacgtgtgcatgtgtctttatagcagcatgatttataatcctttgggtatatacctagtaatgggatggctgggtcaaatggtatttctagttctagatccctgaggaatctccacaccaacttcctctatcctacaagggatgtggtagcaggtgaagagtacccaggatcattgctccttctaagaatgggggaaggcatggagtgaatgagtagggtcaaccgatagattactccattagacttcagcaaatattcttgcctttataccaagttgctcatccattgccctcaatacccctatgcatacctacaagagagtgtcttcatttgccattgcagagccagagagatgtgcagttggactgccctcagactagaggtgcaacacaattcctatggccttgactccctgggtggttattttatatgtttagtgagtagcaccgattttagggaatcagttaacaagaatttactcattttaattaggtttgtatttttttatttccttttgaaagtaacacatattatgggttgatgtgggtagggaggtacaaggagagaaacaagaagatagaggaaaaaatatgacttgcatccccaggaatcaaacaaccatgttgacatgtcatatgcttatttcaaaagttttccttacatactcgaaggcttttaaaaaagtgattatttaattttatatcctgccctttcttttcaacattatagcatatattttcttatcattacgaacccctttataattccaagtgctttttaatgattttgtttttgagatgggggtgtcactgtgttactcaggtcggagtgcagttgcacagtctctgctcactgcatcctctacttcccaggctcaagcgattctgccaccttagcctcctgagtagctgggaccacaggtgtgtaccaccatgcccagctaattttttgaattttttttttatagaaatggggtttcgccatgttgcccaggctggtctcaaatgcctgagtttaggtgatccacctgcctcggcctctcaaagtgctgggattacaggcatgaaccaccatgcctggccataatggtttttaatgagttatttctttgatagatataacataacattatttacgaaacctttccctgttttttaaaatgtgggatggttccacttgctgctattataaatactgccgccccagggcataaagatcaacaagaatgccttgagattctagtatgtgtcaggccttgggctgggttctgggggaatatacatggtttctggtgtcaagaatttacaagttagtttgggggataatgacataatcctaaattaatcctaagcactttccttttgtcctttcagataagatgaaaataatcataaataatattgaatttttttataaagaaagcagaaccaagaaaggatgtatatattgatggcaattgatatatagcacatgtctagattgaccaagacacaaaatgaattgttagtcatagcaaatattggggagattaagttcaaacagcaactggtctaatttgaattttagttttgcctgataaatacctaataactgacaccagactgtacattttcccccatgtaatttaaatgcgctgattagagttggttatttttcataaatccgaaaatgtgtaaacattcattaggaacatgtgcattaaattgcaaccaacattggtggctgattaactgagttgcagttctggctttatgggcctgttgagatctactctccccttgttttcttttttagaattactttgaagctcatgcaaaagtattccaaaaaagaattatgaagttcatgaaactacaacagatttttttttttttgagacagagtcttgctctgttgccccggctggagtaaaatggtgcaatctcagctcactgcaacctctgcctccccggttcaagtgattctcctgcctcagcctcccatgtagctgggattacaggcacccatcaccacatctagctaatttttgtatttttagtagagataggatttcagcatgttggccaggctggtcttgaactcctgacctcagatgatccacccgcctcagcctcccaaagtgctaggattataggcgtgagccaccgcacctggccccagactacaacagattttaaaaagaacatcacgatggtgggtgtgagtgtgagtgaaggggtgttactgtagagcagggtgggataaacacaggtaatagactaggaaacagcctatctgaaagatgctttgaaacaccaggattttggtatatcagaatgaagtgtccatgtgccagagaaccaagtccttccaaactcaagcgtttgaagtaatagaccagtggggacttctccagagtctgggcaggatgattctagtgctgcctctgtgctgtaagcagggatgcatctcaccacttgttttcttcttgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagagttctagtcccctttctagcaccaggagcaagaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaaactaatagtatccagtcacagtgaatttgaaagctggaatagtttgtctttacaatgggtttctgttcactgtcagttatcattatattttggcctttggtggggatgtctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatctgcagccaatttcttggcatttgcttctctttctcctcaactcgactgaccttggtggaatgcagataatgcctctttgttgaaataactttgtgggaatgtacaattttctatatctcttagctttccgtggttctcaaggatatgtacagttttcattttcctccaaagttgaattttgctacatttttcttttaggtaatgataagcattttttaaaaaatcatttttaggtaatggtaagcattttatgccaaatgtggcataacagagtttgaattgaagggcaaagttttcttttcttttttttttgggccccttgaatggtataatacagtcctctccggtggaaagaagagaagagaaggtggacagccctgctcttagtaggtgctgcagatccaaggacatcttttgtccagcttggattaacttgacgtgtatccctgcctgacaaggttgaactgaaagatctatatgttaagctaacatgaaaattcatattctgcaacatagtagatttttctaatgcatgaaataagtacccagcacagtaaaaatactctgacttatgtccctaaatggttgttttgatacaactatatagaaaagagccacaaaataaagataaaagttattgtggccatctctgaaaaaaatatataaaatatttaagaataattatatcttaggaaattatttttacagtgtgtttgaggctacaaacataactcccccattaatacaaattaaatgtgagagctcattctcaaaatttttttgatcaagcacttgtcattttaaatcttgcactaaaaaatggtaacaagagggaccaaactttgcttcccacaattgggatggaatcacctggatttttctgaatgttttaaagaattgctgagaggtagaaacagccaagtatgaaatactgatcttggggctaccgcccaggatcaatcagaaagttatatgcaaaaattcggggtcccaacaaggagagaacaatatgtcaaccatttgcatggggtcgatggatgagaaacatgagcgtagcaagagttacattttgcagaaaaatagcggaggcacacccagagtagaacagcagccagcaagctgccatcctgatcaatttgtgatgcaaggttagggagtatgagcaccgcatgggtccatgctagggagatgtgcaccaggcttagctaagaaacttaaagcagtattttaccaactcttgtcttagggagcataaagtttggatgtccctttatttcagcagtgtgaaggtaaatggaagggtgagggtttgacttggtactgattggtcaagaatcctgctggataaagaaaaggaattttagaagtgaccagagggacagtccagccaaactattatttgataaggaacccaaggccctgggaggcaacaggctagcccttagtttcatggctagctgagagcagattaggagccaacgttgtttgcacatgtcccatcacacctgagatgtcagacatgggaagttcgtgctattattcagttgcctctctggaccatggcaagatttcctcattcatcaaacagactccaggccctgacaaagcagttggatttggcatgtgtgatgaaaacaattagccatccatgtacaacattatgcttactgcatcccatggaaacttaattccctcctagcacatatttgcatactgaaaggtccgaaaagggcatccacggcagcttgagccccttagcaccatgtaaggagcacagcatccaaacggcttcttgagaaccattggggaatgtctttctttttcacatccaattgtttagtgtctatttattcttgggtggccagttttgaaacctaaaaagggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgaggtagaggttggggtttatgaaccccaactctggcttaaagatcttgctgtggctctgttatgttctgaggccttgggattagcctcttcctcattatggagctgattttctagtctgtggatcagctatgcctttggacacttctcttttccattgtgccttttgaatgttgtcttctcactcagcatcagcacttcgatctaaatgcagactaggtagttgggaggaggaaccaaagtgaaccatccttcatttattcagtcattcgttcatctgtcaaacacgtatttggacatcaaggttgcagagatgaacaatgcatggatttcatctttgaggagttcaaaacctagtggagagaacacatggtacaatcgtaacacatgaaggacaagtaagtgctgcagtaaaggtactaataacatgttccttggaacagaggaagaaaaaccacgaaaccatggaaattagggaagcctttacagagggtgtgacaaaactcaatttgacattttcaagctatgtacaatgatgtgcaccttgcagatgctcaataaagtaattactgac

SEQ ID NO: 37743 - DNA, 3880 bp, Homo sapiens
aaattgagcccgcagcctcccgcttcgctctctgctcctcctgttcgacagtcagccgcatcttcttttgcgtcgccaggtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcagccgagccacatcgctcagacaccatggggaaggtgaaggtcggagtcaacgggtgagttcgcgggtggctggggggccctgggctgcgaccgcccccgaaccgcgtctacgagccttgcgggctccgggtctttgcagtcgtatgggggcagggtagctgttccccgcaaggagagctcaaggtcagcgctcggacctggcggagccccgcacccaggctgtggcgccctgtgcagctccgcccttgcggcgccatctgcccggagcctccttcccctagtccccagaaacaggaggtccctactcccgcccgagatcccgacccggacccctaggtgggggacgctttctttcctttcgcgctctgcggggtcacgtgtcgcagaggagcccctcccccacggcctccggcaccgcaggccccgggatgctagtgcgcagcgggtgcatccctgtccggatgctgcgcctgcggtagagcggccgccatgttgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctggtaaatcaaagaagtgggtttatggaggtcctcttgtgtcccctccccgcagaggtgtggtggctgtggcatggtgccaagccgggagaagctgagtcatgggtagttggaaaaggacatttccaccgcaaaatggcccctctggtggtggccccttcctgcagcgccggctcacctcacggccccgcccttcccctgccagcctagcgttgacccgaccccaaaggccaggctgtaaatgtcaccgggaggattgggtgtctgggcgcctcggggaacctgcccttctccccattccgtcttccggaaaccagatctcccaccgcaccctggtctgaggttaaatatagctgctgacctttctgtagctgggggcctgggctggggctctctcccatcccttctccccacacacatgcacttacctgtgctcccactcctgatttctggaaaagagctaggaaggacaggcaacttggcaaatcaaagccctgggactagggggttaaaatacagcttcccctcttcccacccgccccagtctctgtcccttttgtaggagggacttagagaaggggtgggcttgccctgtccagttaatttctgacctttactcctgccctttgagtttgatgatgctgagtgtacaagcgttttctccctaaagggtgcagctgagctaggcagcagcaagcattcctggggtggcatagtggggtggtgaataccatgtacaaagcttgtgcccagactgtgggtggcagtgccccacatggccgcttctcctggaagggcttcgtatgactgggggtgttgggcagccctggagccttcagttgcagccatgccttaagccaggccagcctggcagggaagctcaagggagataaaattcaacctcttgggccctcctgggggtaaggagatgctgcattcgccctcttaatggggaggtggcctagggctgctcacatattctggaggagcctcccctcctcatgccttcttgcctcttgtctcttagatttggtcgtattgggcgcctggtcaccagggctgcttttaactctggtaaagtggatattgttgccatcaatgaccccttcattgacctcaactacatggtgagtgctacatggtgagccccaaagctggtgtgggaggagccacctggctgatgggcagccccttcataccctcacgtattcccccaggtttacatgttccaatatgattccacccatggcaaattccatggcaccgtcaaggctgagaacgggaagcttgtcatcaatggaaatcccatcaccatcttccaggagtgagtggaagacagaatggaagaaatgtgctttggggaggcaactaggatggtgtggctcccttgggtatatggtaaccttgtgtccctcaatatggtcctgtccccatctcccccccacccccataggcgagatccctccaaaatcaagtggggcgatgctggcgctgagtacgtcgtggagtccactggcgtcttcaccaccatggagaaggctggggtgagtgcaggagggcccgcgggaggggaagctgactcagccctgcaaaggcaggacccgggttcataactgtctgcttctctgctgtaggctcatttgcaggggggagccaaaagggtcatcatctctgccccctctgctgatgcccccatgttcgtcatgggtgtgaaccatgagaagtatgacaacagcctcaagatcatcaggtgaggaaggcagggcccgtggagaagcggccagcctggcaccctatggacacgctcccctgacttgcgccccgctccctctttctttgcagcaatgcctcctgcaccaccaactgcttagcacccctggccaaggtcatccatgacaactttggtatcgtggaaggactcatggtatgagagctggggaatgggactgaggctcccacctttctcatccaagactggctcctccctgccggggctgcgtgcaaccctggggttgggggttctggggactggctttcccataatttcctttcaaggtggggagggaggtagaggggtgatgtggggagtacgctgcagggcctcactccttttgcagaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgtggctggggccagagactggctcttaaaaagtgcagggtctggcgccctctggtggctggctcagaaaaagggccctgacaactcttttcatcttctaggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacc

SEQ ID NO: 37744 - DNA, 78846 bp, Homo sapiens
agaaaaaagcagcaagcctcggcagcagtcaatcctccagaacctatgctggtggaacagcctcggccaccaaggtcagtgatttcctgaacacgaaaagacccctactgtattctacagggatatgattagtgggtggggcctgtaggaatggcaaacagtgtccagatatcactgaaggttttttaacaaagtatcatttctgtgctagaagagagaatataatttcttaataatgatgtgaatgatttaaaacctagtaaaaccatttattgtataaatcttcttggcatataataagcgttaaataaatattaattattatgatgactatctgcagataatattaaacttttgaacatactgtgagtaaaaacgtagtgctcccactttagaaaataattcatatcctcctcatgggcattaaccacaccaggcgtgctgctagtgctttatgtaattatatcacgtaatcccctcacaatcttcttcttattcctttatacctgaggaaaccagagctcaaggaggttaagtaaccttgacaagctcacaacgccagtaagatggagatagggcttgaacccaggtttcctgttaagaggtctttgacaatgctgggtcttataaactccatctaagcaatttttggtaatataacccttcaaagttttgcaacttataaaaatcactgaaacctcacctttcgaggcaagaaaatggccaggcacagtggctcatgcctgtaatcgcagcactttgggaggctgaggcaggaggatcaccaggaggatcacttgagcccaggagttcatgaccagcttgagcaacatagtaagaccctttctctcctaaaaaaaaaaaaattaaaaattagccaggcttggtgatgcgtgcctatagtcccagctactcagatggctgaggttggaggatcacttaagtctgggaggtcgaggctgcagtgagctgtgacagtgccactgcactccagcctgggcaatagaacaagactctgtctcaaaaataaaaagaaagtctaattttataatgttagctagtaatttttgataaataaaattgttttgggagtccacggtgggcagatcacgaggtcagaagttcaagaccagcctggccaagatggtgaaaccccatctctactaaaaatacaaaaattagctgggcatggtgtgtggtggtgcgcacctgtagtcccagctactggggaggctgaggcaggagaatggcttgaacccgggaggcacaggttgcagtgagccgagatagcgccactgcactccagccttgtaacaaagtgagaccctgtctcaaaaaaaagaaaaaaaaagttgttacattcaacccatttcaactttgtggtcttttagtatgtccaagattatctaaaacctcaacctatgtttcaggagtatctatacaactatttaacgtaagcttttttttttctttaaaactggtggctatcttatggaagtcagactttctcatagatgtcacttgctcaatgaagagttagtattttcgtgtcactcagagttctgactgctctccaagtccctgatggtgcccaaaccaataatcagctgagaagctctaacgctaaataccatgccactttaagacccgtgccttttaaagaccttttcaaagctctctgctaccagtcaataaaaatataaaaatcattgaaagaccatgaatcgtaaatacagggagttaattaacatttggaaccaacataaattcaaaactgaggtctgctctttgttagccattctttactgctgctggagacaccacagcattcactgatggccactgggtgagagagttgcttacacaaacaaatatgagtttggatttcctctttgccactattatttgtccagtcccactgagcttcagtttcttcatctgtaaaatgagggttggacttctcttgtcagggctgttgagagccttaaatgaaagaaaataaatactaacacttaggcctggccctggcatttagcaggtgctgggaaaatggacctctcctgtgattgatcatgttaatcttcatattctgttatttccaggtctccaaataaaagagagtcttcaactaaaaaagattaacttttattgttatcaggacttgtatttagcatacacttaaattatgccactaaaaatgatacacctcattagcaaaacacccacccagtgagatttagtgagttatttgtaaatgttcccacacttgctattatctaaacttttgaaggtttagtacattgtggaaaaccacacccagttttttcttgaacgtaatcataagaatcagaccctttccatgtttcttttttttaacgtagaagttaccctatttttctgagatgggatagttataaagaatttgaacatctccccacaaaccctgttctgtcttaagagctgggaggggcagggcataactgggaagtggagatgatttagctatatgtttattgctttagtatttaacagcaaacatgaaattctttttttggctttaaaaacaccatcctctcccatttccattcttatgtctgctgtttctctttctcaccatgcttttctgactcactttcctttgccagtttcctaaatgtgagttctccagggtttgattcttcaccccttccgttctcatattttttacttttataaggtgttgaacaaacgtaattgcttatttcttcttttgatgccagattggaatggttgtaactcatagcattatcccttaaggaattacatacccatgcatcatttagaaaagctgggggtaatagcataacttgaagccttttattacacagttatcatggcacacacaggcaaaataatattctcccaacacattctgaaaaggcgtgacagagtggtagatagaattggaagtgagaactagtgctagttttcttgattctggaaatagttaatttgaaattcaaaataagtgataattttacaattattaagaaaactttaaagttttaaaaattaagtacttaatttgaagcatatgtgtaagctatgtattagagaatggtttctatatattgtagaattgttttatgagaatgcttacaaaatgaggaattgggccctcaaataatatcccttctgctatgcagttttaggtttcaaagatctaatgctcttaagtgatgtaaatttttctaattcaaaataattagtgtaaaatatttagttcttaaaatttaatttttggtaaatcagtagtgaagatgaggctgcggaaattatacggactcttactaaagcctatatgaaaatagttgtgatccataaccagtcatgcaattttatttctggaagacttgtcagacaacttctatttcaccaacctgactgttcaggtgaggaaaccgaggttcaaattgcattaggaatgtctctgtagaagaccatgctattaagaagatgtactggttaaagttgttagttccaattagaacccactctgactaagccaaaaaggaatttcttaaggaacggggtagctggtagagaaatccaggagagtacagcagaagaaatctaaagccttacagcagtactaatgcacagtaacactatgaggctttctcctgctgccaccacagctcagctcctgtcacatgtaggactgggtgccagaactctgccactgacaatgcagaagactcaaaatccctattataacatggatttcctggtgggcagcagcctgcacacgttgctcacttcccagctcattcttgtttggcacatctgattggccagtgtaaatcacatgccttcaccctgctccaagggaatctgggggtgtgagtcttctggatcctactttgggaaggcatggactgataaggcaggaaattatcaatatgtggtgaggtttttcaaatatgtggcctcctgctgaatgacagatatccatgacaaaggaaaacaggagaattacctaattgaataggaaaactacagatgacaagttattcagcaacattaggcctttcaaacagaagaaagcgcaaacaactttcctcccagcctagacaggaggagatctatgaaggaataagcacctatcagagaaatactttcgtgatttgggtcctgagtctgccataaatagctgtgctgactttggcaacacagctctcttcccaggttcttacttttctcatctgtaataggagtgagggtttgggttaactcttcaggtactgtggagggtatgctgacattcagtgccagcatcagcccacagtaccctcctaccacgtgtggtttgtgagatgactgtgtgttagacaagaaagcgtttttattttaataattatgcttatattttaatgtgctataaaaagtaaactagcacatcaactcctaatcccatggctattttcatttatagtgaggctgaatttaaggttaaagtaaatctacttcttttaaattaagtaaacataatatatctatggcaggttaaaaaatattatataagtaatgtacaaataataaccagggcttgagaaataagatccagagcagtaattctcaccttttaatgtacataatgagtcagtgtgggttttattaaaatgaagattctggtttaggaagtccaggatgaggctgagattctgcttttctaacaagcttccagtggatgtgctgctgctgctttggcaaccacattttgagtagccaggagactgaatagtgcagaatgtgggtagtttaggctacccataacctaaacatcaactagagaatctgattaaaatgcagattctcaggtttgaagccaagaaattctgattcgccggggtgggggaagagcccaggatttcatatatttaataggcattcccaggagtttcagatgcagatgatttgagaaccacactggcaggaaggacaccctcagggattgtgatggccacagcacagcagtggaactacattgtttgccttcactctaaggaaaggagcctttttccacctgacttacagcagaagaatcttgcgaaaaaaatttttttttttttttgagacagggtctcactattgcccaggcaggagtgcagtggtgtgatctcagctcactgcaacctccaccttccaggttcaagcgataatcctgcctgaagcctcccgagtagctgggattacaggcaagcaccaccgcacacagctaatgtttgtatttttagtagagacagggtttcaccatgttgcccaggctggtctggaactcctgagctcaggtgatccacttgcctcggcctcccaaagtggtgggattacaggcatgagccaccatgcctggccagaaaatttgttttataaccatgtgattactcatctgtactcatcaggagcacagaaatacattcagagataggcatcattgagctgcctaactctggaagctgtggggcccagggcccatccctatggggtgtggcccaaattagtcaccctgtgctgtttttgtcacaggagaaattaatgtcagtgaaacctagatgagcttttagtctatttttaaaaaggaatgacaatactaatgatcaacaacaacaacaaaaagggatatataagctatatatcaagaagaattctaagtccgggtgcatggctcatgcctgtaatcccagcactttgggaggctgaggtgggtggatcacttcaggtcaggagttcgagaccagcctggccaacatggtgaaaccctgtctctactaaaaatacaaaaattagctaggtgtggtggtgcatgcctgtaatcgcagctactcgggaagctgaggcaggagtattgcttgaacctgggaggtggaggttgcagtgagctgagatcacgtgactgcactccagcctgggccacatagcgagaatcccacctcaaaaaaaaaaaaaaattataaggacagggtcttctgctctggaaatgttagaatcttaaagttggaagggctcttatttcactagatttttgacagaaataaaagacaaaaaaaataaggtagctgtgaggagtaccttgaaaggtacatcagagggccctaactgccttggctgcctggtggggtacaaagctgtatggatgagttcacctttttcatgccactggccatcatttgtcatgactcgacacagcactgtccaacctgtcctgaggtctgtgttcctcaaacagtgaccaacactacctccttcactcacaccccaagttcagggttcagagcctttaatgtggttggtgtacggcttttcatttattttaaaattttttataattattttctctaactcttatcattcaatatttattagttggccttctatatgaaagagtggcttaacccctctatttattcattcatttatttacagcagtatagactcatgaatttatattgtattcaatagcttcaaatctattctaattttgaagtttgtaatatactataatataaagtaatcgggtagaattcttactgttaaactactctttaaagaaatccattacacagttttaactgcatttgcaaatccctggttgtagtcattactaatccactttatagtttcaaaagaggtcttcgggggagcatatttgcgaagtgcacccaccgtcgttgccttattctggtagtcacagggtgacagccgagggagcggtaacctgtaatcagccggcggtgcgcagcccacacagcacgtggtccgcatcacaggctgcgttattgagtgagccagtctccagatgccaggcgcatgacgagtccacggagcgggacctccctccccacgcatcccgggctcccggggcggggccgccgggcaggggggcggggagcatcctgcgtcgccttcccgggaccgccccgccccgtcgcactcagagagctgggctggagctccaagcggaaaccgcgggagccgagcccagctaggaatgcagacctcctgaaaaccaagccgaggactgcggggtccggtgtccacgcagagtgagtactgtcttccgccgctttgctccaggccgcgcgtgctcccgggtctagggcctgtgcccccggctacctgccctgcgtgtccggggcctggtccctgcagcggactccccaggctcgggacgtgcgcttttcctactatcgcgaccctggcgataccgtgcgttctgagtttaactgtgtttcttggcgactcctcctccttgtcggtaacactgttactgccccttccgccgggaaatgtatctggtgaccggacgcgtagggttacaaaacaagggatttgtgtggcccggtacaagtggcccgagacaagtggcccgagacaagtggcccaaaagaaggaaagcagcagctatgtcagtttggtttggcacctttatctctagggttggagatagatctcctcctccccagccgtgccgccaccctgtgatgacctccgttttagagcgtgagctcactctgacctttctgcgtacctgatacatgctgggtgtggcgtggcaagtgttgtaacctgtttcggttccatttcctttacacaacctgagacggttgtagaataacatcactgagggttactttgtgtctatcttttaagaatacaaagtgttttcacagagatttaactttctcttctgtatggttagggacccggcattctccacttacacacaggcagggggaagttctttattcccattgtacagcttcagaaaatgaggcagagagtttagacagcttccctaaggatcgggactttggggcctctctagttttctaggaaaccacctatgcatcagaatgacagaaatgcttaatcagcagctctggaaagttcctgctgtttcacatgtttttcagaggaaaaacctctgcattgcagggaagctcaacaaggagtggcatctactgttcaaaaggggaaagtctatttcctaatcagcactagagtttatattaatatagattgcttctttctgatgaatgtattcgacttttgtgcactgatttttcagtatctaaaaggaatattgagttgttgggaatatgctggggagggtgtgctgcttgggttctaggaggcagtataggattaaaatgaagtagtgaaatttagcaaaatcttgctgaacaaggaaaggccacacctgtagactgatggagaaggaataagccacctatagcaatgaggctgactagggatcccgtgtgtgtgcagcaaggactcctggtgtctattacgaatcagcatgctttgtagactgtgaaacagtgtttatgaagcagcacattcaagtataaatattggctgtggttcagttcagatgctttgaaagaagagtccgaatgccagagagtagttgattatatagaattagtggggagttttggttccttgattattctctggcagaattgactaagtataacatctgtactgcaatgaaaacataaaagctagtacgtaaagtaacagtttgaaagaatgaaaccagaaagaaaaagaaagcattttcttttcatttgaataacttctgaaaatcagctgagtatttatgtttctattcattgtttataatcacagttaactttaagtgatcactacttcttaggtggaaacatttactttttctcaaaatatgaactgtcttaattagtcctattcaaataaaaactccataacccatattcttctatgttcatatatatctttgtatctcctctttcattataccttataattccctcaatttggagatcatacgaatctgggatatctgttttagcattggtgtgtctaacctcataagaacatatcgcatagtttttctgatacatagaattagcaatctgcttactagaaaattacaggaggtcttcatgaacattgcatttaattttttctctatggacgctcttgacttaaaaatgtcatcttaatgtttctcaaaaggcatagtcttggcattttgggtgacaattctgaattagatagagctctttgctcgcactgaatgtcagagcgtgaccgaaagcactttcatgcatttaaatgaactttggttgggtactacatccaattttttaaaattgaataaaacatattaaaaagggctagggacggtggctcatgcctgtaatctcagcactttagaaggccaaggagggaggatcgcttgaggccaggagtttgagaccagcctgagcaacatagcaagaccctgtctctacaaaaaatttaaaaattagggcatggtggcgtgcacctatgtggccccagctacttgggaggctaaggtggaaggatcagttgagcctgggaggttaaattgtagtgagctgtgattgtgctgctgcactccagcctgacacagcgatgagactctgtgtcaaaaaaatatatatataaagaaaaaaaagaaaaaaaaagaattgagccataccattttgatggaaagccataaaaataattagtcaatgatttccaatttttaaggccactttacatctcctaagacttgatggcttctggacaaatctgtttatttgaacattgcgatttgggcagaaactgtgtaatcaatcataccgttagcaaggtgacattgttggacccatgtgctatagtactctattgtctaccctaagcaataataatggattattagaaggtgactgtaataggttctagtaaaagaatagatgagcataatctgtattagaacatagtattaatagttctaatattaatatttatattaatagttctaataatagttctaatgtggctataacacattaatagtaacagctacatttactgaaaacactatattctaagcacatacggagcccttatgtgctgtgatgataatgtagctatgacgtagaaactcctgttatgctcgttttacagattaagaaaataaaaactgccatactatattgtttttcaggacatatttaacagcttgccatgaacacttttcaaagaatgagcttcagtgcatgaaaagttatcacacactaaattcgcattttgctacagtgatttcctctctcagaatgcaaacttttactataccatgagccccttaaagacagaatcccctatagcatctacttcatgtcttccacatagtaattgctcaatatttattggattggaaaaaagattagttttatcgtaatatgaatagagccctaagatgctgttacattaatatagattattcctggttaggtagaaatgataaaataatattcatttttattctctaggatttacaagtagagtttttgaagtttaatatctctttgtgctttggctaaagattatagagtggataatcaaaaaatatatgagcaaggaacccttttttctttctttattttttccctggagtttctgcaattggccagacgtgatgctaggcatacagaggtatggcccatataacaaatataaagagcaatgtaaaaagtgttaaatggcagtgctgtcacgatactgtaaaagcggagtgaaaggttaaaggaagagggttgaggttaagcttgggagcctgtttttctgggaatatacagtagaaatatgatttctttaaaggaaatctgcaaccaggaggcaaggctaaagcagaaaatgccaacagctgcagatcctaatgactgagatgttattctggtggagcacagtcagttaaaggcaggactgcttataagtgtgaaatacatccagcctcccagtcattggcttgcctgatgcattattttcttaatctcttcttcccgtgctttcccctgagacactccagtttctgttgcacacctttgcatgtgctgttttgtggaactgagagttctggttaattctaggacattctgataagatgttcttgctactcttcccttgtagacagactggatttccatcaggtgtcagtaacatctaagattttcattttgtcctggggctctacgcagtttaactggagccgccacagctgattgggtgtgtgttgtcagtcccccaggcaagctctgagggttacatttctgctgctcatatttctgtttctttcttcaccactcaacccgaggtgcaaaagtgcaaagacaagttcatcaacaatcagaataacctgcccctgaattctttctaatgattcattttctcaatctagtttctaatttcatatttggcagctaccacctggtaaatacatctccttagctagaggaggaaaacttcacacccagtttactcaccttttgtcgttttccctggttcctgtcaaagttgttgcttggtctgttttgttgccatttgttttcctacagatccctttacaacactctgttttttaaaaaactaacatttaactttatttgaggaagatattttatatgttagaaaaaatgattttgggtctgcttttattgaatgtgttaactttagttaaccttttttttttttgagacagagtctcgctctgtttcccgggctggagtgcagtggcacaatctcggctcactgcagcctccacctcctgggttcaagcaattctcctgccttagcttcctgaattgctgggactacaggcacgtgccaccacttctggctaaattttgtatttttagtagagacggggttttgccatgttggtcaggatggtctcgatctcttgacctcatgatccaatcgaccttcacagggaaggtctctaatgaactaaaccaactgatgttcatggcccacgtttggagcctgagcaaggtcatggaccattgatatttcactcaaagttgccgtaacagattaaagcgcttagtatgcaagtattctccctgagctctataatggactgaggtcccccataccagtgacttaagagtcaaagacctagaccacacctcagggcctccagagttgccggggaaagtgtgagctatgagtgctgttcccaccaagaaatcaggagcttagcctcctgcacatactgtttccttattaactatactaacagagtggccagggaaggtagcagggaatagaatcacttatacatttttcagttacatgtgctttttccttattgtgaatgtaggaaattgtgtttatatccgatagggaaaatgaaacccttttatatgactccattactatggctaataatcatcagcgtccctgaatataaatattctcatgctaacaatatgtttaaaacagtgcctcatatgcttttagacatgcgttattttatagcattttattttaaaagttgtgtcaggtttagagaggtgagtctgcatcagggaactgaaactggtaaccagcatttttatttttcaggattcttccctttcatatgttccatctctttatttttctgtgctgcattgtgattaatggcctcagatctatcttgcagtcgcttaagtctctatgcagttatgtgtagtttatattttcacctatttttgatttggggcttttattttttcttttgtgtctttgatttttaaaatttattaaaagtccccttcagatttttctattgttttagttacttttttctttgagacagggtcttgccctgtcactcaggctggagtgcagtggcacaatcacagctcactgcagccttgaccccctgggatcaggtgatcctcctacctcagcctcccaagtagctaggaccacagttgagagccaccatgcctggctcatttttgtatttttgatagagacagggtttcatcatgtttcccaggctggtcttgaattcctgggctcaactgattcacctgcctcggcctccttcttcacctctatttctttcttcactactcaacccgaggtgcaaaagaggataaacaagttctgggattacaggtgtgagctgctgcgcccagcctgtctttaattcttgaagtaaaatttctcctatatttgtaacaatgactctcccgcatgctattttacttcctgattaggttgggaaaatgtggcttgaaattcaccttcaatgaagattgttttccatgagagtcctttttcccctatgttgtagatctgcctctaccaagtggtttttagtacgttgctgcctgtggtcattcagatttcaacagcgttaatatcttggcttggtgcttccactatacagaaataaatttggtccttgagtgcccaatggcacaagtttggaatttatttttctcatgcatatgcatttttacactcatggctccagccagaaagaaagctgccttaccattattctggacaggtgggcagttgtcaaggcttatgtttgtggatgatcagttctgagtagcttctggttttaagctagtaactcagcacagggcctgtagccaggattcctttctcatttagagaattcaattcctagttcccaactgttatatctgtttctgatatccccgtgagtcattctgtctcagccttgctcaccagaggacttagaattccctccccgttaggttacttgggaatttctcttctttaaagcttacctatctattttattttttatgttaaattttattcagtattctcatgtctggaacaaaatggagttcttttattagaacacagactaattttgttagacctgaacaatgtgtttaaaatgtttgaaagcctttaagttggggaatacatgtactagcttgtcacatgcttatcttatcatcatactggccttatgatattcatactggcctgatcttcgtaatgatctgatgatattcatatcactctacacatgttttcatttgctttttagactcctgttctacagaaatagacatatattattttctgaaaatttaattacttgaccatttgaaaattgcatcctgttttaaaaaatatcctggcagctgagctgtatacttggtgtataatgtgtgcagcattaggggttccccaatattagttccagaatatctacctataaaatgatagcaatattgggatcgatgatgtctacaacatactactatttccttgtggtgcaagaaaggacgcgggctatagagaaagtcacaagtatcaagtgttcctggggtttagggacataagactaaagaggacaagtattattgaggtacttcagggcaagcatgtatgcctttgtcccagtctttttagggaacatttaggttcttcagtaacctaggctagcaatattagcatcaaaaatcttattttaagctggctggaaggtaattttgaagagtcattttgcaaatttatcctaatatcttatgtgatcctttcttttaaccaaatgtaagtgtgaagagacagagattgtcaccaggaatagagcactaatgtacagcaatagacggtagaaaatggtggtcctttcaatgagccactacaaagccatcttgttttaaattacctaaaagtgattctccatgtctgggaattttagaattacgtgagaggcttacagctttttaggccacagacctccttccctcttcttcttgccctttttcctttgtatgtttctaagtgtctattgtcccccttcctctcccactgttctaactactgcctataaataattctcttccaggaccatttctacccgttatgtcaagaaccactgagctacagtgttaatgcttggccagttacattgcccagtggcttgacattacattcattgccagcaataattatgaacatttttagcctaaaatatttaaatagttatgaattcctgcctattctacatatagtttcaatgattagaattagagatcctgttttcccccagcaatattataaaactaaatatcttccacatgatatcttactctaaccttgagtttttaatcaattagttaattatatttacttgggattttagccctaatgggtccacatcacttaaaaaaaaaaaagtctgtcctctgctgaatattcagagtttaaaaatggaggtttaatctctcttggctgttgagtttgagccttctgttggtttcaataatcttttaattattgcagtattgtgtgctgaattattctcacagtgttattgtggcaggcctggattcttagcccagaaaattagaattgttttcttctccagcccttctgacaatcatatttttatacctgttcacaggtttccaaagattaaatgtgatcaacactgatctccatattttcaattaaaatctttgtgaaataccacttgatttccagttgaagtagtagtaaaccatattttctcaatgtatgtgtaacttctccatatcctactatatataggtcaatgaactgaaaatttgggtaccattcaacttgggaagacaaccaatataaaacaaagaaaaagttaactaagaacattctagctattgctgataatctgaaaaaaattctggaatgctctgggggcaggattcagtctagcagcacgtatatagtttagagaaactctacaggatgtagattttgaaaataaatagaaacaaataaatttaacatttattaatttattggacaactactgtgctaagtgatttacataagatttcatttattccttgtaagagttgcatattttacaactaggtaaggaggtattgacagttttataaatgaggagactgagggccaagagagttcaaataacttaccctaggtcactacaaatagcaagattctatttgattctaaaattcttttcagcagactagtcttacaaaatcctctgttcagtagtttgtatctaagtagtttaaataactgagaggggaatttgtttctaaacttaaacactggaaatcaatattgtgctcttttgttatatgcagtatcttaggactgctgaaattctaatgggtgaggtttcccacttgtctgaaagagagtattgtacactgattgggattaggagataatagtttagttggcagtttctttggacatttgatatgggcagtagagaaggaataaattagccattttggaatatggtgaaaattaatagtaaaattaaatagcacataactgaaaacacccttatcctataggaaataggacacccttaccctataggaaacttttgcttagattgaaatataagcagcagtgctcatatatttacagcagtttcaaattcaaatgaatcctactttaaaatgtgttctatctattccactgaattgttatctgatgggaaggtggaatgtaatgcagtggaatgtatcattatctgaaacaggcatggagcagtttagaaatttgctcaaggtcacacaatttagcagagctgagattcaaactcaagtggcctggctccaaagccattcttctaaccatgacacaactttttttcttttcttttcttttttgaaacaggctcttggggtcttgctctgtcacttgggctggagtgcagtggtgcaatcacgggccactgcagcctttatgtccaggctcaagtggtcttcccatctcagcctcctgagggcctgggaccacaggtgtgtgctaccatacttggctaatttgattcttttgtagagatggggtctcactatgctgcccaggctggtctctaactcctgggctcaatcaatcctcccacctgagcctcccaaagtgctgggattataggcatgagccactgtgcccagcgaccatctctttaatatttgcaaagattgatacaacactgcctctttaatatttgcaaaattaaacttgctgtcagtatacatttgtgaatttgttcttcttaggtggtttccagaataacattttatttcactccccattttcatgttggttatttgacaatcagcttggataagagaaccttgttacagttctcatgacgttggctttttaattaagaatattcttcagtgaaaggtgggctggctgccaggcccatctctcagtcctcatgtttggctctgtcttaagatatcctcatatgttcctccctactttgtgttagagacattttgagtctctcatttctgtggagattgaggcttgcagttggttttgcagcgtaagtgcacataaaagttctcatgtttttcttgctctctgttcagtttacacctaaggaatgaatgcactatggaagtagaaaggctttctggatgattgttcagcagacctcagaatttctctttttttttttttttttgagatggaggcttgctctgtcacccagctggagtgcagtggtgcaatcttggctcattgcaacctctgcctcctgagttcaagtgattctcttgtctcagccttctgagtagctgggactacaggcacgtgccaccatgcccagctaactttctgtatttttagtagagacggagtttcactgtgttagccaggatggtcacgatctcctgacctggtgatccacccacctcagcctcccgaagtgctgggattgcaggtgtgagccaccgtgcctggccagaatttctcattcttataccataatcatatcatcaataaccatatatgctttagatgagctcataatctgtcagggttgttacaggtatatgctcttgctaccaagattcctcttcatttgactggaacatggacctaaagcaaccatgcatttgaatccaaagaaaatgccacaatgtaaaataatgttgcaggttctttcctttgaggaagataagcaagattaatgtgaaatgtgtaacttctcaaattagtgctcaggctgggcatggtggctcacacctgtaatcccagcacttcggggaggctgaggtgggtggatcacctgaggtcaggagtttgagaccagcctgaccaatatggtgaaaccccatctctactaaaaatacaaaaattagctgggtgtggtggtgcacacctgtagtcccagctacttgggaggctgagaccggagaattgcttgaacccaggtggcggaggttacagtgagccaaggtcatgctactgcactccagctaggtgacagagcaatactctgtccaaaaaaacaaaaaaaacacagtggtcagcacagaattactctgtcattctgaggccaagcaaagaaactttcgaggctgttggcattcataaaataataaaaatcactgctgtctattgatgtaccatgtgccaggcaccaaatcatgcactttatatacataccctcatttaatcctcactgctagcttatgaagtaggtatctttttttatatacattaaatgaatttaaaaacctcacatttggaaggattaagcagcctgcctgtagttgtgcaaccagaattaggcctcaggtctatgggactccagagctcatgctcttaacctctgtgtttcccaattgaacatctgtccttaagcacattatttaatgcccttcactaaagtatagcatataatattagaactgcagaactacaggattctcaaggccaacagtttttacaaataaagaaaaggtgcgcaagaaagattaagagctccaagtcacatggctagtcaagtacagtcttcctcatggctcctgtagtgcctgttaacagaaattgtttgattcacaggcttatgtaaatcctcacctgtgaaaccttctctaggggagggacaagaagcagaaagtaggctgcattttctggacctgacttccctgttttgctttatcttaggcagccagagattagacatatttggaattatttcatgcatcaagagaagcaactggaatccctagagacatgaatacaacttcaggaaagaaatctgcttttctattctttgatgactgacctaggctgtgtggctagctcttctccttacttacaaaattattatcccataaaaaagcactggaaaactagagtttggaaagcaatgaaaatgaagcagttgcctcgtagaactggaagctcaacttcatgccttaaatgtggatttttttttctaagttcttggggtggtccggtatcagagctcataatcagaccctcagagaatatggccagtatccttctagcttggatttagatcacagatcagctgtgactattgtcacagttgctaggcaacgtttgtatgtttatttcgaggcctacccacatgttgcatcagaggccaaagctcatgtgctctgcactcctcagaacaagtagagctctttatttttaactaaactgtttccttgtaatgtattttatgaatgtacagcctactctgccaagctgtagttatcttcagtttctccctagtagtcccaattctctaaatttttgcattcaacttcatctaacctgttgcattctggactgaatatctctggtactttcctacccctaagtcttgtgcaagctgttttgctcacctagaatgcctgcctgatccagcctctatctacacattttgtaaaatcaagatattttgttttaatatttgatatgagggcagtcaacttgttacagcaaaaagttcatggacattattgtcatatctgtgttcaaattcaggctctgccccttcttaactgtgtaatcttagataagttatttaacttctctaagcatcacttttctcattgataaaatgcagataatgtttacctatcaagatttatgaagatatattgaaatgagatacatagagcacctgtcacagctcctggtatttggaagattctataagtccccacctccctgtagatgacactacaataagcatccaataaatagtccctgccttgtctatgaagcctttcctaaccatcttccaaaccagcacctcagaaatagtctccctcttctgaccgcctgtagcattgtattgtacctaagatcttatcacagtcaaacttgtcaaatactatgttctgagatacaagttggcactgtaactagatctgctagcacaacaccatattctgcccaaaagagatggctgaacttcattcatagatgatccattgtttatctttcatcagaatcacactttcagttatcataaacactataccttgttagatgactctattgcaggtctctttaaaagcaccattattatacttaataattaaagggattgtaagaatgtatgtcatggtgtgacagcttggcaaacaacagacatctgaatattcatttcctgaagtgaataatccatcattacagaaagaaaaatggaagcctgtattcaatagacctataaaaggtgtttaaagaatgtccatgtctttcttagaaaagccccttgtgagcagccttgttttgttgcggttgtcttacaggaagcagctcagggttttgcgtatatgtgttttatttttaagttgtacaactcctggttgatgacagtcataacgtaaatgacctaaagtttaaattgcgttattctaatcagttttctgacctctgctgtcaacagaatttctgacgatcaaataataaaactcagacaatattggttttgtgccataaaataatactcttgtgtttattcatgtacaaattcatgcatttatctcagatacttgttaagcaactactatgttaaggctccggggatggggatggggatgggtggcaactcaaacaggcctggcccctgccttcatggagttcacatttggctgttttataaatgttgtgaggaaaggattttttttcacccatgattgcctttatttcaatatttgagatgtgttattaaataagaatctgatcatggctcaggtcaaattatttgtttttctcttgtacatctagcagagctgtttgtaaaagttaaaaattagttattgatttgtcagattttttaatttagaaaatgttttgtatttgttttgcggtttgcctaaattgctctaacatttggtatctaatttgactctcacagtaaccctgtagggtgcatggtattgccatgataagaaactagatgctcagcaggcttaattgacctcccatggagtcccggccacttagcagccatccaaatggaaacttaagtcttctgatttattaagtgtgttcttgattccagcttaaaaaaaacttaaagtattaaaactgtatcttattctgtgtttaaatgagactaactgacagctagaaaatggaaacaaaaatgtgaatcaactgtgatttttgagcccctctctgctactgtataggcactgtggggagtagaaatgacctctgcctcttgataaatttatagcttcatcgataagacataatgtacacttagaaaggaactcagtaaccctccaacacagaatgcatggttcagtgttaaagtgagaaatatcaacacaagagttgagaagataataagagctaaagcagatgcaaatagtgtatcttgagctaaatcttcaagggcagggaagatgggacttgggcagggaagaggcttctaggcagggggaatggcaagttgcaaggctcagaagtggaagggagtgtgatggtgatagtgataacaataactgccatttgcccagcacttatcacttgccaagcagttattggttcacatgcattaacttatccttaaaacggctatcaaaacaattcaaccagagaagaattgttactatttcaattttacatatgaggaaactgaggcagagaggttaagcaacttgctcaaggttgcatgtgcattaaatggcagctggattccaccatggtcttgagaccagaatccactctaacccttttaacctgtgtgttatgctgcctgatgtggtgctcgtgagatggtaaggacaccttcatggttagaggggagactcaatatggggtcatgatgagagaggtcaaataatggagaatctaaaaatcaggcagaaggcattaaactttgtctaggacttattgatatttcatcagtgcggaaacatggtagacatttattttagaaagattagtcagccctagacagaaaggattgagagacaaataagggtaaggatggcaactattagatggaaactattaaaagggggtttctatccaggtatgggtgataggtgattagacctggagtagggtagcagtagaaatgagaaggatgtaatggtgataaggactggaactggcactgaatcaacaggtgagtcaaggccaggtgatttcctgagagcagcttcatggtattacccccattttacagatgaggaaatacggaggctccaagaggttaatttgggctaataagcattggagcagggatttcagcctatatctatctttcttggcttcctctctttaaggtaaaataatgcagtctggtcatatagtagagttgctgataaggtttgaagaattgctcccaaaataagagatgcttaaagtcatggggagaaatcaacattcagagggagcaataatatcagagaaaaggcagagactgactattaaagaacactggagggagggaggagggtaaggattgaaaaactacctatcaggtactgtgcttatcacctgggcgatgaaataatctgtccaccaaacccccatgacacgcagtttacctgtttaacaaacttacacatgtgcccctgaacctaaaagttaaaaaaaaaaagaatacagagaagaatggagcaagtggaagaggcttccggaagaaaacaagttagaggtatagggagggaacccagggctcctaaagccacagcagccaacaaggagagaacagtcagtgaatgactcaaagtgaaactgccaatggattgtcaagtggagaaggagggaacatgcacgcagcccagtgttcttagtaaccctcaacaaacaaagacagattcaggtgtgtgaagggcaagtagtgttgcaggtgggaggatatgggagtgctgccagtgatggggtggagaagggaaggaaggtctgtcatgaggagaaagaattctgacgcatccgatgccccactctgtgccaagttccgagccaagccagctgcggtcaaggggagagatcacggggaggctgaatggctggaggggaggcagagaggattcctgtaatccagtgggaggtgcctggcaagaggccaggaggacgtgaagggattctaatgtgtggtagacaaagaagtaaggagctgagggaatgattgttccatcagctacatgtagtggcgcaatggatgagcccgcatcctaggagcccccttcctctgcccctgcttctatagaagcccttaccttcccatcctggctcacttgccaggacctgctggggagctcagaaccctccctactcccatccagtctcacaagacagttaagtgagcctcccacctcagccttccaagtagctgggactacaggcgcgtgccaccacactcagctaatttttaaattttttgtagagacaaggtctcactacattgcccaggctggtctccaacttctggactcaagctgtcctcccatctcggcctcccgaggtgctgggatttcaggtgtgagccattgcacccatctgtacattgctttttaaataataattgttgaataggcgggtgagtggagagtaatttctattaaggaacttttctctgcttcttgttactctgacttgtgccttaattcaagtttataaatgattactaatatttgggatattaagataggtacatgggtcatttgggaggggtagtattttgatagcagcactttatactctgatttacagtattaattctttagaggtattttggtgtatatgagcactgatggttgtgctttaaaattggcagcccgttgatgttagcaggaccagccaagtggcaggcactgcagtagagggacctgggttagaagtcagatggccaagctcccaggcctggcgtacacagctcggagggtcctcgtgcagagagtgctcctttccagcctgagcgatccctccttatcctccaatcaccgcatgacaggtcacattatcagaactgcctgtctcaactatcccctgaactgctatggttccctcatctacattctcatggaaccctgtgagtttcctttgtagcaaataattgttgggagtgattatttctactaatgccatctttgactaggctatagctttcatacgggcagggacatgcctactggttttacctctgtgtccccagcacctgacacagtacctggcacagagcatattctggataaacacctgggggagccaatgaactctggtaaaatcttggacatgagattccatttttctcacctgtttaaagcctgtatattaaagcttgtattaaactttatcactaaggtgctttctctttgaagatctatggattaacccttcacaattttttattataaatgttatccacatcaatgatacgaaattcaaacaatgcaaaagagtatacaatgaaagtgtattcattcattcaccagagattacaaatattgaaagttgcttgtctttacagagagaataaaaattgaacaagctgtagccagaatcgaatggattaataatggggtgggcatattccctacttccagctcccatgaagcagctttcatatttcagttttaaaatggttagtgccttagtgagggaagaaaactttcatgcagtaatctgtgctgccaacaggggccaaggccctcagctaaattcccactacaccctgcgccattgctgattttcagctgttctgtatagagattttactgttcatgggggccctctgaaagttttctcctttctggaatttgaggatcacttcaaggtattgtttaataaagtaacaaggcaggctggacaattcaaggcaatgtgattttatggatgatttaatacatttggatgtgtggaaaatatgtctacctaaagattttcagcttcagaagcactttcacatagagtgtttggtttctgtgttggtgttgcatggttgaggggaatcattaaaggaatggaatgcagctaagtggaatttcttgagtttgaatggaaatctgtataatcaattccaattatggaaggatagaattacataaatacagggacattaagcaccataatgttttaaaatattttcaaggaaaaatatggatattcatatatttatccattaatttgatagagggaaaatctgtcttggtacatcttacagttttcagtaccaaaaagaatatgagagaggcccttccatgccctgctacagtgactggggcttcttgtatgtgtgcgtgtgtgtgtattttggtggaagggagtgtccagttggtgcctaagggttctcaggaatagttatgtttatatgattatttttgaaaaataagtatactaaagctttggatttctgtctgtaaattatgatagtttaactacaagcatcaatgtgttctgcattaactgaggtttgtggggaaggtgattttgttcatgggccatagactatagtgggtttcatacaatcaccttgagtggtagtgtattgggggtgggggaaggtaagggagaagcaggaatgggctcatgctgccctgtgactcagcctctgaagtggctctggaccaggcattagggacacagtgaggtccatcttacaggcttccttccctgggtgttgttggcagggtagcagctgtttactgacagtcagttacttaagaaggcagctcatgccagatggaatccctgggttctaaaacctaatggactttaagtgttaaggaggtttaaatgagtctgggtaggagtttgcaaagattataattatctgtttaatattaaccagtgtaatacaagttaagtactagaatagtactccaaaccatacaagtatccacacacacatcccagtacttagatgactggatcacaggggctgattgcaccactgcaagcatctcaaggaagggtgttccttgaatagttactatttatcacctcttgccttctaaggaagagcctagatgagacataatgcagtagaattccctctgtaaccttgtctccaccttctctttcttacatgacactgaacggacagttcacatccacccaagtctatttacgggagttttgtccttctatcttatgtattaggaataacacactggcaatttaatgagcatctgcaatttgccagacattttgccacactatctcaaatacgaccctgcaaatagatgttactgtactttgtatgtaaatggacctggaagacaaagctcaaagtcacagagcttgtaactgacagagctggggcttgaacaaaattttgttgagttgcaaaatccatgttttttctgaaaataacataaacagtaattataataatatttactgagcattcattatgtgccagggagtaattctaataataaacttacaaggtagttgttaactactaaagaaaaattgaggttgggaaactggagattataaaatttaagtatcttacccgagattgtttagtaaatagcagacccaaattttgaacctatttgatctggttacaaaggctttcactactggacaccacctcctactagatttttgtgctctaaactgggtaaaaccaaggtaaagggccaagggcagtatggttaagaggagctgaaggaccatgtagattgtaggttaaatagaatcgaactttctatttctttctttcctttctaggtgtcagcttcctctggtgcaaccagcaagtcttccagtatgaatcccacagaaaccaaggtatgaagaatgctaattgagtgagtgctaatttaagttgattgtgctgcaaagcaaaacaaatgtagactaattgttgatgatgagttatatatgctaggaagttttaattatggaagtaaacattttcttcctaatttatgggggtctttgaaaactcagctttccttccaatatttaccttacacatcatctacatggttttaggttatctagaaaagtagagtcacctagagttgttttgttttgttttgttttgttttgagacagggtcttgctctgtcacctaggctggagtatagtggtgtgattacactcactgcagccccaacctcctggactcaagcgaccctcccatctcggcctcttgagtagctggggctacagaggcacaccaccatgcccggctaattgtttttttgtttgtttgtttgtttgtttgtttttgtagagacagggtctcactgtgttgcccaagctggtctcaaattcctgggccgaagcagtccttccacctgggcctcccaaagtgctgggattacaggaatgagccaccgtgcccgtggccagttttgtttttgtttttgatcctagatttgattgagttttttaattgaagatattcctctaagtacatttctctacattgaaatgagaatataaattattaattcttgctaaaatggtcttactattctgagcacttaaaaataaatataaaaatgaaagattatactaaatgaacataaaaatatactggttatttcggatgctttcccaagttgttttttctgaaatttgagtcttgtggggtaccattttattgacaaacctttcttgagctctatttgggatttattcttaaaattatttttttgaatttcagaattaaaaataaaagaatttcctctagtggtattgtccactttgttctgaagagctggctgcagctgccttttaaaccctctccctaagttactctagctcaagctgtatctcttgggaatatttcaggggagggaattaaagagggagcattttcaaaattctctcaactaatgtttgtgtgccaatattctttaatacctttaagagctaccccaactccattattattaaattgcccttgtttaaaattaccaacctacttttgttttctgtctttcatattactatgctatccctgtagtttcctatcccaggtgatgtggcactataacttagtactatcaaaggattatatggcctcatcttgaatcatcttcaaagaacattacaaatatctagaaatacactatccacatctaagttcttatgtcatttagcattcatttaaaattttaatctaaaattatcagtttttaaatttagtatttaaatttacattgatttctaaattgctttcaaaatatacattatataatctataattaatgttagctgtctctatttaattatgttaagcttaatcttaaaaaattaaaaatctttttttttccttgaggcagggtctcgctctgtcttccaggctggatgtagtggcatgatcacagcttgctgccaccttgacctcctggatgcaagtgatcctcctacctcagtctcctgagtagctggaactctaggggcacaccaccatgcctggctaatatttctgtttttctgtagagacaggggtcttgctatgttactcaggctggtctcaaactcctgggctcaagcagtcctcccatctcagcctcccaaagtgctgggattacaggcatgagccactgtgtccagcctaaaattaaaaatcctaattttaaaaaatattccagaagcatctacaaaataaaagttctcattaagaccaggcatagtggcccacacctataatcccagcattttgagaggtcaaggtgggaggatcgcttgagcccaggagtttgggaccagcctgggcaacatagcgagatcccgtgtctacaaaaaattagccaggtgtggtggtttactcctgtagtctcagctactcgggaggctgaggcaggaggatggcttgagcccaggagatcaaggctgcagcaagctgtgattgcaccactgcactccagcccaggtgacagagcaagaccctgtctcaaaaataaataaataaataaataaataaataatctcattgaatttagagatcatgaaaaccaaagaaaagagataggaaagagagccagaaatataggatttcctttttattcttttggttctttttcatcctgttgcctgattctaatcccctgtgcctcagctcaaggaccaatgtttatttcaagcgtggcctgttacctagaacaaatgtcagcaaactcttcacccttctctaagcattaatcatgagaattctcggcagtcctgtgaaactggaggaaagtaggagagagaagagggggagagacaaaaataagatgcacgtaatgaagtgtccccagtggctaactagggaccacttttggcctcaagtctctttccctggaacctggttccatatcagctgtgatattggacaatctctttttgctttggtttccttatctgtacagtttggaggaaggtgataatagtacctgcctcacaagactgtgtaaggaaacataatgtatattggacaattcctgtcctaagcaagtgtccagatgggattgtctgttggccactactggggagagagtgcagtgcgatgactagaacacacaacctcaggtccaccatggatgtctttagggagttatttaactgctctaaactcaatttctcatctgtgaaatgggtataataatacttgtctcataggattattatgaagataaagtgggttgacacatgagaggtgattaatacacattagttattatggtcatcattattatattcagcacaatcactacaaaaataaattcagcaattactgatttaaatatagattgcattataagctgcttgtgtctgtgagcatacattcttaattgtagtgtaggttctcccatgcaaaatcttgattgccaaattgcaagctattaatagattcaaagcactatactaccagctggcttattttccttgttaatcatttaataaattatatttgcataaactgaaaggatagttccataaatagaaactcattaatgagaatgtagtgtgaaaggatccaaaatttaaaatttctttaaaaacatttcaatcataagctttgtttccttcccaaaatagtgtgttagcctagcaaggggccattatttgaagaaagtatgtgtcttcattactgaagtagaagacatgataaattaagaggataattgactttagcctcttcaaataaaaataaataaataaaaaccactagtttgtgctgatactaccaagcagataaaaaggaaagaaacagcaggaagcatcggaccctagtttgtaatctctgactgaaaagttcatgaaatgtttaatcaagttttattcatgattgtatatcttgcctatattgagaatgcatgcatgtacttacttgtttttgcacaagtaatgtttagttggataaaactgtaaaatatcatactaaagatgctaagttacaaccagttctgtagaagcatttctagaactttaaattcgatctctgcatacaggactgtgatgtgcccagtaaaaatccatgcactaaatatttacaattttggggggattatgttgacagaatttcataaaactttccgttacatctgtgactatttgatcataactaaacattggatacataggaaaaaatgatattcatgtagtctttacacagggaaaggaaaggaatgagaaattaattttattaatggaaaccttcgctgaaaaaaaccttcactgaaaaaatgtaaacacaaactgaaatatctgcttaggaccttagaatgtaagtgcctacagcttcttggagttatacacatatgcatcgagtagatgcaatagatgaatagaattgatataatcattttaaccctttttgtacatgttacttatttgactgacagataaaataaaattatacctggggctgtgctcttatattaggccattccagtcagccaacagatggaaggaccacatcttcctaacaagaaaaaacacaaaaaacaggtgatgttgttcattgtactagggcatctctgtttactaacggttacatcacccgctcagcatgtgctaataactgcaattcacagtcttctgttaacactgagatcccatcatggactttctgtaggcttagctgcccatcagccacattctggcactaaaagtaattttcactgctttctgtgccctcaattctgtcaccatcccattgttttacactgtcagccaaaacccgtgatgaatatttcactgataaaaacaccgtgttagtggcatggaaacacagtgcccttggctttgtgatgaaggtttttattttctgttgcccatttatgtgttaccatgtaaatagtaataaatctttacatatctttgatatacctagcaaggagatataaattgctccctgaatagtaaagcagaatattaactagtatacctaattgtttatctaaagagttgcaatttcaagcaaagtgtaacaaacttaactgataatgtttataattacattaaaaatcatctcttttgagtttcctcagttgaagaaaatctgtgatagtctttgtaaactatgtctatctttcttttcttccttcctttttttctttctttttttctgaacttaggctgtaaaaacagaacctgagaagaagtcacagtcaaccaaggtaaatagtttaagtctgttagttagttatttggattctttttaataataatgaataatcaacttcctgccttggcacagctgtgaatggtaaagggggttgctggctaatttaattaatttttagacccttttgaatggctgtgtacatgtagaatatataaaatataacattaagtccgtatattgttaaaaagaatatataatattttataaatgaaaactatttcagaagcattttgttcaaatctagttttttgttatatgtatagtgattgctttaaaaaagaaaaaagcaagaggaacagaagaaaaaaggcaaagagtagtaatgaatatccaattccaattccaatgagacatcaagaataaggtgtctgctgaactcagcacctagatggcttagggatgagaatctttcctaagaggctggctgggtttatcgtgacagtcttacctcagttggtggagctagttaacagttacacaggaggctagcttctgttactttcctgacccatgactgtccagaatgaatgccattctgcctctgcatggaggtgaaccccaggttgtgtacggcagcacaaatgtttctcttcaataaggtgctgcattttattttgtcaagcacttaaagcaagtactaagacaagaccacaaggtttcctgtggaaaagcacagatatttgagcccaggtacttcaggcacaggtgagggtgaaaggtgaggcttgtctgattttgtggaaggcctcctggtggcccctggggatggtagaacatagggtactccgagtgaagaattcagcagctaagtggaagttgtcttctattccactttaaatacttttatctactgaatcgcaagaaaattgggtttctggtggtaagatcttctctactaacaaagaaacaaaactctgtaaatcctatgaaaggagtttttttttttttttgcttttgagacggagtctcgctctgtcgcccaggctggagtgcagtggcgccatcttggctcactgcaagctccgcctcccgggttcacgccattctccttcctccgcctcccgagtagctgggactacaggcacccgccaccaagcctggctcatttttttgtatttttagtagagacggggtttcactgtgttagccaggatggtcttgatctcctgaccttgtgatacgcccgcctcggcctcccaaagtgctgggattacaggcgtgagccaccgcgcctggcctaaaatatattttctagagtgggattagctgtcaacaaactcagtagtcacatggctcatgtgttatctgtgtacatttgtgaaaaacaaccagtaatttagagacatacgtgtatttgaaaatattattcagatgaaatactgaatttttcattattctgataatcaccattctcagagactgctgacagggttactattgacctgataccacatgtctacttctgtgatcctaaagagtgggcctgagtgggcctaagcgggcttttcctgaaaaaggcagaatgttttagttggaattttgttcttgttcttgtttgaaagtattacaagttggattccagtgtaatcaagtttaatcttttgaaattgacagctgtctgtggttcatgagaaaaaatcccaagaaggaaagccaaaagaacacacagaggtaaatgattatcatcaggacttaattataaggcaacctcttttggtgggatataattaaaatctttcattaattcaaaactaatccctacaatggatagttggatattagttttttcagctaaaatggtgccatcctgtggcaatagcagtgtttacaatttatgtgattcttgctgaattttgggggaaggatttgcactatttcaaattttgtacctaaagtgaaattgtcacatgtacatcacactaattgaaatttacataatttagaaccacagacagcacaactgttatgaacaatttttattctatagagaaaagtatcagtattatgtttaagactaccatcttgttaacaatgtctttatatgtgtgtgggcacctgtgtgtgtactttcagccaaaaagcctacccaagcaggcatcagatacaggaagtaacgatgctcacaataaaaaagcagtttccagatcagctgaacagcagccatcagagaaatcaacagaaccaaaggtaaatgaagcagattgataggaaaaccttaacatcaactggataataagatacggttcccctgttcacactgaggtgtgtagttcaatctatggggctgtgctgaatatattttgtattatagtgatttggtattattattttgttggtttttcaaatagacttgtaggaacttggatgcatggatggcttgagaagggcatcagattggtctaggggatgcgctgtccgtccttctcctactgcccagcaataaccagctgtgactgcagggcagcaggctctgctgtctcccagacaggcagctttggattgaggctgcctcctggaccccccacacctgggctggggaacatatgtgccctgaattatctggttctttaaatggaaatcctaaagcatttttagggtcgtgttgtagaagagctgaacttacagagccaaaaattagaaattgcttccatacttctgtagttaatagcagccaccttttagaagaattaacatctacaagaaatactttttcattgagagcacttggaagataataacgaggtctgcttcacagtatattttatatcagagatcacagatttgtgatctaccacttaaatgccacatgtatattttgtttggcttacaatgttgttaaaaaattatttttaattaattgccagcaatcaaagtcagggcatttcacataacatcccaaattgtaacttctcttgaaaaatcagactatctagtaagagtgagctcacgtggcaacaattgactagagccattacacctggtatgtgtgctccagtttaccacaatccttacctagcctgattgacctacgcaagttacctgcgtgaacgttttaggctcttgagtccagctttatgtggtgcttagcactgcaccatgtacaatagaagtgagcaaacattcccttatggtgtccgtgagggtgaactggcagatgttagtgacatttgaaactcatgatcttgataatagccatgcagagatacttagctctgtcaaccttttatcctcactgtcttagactaaaccacaagacatgatttctgctggtggagagagtgttgctggtatcactgcaatatctggcaagccgggtgacaaggtgagcacacacaagcagacggaaacgtgggcctctgtgcttctcaagtttcttttatgagaaacgtatgctcaaataacctatcatctggcaaaactgaacactgcttatatgtaaaattttgtgaagagcatgcatttaagggatagagagtgaacaagataccaaaaataatttgtaaatttatatattcaataactgcttactgagtacatgccatatataacgtactgatatcaataccaaggacattaaaatgtgagttgactcagactctcccttccaaatgtatagatatgaaataaagcaaatacaatttccaggagcatttgaatcggctttttcagctttcaatgctgatgccagctgtcttgatactagtgtatcacaactatgacatcaacatgaatggatatgagaagttttcaaaggaaatatttcaagtcctctcaggatgaagtagatgtgttgagctgggtgattgtgggcataacttccttagattttttgaagagctgcttccaatacttgcccaggaatataagatgagaagttatctaccttttctacccatagcaatatagaatttttttttttaccttatcctttaaggtttttttttttttttttgcatttatttatttatttattttcattatactttaagttttagggtacatgtgcacattgtgcaggttagttacatatgtatacatgtgccatgctggtgcgctgcacccactaactcgtcatctagcattaggtatatctcccaatgctatccctcccccctctccccacccctccacagtcccccgagtgtgatattccccttcctgtgtccatgtgatctcattgttcaattcccacgtatgagtgagaatatgcggtgtttggtttttcgttcttgcgatagtttactgagaatgatgatttccaatttcatccatgtccctacaaaggacatgaactcatcattttttatggctgcatagtattccatggtgtatatgtgccacattttcttaatccactctgtcattgttggacatttgggttggttcgaagtctttgctattgtgaataatgccgcagtaaacatacttgtgcatgtgtctttatagcagcatgatttatagtccttttggtatatacccagtaatgggatggctaggtcaaatggtatttctagttctagatccctgaggaatcgccacactgacttccacaagggttgaactagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaagcaatatagaattagtaatcagtttggagagcatgtaatcaatttgaagccacaagtaagcaagtgaaggaacaatgagaagatgggaatgaaaaatgtaaaagtaatatagatttatctatacttttgcttctgtaaatgggacagatatcctgctacagctaaatggtaaagaaggtcatagggaaaatgagttttagggtaaaagtatggcacatctccctgaaacatcatttttttccttctgggattttgggagaaaaggcacattattttatccaaattaatacaggtctcctatggagcaaaggcaacatttacaaaaacttttaaatgaaaatatcaaacttaaaattgttttttcttgcaatagatcacttgtatactaccttgagactcatagcctcactccaggaagacacagcactctcttgcaccaatgaggaatgcttacatgaaatggtttgaaaatggatacatttaaggcagaagattagatacgttaaaatagatttttaaatgtaatcaatgttttcagtttggaaatggatagatttaaggcagaggattaggcccgctaaaatagatttttaaatgtaatcaaaatttacagttttgagctaaatgtaaattaaccagtgttataagtgaaaactaaacaataaaattaggagaggcttatgtggaagtctgccgtgcattgacttgtgctggaacttgcagcaagtcattttactttacgttgcctctgattcttctcccattaaataggatttaatgacttgccttcttattttagtacatagcatgtttaaagtaccataaggcaggcagatcacctgaggtcaggagctcaagaccagcctgaccaacatggagaaaccccgtctctactaaaaataaaaaattagctgggcatggtggcacaggcctgtaatcccagctactcaagaggctgaggcaggagaattgcttgaacccgggaggcagaggttgcggtgagccaagatcgcaccgttgcactccagcctgggcaacaagagtgaaacactgtctcaaaaaaataaaataaaaaactaaataaggtaccatggttggttctgcaggatgcactagctataggctggcctgtctagggggtggggaaaagacaatgtacctggggctgtatttcaatcagatgaagaaaggcccccacaaggtgttatttggtgaggaatgaagggattctatctaattcagggaatccacaagagctttggaagagtagatccaagttcagttaggcatggaaggatagctgggattgcaggtgttgaaaagtgtaagatgtgttctgggcacaaagtacattccaacgtgggtgaagcacagaggaagtgaatggtggggctgtaagaccagaaagacaggttgagcactgctgtggagaaccctaaggtgaatttgtacatgtggtgattcagctgacagcgggtagcctttgagaacctgagagaacagatggggtgatgcaattgaatccgagctgcagaaggattaagggactgcagttaggtggatgggatagagataggaaggtagaaggttggtcagggactgtttcagtagtcctgatgagtcatattttagcctaaattagagctgtgatagaataagaaagtggggagttatccaagatgaattgcagagcaaaaatcttcaggttttaggaaatgattgacagaagtgggcaaagacaaagtaaaatctaagataacctggtgcttctgagtctgattgcaggaggttggtagccacacggtaagggaaaggaggcccctaaggtgctcattgtcaggtttgtgcaagtgcagagttggcacctgagaatgagtgcctttttaaattgtgagctgggcaccttgcagtccagtccctaagttccctgggtaccattggcaggagtacagatagatgtcagaggaactgaggaggaaagaggtgtctctaattttggacaagctgaatttaagtgtttgaagtgtccaaagaaatatgtctagcaagacaattaaaatactgttttctaatagaaaagaatgaagtaggaggaaagggagaggaagagaaagagtggatggaatagaaagatagtggggagagagggaggggaagagagacattgagaaggaagaggaaggtgggggagagaacatgagtgaatatctgcatgaggtagtggctgaatcatggaagtggtttcaattatccagactcaggctcacaccctagtggcccccacagtgtttctagcattgcaattgtaacagtcacttatttagcacttacaattacatagcaagtacttacatagtgctgagcatgtgccaaacaatggttttcatacttcgtatagattcacttatctaatatctccaaggagaagtgacttgctaaagcctcaagcagccatgcatgtctcaactgttatgcaaaccttggcagtcagagcctgtgctcttcctgtgctttgttccctgagtttggataccttcaaatgggaaatggtccccttttatcttaaacccaacaacttcacccatttagtttctgccagtctctgaaagcatttgcctctggccatagagaatgattttggataagaccaccagcacagggcagaaatgtgcagagtgtatacagtggggaccaaagtaaaagagatgccagaggtaatggagaacaaagggcatagatgccacaataggatcagaatggtgccgaaaggtggcaatggggagggagagatgctccaagggtcaaatttcagagattacatctggataaaagcatggaaactgcagattgaaaagttgtttgcagtctttgatagagcaatggaagcaatgatgagcgatcaactcattttaaggaaagaggaggtgttgagatgccgaagtgagggatatggaagtcttgatgtgtgggggcaaagagccagagagcaaagccagaagtggcagcctatagaaagaattcatggatgttgtaaaaactggctgtgggccctggagaagaacagcgaggaaagaaacagtcttggattcaaatcttcattctgtcccttactgtgtaacctgaggaaagtggcctaatctgagccttgctttgcccatcactaaatgagactaatataattaaagcccttctgaaaaaggatataaaacacacagcacagtttctgctgtagagcggatgttcagtgtatgatcaatgcttgttaatataatgaatttattttaaaatttgtaatagtattgagttttattaaggtatgtgaggagttgttaatttctcaattctcaccagaaaaaagaaaagaaatcattaaccccagctgtgccagttgaatctaaaccggataaaccatcgggaaaggtatgaagacaacagtgtccttctacatgagacagttactcatatgctctgtatttatcataatctgatttcttgtgggcaaataatatgaggggggtaatttaaaggaccattttaatgaattattgtttcaagctaatattgaaagtgtgggttggaagtatggttttcacactcatgtttgtaacacttgctattataaccccttttttaaaaaaaaacaaacaaactccagtttcatcccatggagtttacattccagtttctctcctgcaaatacactttatttaaccagaggtattactaaagaagtaaggtacttctttttttctgaaattcctaaaagaatcagtgtaagcctaacagccttcagattgtatttcacatatccatgatcaggagagtcctaaaattgtcatgggaatatggtagttgcaaaaaaaaaagacaatttaaataattatttttcatctaaatcaaataatacaaggtcctttcctagattgttgttttctcctttcaatgcaggttattgttcataacgagtcatcaacataaaaaatagatagaagcactcttatttattattatattagtccatgtttacactgttataaagaacttccctgagactgggtaatttataaagaaaagaggtttaattgactcacatttctgtgtggctggggaggcctcaggaaacttacaatcatgctggaaagggaatcagacactttcttcacaaggcagcaggagagagagcatgtgaaggaggaacagtcaaacacttataaaaccatccaatctcatgagaactcactcactatcatgagaacagcatgaaaatcgccccaatgatccagtcacctcccttcctcgacacgtggggattataggtccctcccttgacacatggggattacaattggagttgagacttgggtggagacatgagccaaaccatatcagttatactgatttaagcccatattggcagagtaaacttgtgagttcttgtaagtttaatgtctcaggtaatttctgttttgtaaacctcttcaggcaagcaagtgaacaacaacaaaaaaaaacatgaatgaaataatacagagtgatttccctcatgaaatagattctatttggaataggtactatatagagatttttaggggttctttgtttaaaactctggaaaagtattgataagcaataaataccaagcatttcccttatcgcttagagcaacatggttataattccctgtattttgttttgttttgttttgtttttccttttttaactgtcagtgcatcggactggcagctttaatgaacttgtacatttgttcatgtatgtaatgcctgtagacttgttgaaactgtgcttcttgcctgaatgtggcttttcatctttccaacctagaatttgtactttgagacttaaatagtaaagtctgttaaagaccagattttaactattttggggaactatttgaagaacttttggtgtttggtggtttttctacacagaatggctttttttgtagttaaactaaaggtgaaatatgtataacaaataacatttaaatatctgttctttcttttccagtcaggcatggatgctgctttggatgacttaatagatactttaggaggacctgaagaaactgaagaagaaaatacaacgtatactggaccagaagtttcagtatgtgatcatgatatctgtaaaaattcatactcagtgggtaggagagcaaataaggccatggtcatgaagtacaaaagaatacctagtgaggccaggcgcagtggctcacatctgtaatcccagcactttgggaggccgaggcaggcagatttcttgaagtcaggcattcaagaccagcctggccaacatggtgaaaccctgtccttactaaaaatacaaaaattagctgggcatggtggtacacgcctgtaatcccagctacttgggaagctgaggcaggagaatcacttgaacccaggaggcagaggttgcagcgagctgagatcgcaccactgcactccagtttgggcgacagagcgagactccatctcaaaaaaaagagtatctagtgttctgtcatttgcatagaaacaggatgatgtcagtatcaacatcaacacagcaactaaaaattagtatcggggatggaaattgtcttttggcagctgcattataacattgagttagcaaacatttgttgttgtgctaagattgacactgggacacggtccactgggtcacacacttattttccatcctcaagatttaagtataatggactagaacttgttttgatttctcgatatttaccaccctcagtttatccctattcctaattcctaaaattatattttccttggtattaaaaaaaagacatgccagccaggcatggtggctcacacctgtaatcccagcactttgggaggccgaggcaggcggatcatctgaggtcaggagttcaagaccagcctagccaacatggtgaaaccctgtctctactaaaaatacaaaaaaattagtcaggaatgttggcgcatggctgtaatcccagctactcaggaggctgaggcaggagaactgcttgaacccgggaggcagtggttgcagttagctgggatcatgccattgcactccagcctgggcaacatggatgagactccatctcaaaaaaaaaaaaaaaaagacacgccataggctagacaaaaatatttgcaacagacataacaaagggtttgtttctagaatttataaagaataaaaaacagaaaaagacaacccaatagaaaatcgagagaaaacttgactgaccaataagcaagtaaaatgaaactctccttagtaattaggataatgatactaaaacacagaagaaacactgctttgcatttatcagattagcaaaagcgtgaaagtctgacaattcctatagttttcctatagctggtgggtgttcatgatgaacattcccttcaaccaggaagtccacctgtagagagattgccaggagggagccttgcccatgtgtgcaaggagttataagaactggtgaaatgtttggaaacaattttgttcaatagaggacaggataataaaattcagtgctttatagtggttaaaatggattattcatgtatcaacatggatacattacaaaaacataattttgaataaaaaatgcagaatgatatgtagaatatgataccatttatataacattggaaaatatgcaaagtaatgctggacgttgtttatggttacctacatatgtaaaaaatgttctaaaataactttaaattgatatgctaaagttcagaatggtggctatttctgattaacagggaaagggaattaggtttgagaatgctaaacaggagacatccactctatgattttgttttcttagaaatgacaaagctgatagagttgggtattgggttatacataaactcattatcttattaactgctcttttgtattggttagaaaccttagataatgaaaacatttgaaaacaaaatgtatttagaagtcaactttagtattttgaatattttctagcattacatatgagttaagccaattaaatatgggtatttgtgtaaacttagaaatgtagttgtataaagtgttggcttcttaatgatttatcgttcatctcagtacttccataaattaataatggaatagtgctttagtttcagaatatgcatatagcattgtcaggtaattaattatataatatccctatgtgtatgattttgttccaggatccaatgagttccacctacatagaggaattgggtaaaagagaagtcacaattcctccaaaatatagggaactattggctgtaagttaaataatcatttacttttatttcactgtttcctctttagaaaataatttcatgtcaatatttttacagtgtttagaagttagaaaatataatggtgcttgtgaaattgtcattactatgaagctcgctgcattggttggctggggctgctgttaagaaagtaccacagatcggggcataaacaagagattgattgtctcacagttctggaggctggaagtctagaatcaaggtgtcagcagtgctggttccttctgagggctgtgagggaaaggtatctttgaggcctattcttggcttatagatggccgtcttcttcccgtgtctctacacaccgtcttccttctgtgcttctatgcatatctctgggtccaaatttcccctttttataaggacgcgcatcatattggagtagggcccaccctaatgacctcacctttacttgattctataaggaacctatctcaaaatcaggtctcgttttgaggtactggggttaagacttgaacatatagatctggggtgggaggcacaattcaacccacaacgggcaatacattttgccgatcttaaggattaattctaccttctcaacatcatcaaattaatatttgtttcagaaaaaggaagggatcacagggcctcctgcagactcttcggtgagtttacatacatgtcttctgatctaaattaatagttttatatttttggctgggggaacagggctatcaattctatatttgaggattatgacttaactcatctccaaatcaaatggagtttctgtgtgttcagagaaaggggttggtgggagggttgtctcagtgctcctgagtctcataagtaggttttttgagggaaaggagaaagaaggcgagaaagtattaggatagaatattatgcatgttcataataatagaatgagaatgtaactccttttgaaagggggaagtggaaaataatactcaatgagtagccactctcttcaaaacatacactttgatctaagttgtttcattaacacacctcatttggtagcaagggaattggaaaagtgcattcttcatttgctaggtttatgatccattcttccacttgagtgcttcccgtaagttacccatcactgtgcctgtttctttagaaacccatagggccagatgatgctatagacgccttgtcatctgacttcacctgtgggtcgcctacagctgctggaaagaaaactgaaaaagaggtattgtttttagtgttgttaagggaaacttgttaggaactattttgaactttaaaagaataactttttagttcaggctattacagttaaactttcctcatctgtaagtctaatcttttgtattttgtttttcaggaatctacagaagttttaaaagctcagtcagcagggacagtcagaagtgctgctccaccccaagagaagaaaagaaaggtggagaaggtatagtcacagtctacctgacagcagttgctttccagagcctgatctagctcattcaggaaactgccagtagcacataacccatgatgagaagccatgattttttccctctcaggtctatgtggaatagtgaagccaatgagggttatgttgatcatctccaggcaagccttgtgtgtttctgtaactgcttgtgaatgattttagcacagttgtctcagtcatcatctaagaccatctcaccattatgatacacagaagggcagaaaccagagaaattgcactcttggaacataaaaccttcaagtttgattgtataaaggactttgagccctgaggatcactagagggacaccaagtagctggtactgcccagcattctcaactatatttcactatgacataattctcacaaatcgcaaaaggcaatcctgcagctctgtgctggctgggaacacatgtctcctctgcaaacagtcaagataatgctcaggaacggtttctatcagagcagcttgtgcctctcccctcctggagtggacagtttatttttatctggcaggctggggaacagtggtgagtaccacacccctgagagtgggagttcctacaacgatcagccattgtgccttcagagaagaaggcagcaggggccacttcaagcttccctgcttcctaagcttaggttgtcagaagcctttttagagatacatttttagaaaaagaaaaatagtgtggtaacagtttactacttgcttcttttttttttgtttgtttagagtattttatagtaatattactatagctttatgtctagcttaccaaataaggggtgaagtgtgccccagagaacgctgttactgtagaaacgtgtcttagccccaatttccactcattggtaagttctttttcctttctctcttttgcaaggtttcaaataaaattgcctttctagagcacttccccaatccatattcagtttataatctaaaatgtattttacaaagaagtaaatggattgttcgggctccagagatgtcttttttcatgcacaggattttttacttttaacaggatacaatgagtgatcaagcactcgaggctctgtcggcttcactgggcacccggcaagcagaacctgagctcgacctccgctcaattaaggaagtcgatgaggtactgaccttagagttgatttacaaagcttgttagtctgcacattacaaaaccgaatgcactctgcatgtttagaattctcgcacaacttttattggagagtaaaagtgagcattcttcattgtgccttatttattgctgagtggttagcaactaagggggatagttacatgactgacttgtgaaacagctagaattttaacatttgaaatgaacacgaatctcccttgctagagcttaaatgacccttgactaaacaaggtaacaaggaggcaatgcctggtgggaaatagtgaagtttggcaattggaaatttgtattttcagaagggttctgggtgcttctgtttataagagaaggagatgtctatacacggagtgggaagatccttcatttatcactatggggaaagatgttgaaaattttgtctcaaattaaaatcaagcaacaattaccctaactagagctcctgcatatttatagaataatgctgatgagtgtttatcccgccacactccaagatcttaacaagccttctgaaccaaaacaagcttacatctggtgtacgaaagttttaatattaaattataatttttgtggaatttttcaactcagtcctctggggtgaaagaggaaggaaaggagagagttgccggttcctgacaaggcagtgttgtggggagatggaaaggtagcctgggatccccaggagcccgccccacctccatcagctcaggctgggggtgctggcaggcattgctgtcacaatgccccatctctgctgtcacttcctgttctgagtcatcagggaaggggagtctccctgacttccagcaacaatccttgagtctgggactgccctggcctaagatgggccagtttctatcttcgactttcttggagggctcaccggccacagtgtggcacgataagctttgtgacggtgaacgcagaggagcaagagaagcagttcgtatcttccaggaccaagtaatgtattgggaagaagggaaacttgattacaacacaatgtgagatatacattacttagagtagccgacagaagcagtgtcatcttgaggaaagcggggtgttggcagaatcctggggggagtcaggaggccaagctgagttgtggctttaccacctgagggcgacagggccacaagtatattgcacttctgccccaagcttcttacagacacttaaggagagacaattaatgtgggaagggagggtataaacatgtcataaacctcaggatcaaaggagtcttaaaagtgactaaaagcagataagcagatgttaagaaaaaaagtgacataaaataagttatttaaacatgtgggtaactagtttgggaatgcatatgaatgtattaagttccctctagaaaacttcagagtcgcagcaaactaaaattccagcaaaaagaactcctcttttccactcttatgacataatagttgtattagtctgttctcatgctgctaataaagacataccagagactgggtaatgtataaaggaaagaagtttaattgactcacagttcctcatggctagggaggcctcataattacggtggaaagtgaatgaggagcaaagtcacgtcttacatggaggaaagtaaaagagcatgtgcaggggaactcccctttataaaaccatcagatctagtgagaattattcactatcatgagaacagtacaggagagctccgcccccatgattcaattacctcccactgggtccctcccacgacacgtgggaattatgggagctacaattcaagatgagatttgggtggggacacagccaaagcatatcactagttttcctttttaatcatatacaaagtatgaatgtttctaaagaggatctttcagtcctctagattattaacctgaattcttagtacccgacttagtgggtcctttacatcctagatagtctgatgtgatgagaaggctcaggaaggtcactgtcagcctgtaggagtgtccactgccaccccagcataccccagaatagagagctatctgtggaaaaccacacaatactccagagaggaaacccatgcctacttggtattcccatcatctaccataacataaaataaaagttttttattctctaatgatagcccattataagtctcccacatttttaggtgtggctgcctagtctagtgccatttcaattcagtaggctcttttttttcgatgcctactgtatacaaaccagagcaggcatttcaagactataaagatcaaagaggaaaataaaagctctggccgcatgtgtaactttcactgtccacagcctgagattagtggggaggaccgtcttaatacaggtgaccctggatgttcatgaaggccgctgtgccttgacctggggagtgctgctccatgacaggatttctccagatgccgaaatagagcgtgactggaaatgtttaaaagaaaaccatgacttcatcctttaatgagagcttctctataaaacagtgaaactaatcccaaagcatagaacagtgcctggtccattaaaagtgctcaataagtagtaattaatcaactaaccaatcagtgggtttagttacatttaatgtttaaatgttttcatttgttttgttttttatatttcctgtaaaacatgaccagctgactttctctattattgtgcgtatcctgtttaaatgttactaattacaattgtttaagaaccacactcttaggctaagatgcagatgggggccgtgggttgggttggaatatgccaagtgaacctcctaccttggttagtaaattaaatccacacctttatataggtacaaattcttacatattatggaacttcacactacccaccagcaggttaaattgcaagtgttgtgtcctagcagtcagtgatctactatagaactatgcttttatttgtaatgcagctagttgttcatggttcagtaagctagagaagtcctggcattattgaagagagtccttttaaaagaggtaaaacaagttatccatggatcagccaagatttgtgatgggccgcttctcccatatctgaactgggtttaatgtgaaaattagtcgtgtttcctctcccttccttagacagctgcctcgttgagtaagacagatgaaggccattaaaataattgcaactaactgctgcactgtgcttactgtcttcaaaggatcttttatttacttttctctggtgatcttcacaagtcagtgagctagataagggttattagtagccacattttacagctgaagaaactggaccaaataaaggctaagtggcttcccaaggtcacagcagctgggagcagaacagggcagttgcccaggatccctggctgggctacttttgctcagtcacccactgctccctttctcacagctgcccaccatcgtcttgtgctttgtagtttacaaggctcttccagatgcttttaccagatttggtcttctctataacactcgagaagtacacagaggaagtgatatcatctcattatgtgcattatccaactactttttttttcccctccattttcatcaggcaaaagctaaagaagaaaaactagagaagtgtggtgaggatgatgaaacaatcccatctgagtacagattaaaaccagccacggtaaatttttagccacagtgcatgacaacagcatcttgcctttgcatcttgttttgttgtatctgtacccttgacattgtcaaaggacatgtctgtcccccattcagatattaactctgaaaaccctgaacctttttttctctgctccctacagttagaccccttgagggatggtttgtccctgcctggcttcctaagtagtgaccatgtgttcatttaaattcccacagatttaaatgtttcgtttattaacagttcttacaatagatcccaaaactcagaaggaacaatttggggataatttcttttctaactgctatatggataaaagcaccataggtcttctgaggggtagatatgaatgcacgagggtttaccagtatcctaagtgaaggtggttttgttgctgttgtttttgattatggtgaggatggtagactaactcctgtcattacatttgtcatttacttttgaaatcatgcatataaacacatgttggaatatagttacaattctaagttatgaaacctcatatccaaaaaaactaaacagtgttataggaatgatatccacctcttcactctaggttggagaattggggttttttaaaagcttcgattaacatagctacatctttattgccaaagaacttttttttcctattactctacccaacagattaaaaacatttttaataacttaaagtaaatgtgcattctgcttggtaacatctcgatttttatagctcaactcctttttttatactttataaaaagtaaatctgaaacacaaactcatgtaaatctaagaaaaaaattagctgacatttcatatcctggaattcccagaaacaaacttgatgggacatgaaagcaaaattttctatttcatttccaatgaattttaatttcatttacaggataaagatggaaaaccactattgccagagcctgaagaaaaacccaaggttaggaaatacatttttttctgatacttaaagaacaatagacatgtaaagtatgaattaagataattttgacagtctggaattcactgtgcagacttgcatgctaacctagtacagaggaaaggggaacttctgatggtaacacttggctgatacctgtagctcctttccatatattttaaagatgatcttcctcataaatcattactagactataaatttctaggtaaaatttattgcacactagaaactgatgtcaagagggcccttaagtcagattaagctagcacttagagttccatcctgatcaaattctctaatgattctattttgccttaagttggtagtaacctgtcacatacaatcagcaacatttattaatcgcttgctatgcacctggcactgcaccaaatgctttttggatattatctttgtgagtcctcaatgaatgaggacggtactgttattattcccattttacagtgaggaaattgagacacagagggcctatgtaaatagcccaaggtcaaggggctataaaatagcaagccaagcccaggacttagaactcaggctgtctggtctgagtcccagcgtctgaatcacatgcccttctatcatgttactgttgttagtgacaatctccacatgccctaaactaataccactctcctgaaagaacaaggggtagcagaactttgctgccaaaatcctgcataatcatagaaacggagtatatcatccgtgttttgacttattcagaagagaagtcatgaggaaataggaaaataataatcacatttaaaaaaattatacagatcttcattgtagagaacaggcaattttatttgaacaaaattcttctgaaactgaaacatcaagggaatgtttgaccaaataaaccattaatactttggtcctgaggtgtttagtatttcttaattgtttcatgaaaattttatcttaacgttgataaatgaaaaaatatgccctttataaattagctttgggtgttaagtatggcctcatatgtgttaatcaggaaaaaaattgctccatgaaaactttttttttacaaaataaaaaagagtccccttgtaatatacagcacttcttatattacagcctcggagtgaatcagaactcattgatgaactttcagaagattttgaccggtctgaatgtaaagagaaaccatctaagccaactgaaaagacagaagtatgtttctaaacatataaatctctagttttgaggtttgtgatcttaaaaaaaaattgtgagacagactgttttagcatcaagcagtctgttagaaagcccaatatgccatcgttttttccatgtcatttttgtcttcctttttggatgtgctttctgccccaacctaaccctgatattcttgcaattgaagtcctgcaatgactccttcggaaagctctggaacccatgccttccttcttatcccagcttctgtaactgacctgattggaactgtcaccacccctcccctctgggttgcagtggcctttctgcagtctccttcatgtccgccggactcattctttctcaagcatgtctgtagttatgtcattcctctgcttctatccccaggagtttcccatccctacaaaaaaaagttcctattaccatattcttgacccagttttctttcctaccaaactgtgtccctgtgtcagtaaacagaacaataagtatgtgtgcatccctggcttttctcacttggttcctctgtcttgattgacctttctttctaatgctagatcaactaaagtcttactcatcttttcaaggctctgctgaaatatggctttatctgctgcttttccctccctaagctatatccatccaacctttattaagcagaacacaacatggcagaggatctgtagttctttttttatatatcactattaaagcctttgttacaaagaagagtttagctgttttagtccctctttaactctaacatttatgccaagtttaaatgggtagtaagttccttgaacgaagagatcatatcctattaatgaccatctgctgagcaccttgcatataggataggcttccataaaagtctagatttaaaacaatttgtttaaaggtttgcttctgttctttttgtttgtttgttttgttttgttttttcttgagatagggtctcactctctctcccagctgggagtgtagtggcacagtcttggctcactccagcctcaatcttccaggcccaagcaattctctcgcctcagcctcctgagtagctgagactacaggtgcatgccaccatgcctggctaatttttgtattttctgcagagctggggtttggccatgttgcccaggctgattcaaactcctggactccagtgatccaccctccttggcctcccaaagtgctgggatcacaggcatgagccaccacacccagccttgaaactttattcttgtgataaaataagatgggacagtggttctcaaactttagcatgcatcaggatcatctggagagtttttttttaaacacaggctgctagactctacccccaaagtttcttagtacatggggcaggggtctaagaatccgcatttctaggttcccttatggtgctgaggctgttagttcagggattacacttccaaaacttgtggcttattactactaccttccattcctacatagctgtatataaagtgctcttaggtttatataaatacaatattttacataatgctatattacataataggcatatttgttatacataatgacaaataaataatagaaataatagcaataattgctcaaatgtattgagctaactgtgttcccaggtactatgcatagcactttgcctgcattgtcttatataggcctcttaccaacccttcagatgtggatactgtcattgttctcattttacacatgtggaaactcagtttcacgagtttcagtaacctgcctaaggtgagaagtaaaaccaagttgaaaaaaatggcagctgaagagttttagcatgctttgacttatttactatttagcaatccttaggtattcaagagaatcatgttcacaccatataatgtagcggagtgtcttgttggtctaccattactcagtcttattaaccaaatatttctaaacttattgagagtacttgtgtctttcctcaggaatctaaggccgctgctccagctcctgtgtcggaggctgtgtgtcggacctccatgtgtagtatacagtcagcaccccctgagccggctaccttggtgagtgactccctgggcatttgagcagtggcttgagaaagttttctgcctcctcctgtcactctctgctgtgtattaccatcattttatcttatcctgacaaattaaaaataaaatctgatatcattatagtatctgttgtttctttgggcttcaggggtgtcgtagaaattcagactaagatttaaatttttaattaaattactcccaactgtatttttctctactcttctgaaattctagttcctcagctattgtggataatcctgccttttcacttctctgcatcttttaagcctatatggatttccaccgaaagcccaaagttacttttttactgactttcctggtagaataacatgcagtaaaatcattatgattcctccccactcttcccactgcaggaggtgaaactgactcaatttctttctctttccttcttcttttcgtgcttctctctcactttctaattttcacatgaagtatgatatttaagaaggtgaatctttgtttccttttgattttagtgttttttttccattagttaatgattgaatttgactcagggaataacatctgatggaattatatttcaattgtatttcattactacagaattagcacatcttccctctgaacacctacctttcatcatctgctgtgccattgctctagatgttttgcaatgtcttctcattaaattttcacaaggacactatgaagtctgtcctgatcatcttcctgtaatagataagggaaatgaggctttgagttgaccttgatccacttgatatttcagagcctcagttgagatgaaagatatggcccctgctctcagctgtcttcaagactagtgtggatatgagccctccccagttttttggggtttcagggtactcttcaggtactttttacagcatgtgtgctaggccacagtggtaaagaaccggagaggaggagggactctaggaggactctggtgaagaaagcaggcaaagaggctgtgattggagtcaaaacaacaatagccagcattccccagtagaactcttgtaaccaaaacctgcacctgcaccacctgcctcatctgccaagtgtgactgcccgggctttagagggctcaattccttttcaactttaccctgactgtagagctgagcattggattgttagaaagcagacaaaccagaacaaaacaaaaagctcttgttttccctttccccgtcctcctttccagggccttaaccccaccaactctggccatggttgcccaggttactgtcactgaggcagttggcatttctgggattgtgacaccctcgaacgccagaaagaatagctgtagagtgtaataaaggtcagaggactcaagaaaggcatgaagattagagagtaaaggaagacagaccagaggaaggagatgaatgcgttccctaggtggttcttgtgtgtataaaagaaaatttattaaggaaacccagagacctgagttgtagttgtgaatttgataatatcaaatactacagaaatagaagttttagtccttactcctgtttccagattcctttgttcttaagtctgcttcttctcctaggttttctttaactgtttcagtaatttcttaagcaagaggttggcaaagggcacaggtttggggaagcagtggtttccaaagattctgtagcatagagtatgagaaaacagaattgtagtgtgagcaggtgtcttaaatcatgtagcaactcacattgcttgcataagacttgggtaccagtgcaactcttgatatccttgattagagtgttgcaactcttaatacttaatacttaatttaggtataatcccaaacaggttagaaacctcagggataacctcagggattttttttttttttttttttttttttttttttggtagctcttgggaataaaacccatgcagtattcagccactaggtggtgctaaatcacttttctttggtgatctttccttttgcagtgcagtttatcagaaaaacagcttttcttacttgaaatcatggctaaaatataaaacagaaatacagttttactctaaaattttaataggtgctcattgtgaggtcagagattttaataataagattaaactctgagattgtttgacccaaggccttttacatttttgtttgaccaagaccaacagtgggaaattcattgatattgcaaccccatccccatacactggaagcaacagtttaaagaatagtatttatcccttctatgtatgatgcattttatacacacacacacacacacacacacacacactcttacatttttttttttttgaggcagagtctcgttctgtcatccaggttggactgcaatggcatgatctcggctcactgcaacctcaacctcctgaggtcaagcaatcctcccacctcagcctcttgaggagatgggactacaggcatgcaccatcatgcctggctaatttttaaaaactttttgtaaagatgggatctcactgtgttgccccggctggtctcaaactcctgagctcaaacaatcttcctgccttggcctcccaaaatgctgtgatggattacaggtgtgagccactgtgcctggtcctgttctcttcattaaaaaagaaaagtcctggccatgaaccattaagttgattcttatgacctactaatgtacagacgattccctttattttcccttgacaccattcgtcctctgtgttcaccagtgtgattttaaataccagcatggccagagttcattacatttgggggagtacatttcattttgaacaatcggaccacaggtagacagttctcactgtgccattcaggttagttggtcacaggcagagtcatcagaaccagccctgaaactcctttggtcagtagaagccctgtggagaaaacaggcttccgagcctcctcttctgagacaagccaggctgtcccacaggaaatggagaggaatggcctcttgtgggctctctgaaaatctttcctgtgccgtctatggaatgatctccataaagaccacgtctttcttttttcctggtatgcaacttatctgtgatacacctcagtccattgtctttcttatttctaaaccaactctgggtcaggtctcgtaagtttcacattatcaacatataatttgcacacaatgtttaatataagaaatttgctcgaatgttaaacgttttgttttttaaacatagattctaattcagttgataactcgagttattaaaagatagcgtgtgccttttatctgaaataatgatatgcctttctgaattgatagcatatgttttaaagggagtgattaaccacctacttaatatatccactaatgcactttcagaagggcacagtgccagatgatgctgtagaagccttggctgatagcctggggaaaaaggaagcagatccagaagatggaaaacctgtgatggataaagtcaaggtaatggcaactgagatgcttctggaaaataaatatcattgatcaccttctccccctgcaaataagttagtcatttgttttgttttttatatttcctgtaaaacatgaccagctggctttttctattattgtgcatatcctgtttaataagctaaacctgaataagctgcagtgttgaacccccacagtggatggtcgacatgcacagaccggaggcctctgagtctcatctttgcccacctgcattgacattgctgggacttgggaaggaaggggcagctgcctgctgctcctcacagctgtcttgcatcccagcaggctttctgctggtgcctgagtctgccagatgaagttgctgtaggagcactaagcatacggtcatatgtacttcctaacctaatgatagatttgtttacctcaaatctagtcactcaggcatgaattttatggagagaaaaaaacatgctaacaatgaaaatggtataatttttctcaggagaaggccaaagaagaagaccgtgaaaagcttggtgaaaaagaagaaacaattcctcctgattatagattagaagaggtcaaggtaaacaggctggagtctttttctattttattttaattcatactgaattcatacacagaacaaaggtacttgggaacagaactggaatataaagatcttgtttcttcatatttcaaacaccaaatagtattagtctactactaatagtgttagaacaccagatacaaagctaaaatattcctaagtagacttgatcctcaagtgaaagaaatctaatgtctaagctacctaatgttttcctttctaacccacagcttgttacaataccagaaatattaaaaaaccttgtgtagataggagaactaaaatgaggaataggccgggcatggtggctcatgcctataatcccagaagtttagaaggccaaggcaggagcatctcttgagcccaggagttcaagactagcctgggcaacataatgagaccctgtctctacaaaaaaatcaaaaaaattaggcatggtggcatgtgcctgtagtcccaggtacttgcgaggctgaagtgggaggatcacttgagcccaggaggtagaggctgcagtgagccatgatcgtaccactgcactccagccagggtgacagagcgagaccctaactcaaaaagaagtaaaaaatgaaaaaaaataaaataaggaacaattactttatataagaaaaatttgcaactttcagatataagttggaaaaataagagaacctatttaacattgagtatagtgttaagttgccccatttcttctattttgaaagtacagattgtacacaacaagggggaagaccccattatgagtcctgtggtttaagtgcagtcacttaaatgaggcggattcgtggacagttgaacaatgtcagtcatctttgtagcaggccaggatttgaaagagtattcaactaaacttcattaacaattctagaaaatcaaattcatgcttctcactcatccatgtgcactagcccatttatttagcagacacgggaactagactgaactatccgtgattgaaagtttattattctggaaacctttatatttgcttcctgagttttacaattcagttgcagccatagcgtttctattaatttgggctcatttgtacattgctttgcaaagttcctagagagcatgctaagggccacatgttctgtctccactgagtgcccattcagtagaggctggtcaagtgcaggtaaactctcttcatgataggtgattggttggtgatttgctctctccctttactgaatttagtagtagtgtttaaggaagcagttgattcacagtccctgatcactttattctgtagtcatttcatcctcctctgacttacctcacacgttattagttacctattaataacattttcaggcactagcttcatctcatttaaatcctatgttggtattcaccagctatgttcccatcaggtctcctcagtgagatttggctccccgagggcaggccacaacctccccttccagacgcagaatgacgcagtgatggaaaatcgatttcagtttgagtagggagcaaaagtgctcccagagtcccaggcatcacttaggaaattttctgcctttacagctaagagatggtggagaacaagcccaggttcagctttcccctgtacctgaagaatggtcagaaggcaaaagtcagtcatgagggaaacaggtgatccaagttgaatatccctcatctgacatgcctggggaccagaactgtttcagatttcagacttttctggattttggaatatttgcctcgtatctgttgagcagccctagtctgaaaatccaaaatgcccccgtgagcatttcctttgagttgtcaggtcagcactcaaaaagtttcaaattttggagcatttaaattgttttcagattttcagattagggatactcaacttgtacctctaaaccattgcacttcacattttcaatgaaacaaaaaccaaccttaaccagtttctcaggtgaaatattcatatatatgtatatctttgtatttacttatttttgtgtaggtggataaatgggatttactattagtatatagatctccttttactaaagagccccgcatgctttcttcattttgtcgtgttactcaaatgtggcacttggagtcataaacagcttgacctaatctgaaccataagttgcagagcgtttcactgacaggttaaactccctgagggcaaggcctttgtgcgattttctgttgtattgccaatgcttacttaggtcagggcttggcatgtagtccttgcatatgagttagatgtgtggcttacaaggttaaccagcattttccagacaacctctacaaagcccacccccatgtaggtaaagggcttatcccacactgtcctgcaaaccccagtcacagcaccacataccacactatgctgactttcacgttttcctgctgtgatagtctctaggcttctgaggtcacaagccatacctcatccagtgtgcagcccccgtgactcaggaatgcctggtgcttgtgagctgtttgttgccatgaactaattagagcatattctctggtgagagaatccttcgtgacatgatggatctaatttaaaatgtacaacagcaagtataacctgtagaccctttgtaatgtttacaaggtttcatactttggataaaatgtaaaatgatttcatgccatgtgttttcccccccggataggataaagatggaaagccactcctgccaaaagagtctaaggaacagcttccagtaagcaaaccagttttctctgaggatatcttttccttttggccctgattgcaatggtgtttgttgatacatttcctggttcttgcagcccatgagtgaagacttccttctggatgctttgtctgaggacttctctggtccacaaaatgcttcatctcttgtaagtccaaaactcttggttttatttctttagttttttttttttttttcctttgagatggagtcttgctctgtcatccaggcgggagtacagtggtgccatcttcagtcaccgcaacctccaccttccagattcaagcgattctcctgccccagcctcctgagtagctgggactacaggggtgcaccaccacacccagctaatttttgtatttttagtagagacgggctttcaccatgctggccaggctggtgtcagtctcctaacctcatgatccgcccacctcggcctctgaaagtgcttggattacaggcatgagccaccgcgcctggcctatttctttagttttagagtggcagaaataaatggaaactggtgacttagaatctgacttgggaactcaggaacaatcataaaattaatggccctcaacccactgtagccattaaaaatgtgttgcaccatgaaatactgtcccaacatagtggatgcttttattagtgtaactaatatcaagtaccagtacccctatgaaaagagaatttaaatgtaagcttatccaaaattactcctcagacaactttacctattgatatttctacaatttatcatttcccaaattgcctcctaagggaacttagctccatgtggaatatagagtccctcaaagggaactctgttactcgaaaagtttggacaatattgggtaatgttaagcaggtttctctactgtaggattttcatggctttttatatgcaaatatatagtgagtctgttagagttcccaaacttaataactgcagaaccttttcttgtggggtctggtttatctgtttactgggaactcagtttttaaaccactgaatgtattattagcagtcagttggaaagggattaacagtttctatgacagtggcatggaaaatatatttatatcagttggagaatagacagaatgacaactagaagaaataatgattctttggaattgcctgaagttgttacttttgctgaatgaagcaataaagcccctcaaagaagagcttactaaccagagcatgttattctctgtacccctgtaaaagcaccgtgctgctcagtcacctcatcccgtgaccttcctctcatcgtcttccatacagaccacatcacagcaaagcactccagccttgatttagaaaccataagacatggggaagaatacaatgtgaggagtacgccaggaatgtggagtcatagcattacactgaggcagaacagatgaacaaatagtggggaacaagatctcaattcccttcctcctcctatcattattattattacaattgttagggttgttttttcttttagaaattcaaagatttggaaaaagtaacaatggatttatatgcccccttcaaagatatgtagcagtgaaatggtgagatgaaacaacctttaaaaaaaatcttactcttagaaaattagcaaaggaaacattagtgccaacaatatagttaataaagtagaaataactaatcatcatgagaaccaaataatcaaaatagttatttagtggaaagtttcaagaaatttgggggagaagtatcacatatggctcataattagtgttcatctgtaaaagagtagctcctgtacgtaccatgctctttgatataatagaacagaaatgctatataaaaagaaacacttaaaactattcccctaataatactgagatcacattgataatagactattttaaaacatcaaagatattacaagaaaaagtctttgagaagcagtcaaagcagtattcctgtgatacattgtcataaacacctttatcaatagtagagaaagagaaaaagagaaacctgataaactaaatgcttattgaattttaaactgaaatttctaaaagttttaataaggtagccaccaaaaacaaagtagcaataagcataccaggaaatgaaaatagcggcatgaaagttaactggccaatagttgtttcttttgaaataacaaatactttataaaatactagcaaatataaaagaggaaaaaaaaccttacaaaaaatacaattaaattttaacagagtaatataataatatagagatcaactaaattattggtagtttaaagccaatagtcagttggcttttatgaatttttaacattttacaaaactgataaatagagaaaataatcttactaataaaatttaacataaatgtgagaaaatacaataatcagtacagagcacaaataaattattaggaaacactatgtacaacaattttctaagattaaacaaaaatattaaactgcgtaattcacaaaacctaaaaaaagactgaagaaaatattgcaatgattttcaaactgtccttctactgaaggtttaaagatgactctaactgttgaacactcagttcttatgtggcataaatatgtcatgaaaaagatggggtcacatagttgcttctatgagtaattatggtgctaatcttaaaatctgacaaatataacggtatcagctaaagttacttaaatgtgtagatgtaaaaattacatacagcatacatagaatataacaaacagttaaattatttgccattataagtattgattcagtagcaggaaaactgtcaatatattgtagtggtatatcaaatagaaacaaataatcatgtccatgtaaaagatctatttaaaattttacatatactcatattataaataaaaactttttaaaaagtaggcaatcccctaatctgttaaagagtctttagttttcagaatcaaatattcaatatcatgctggaggcattttccttaaaagcagaaactatgaaaagtttattgtcatttctgcttattatcacatggaagaatcattaacaacacatgaaaaaaatgacaaacattaaaagggaacatttgaatatatttgtggatagcactacttgtagataatacatttgtaagtaacattatgccatgtttattagtaacaacagatgagaaaatgtaattaatatgagatcagacttaatgtaaactataaaaggagaaatgatcagaaaaataaggacacaaaaaaattgaaggccatacattaagtcagtttaactaaatatcttaaaaagaatgatgacaattcaagtcattttatgtgttaattttttattaaatagcaataagatacttttataactcaataaaattattcaatgatacattcggaaaataaatgtataaaatatgaaaaagtactaaaaagcatttttcagtacttttaggtaagattaatccaactaaacactagcatatgttatacagtaataataagtggaaaatacaataatgttgagaaagcaaactcaaagcatagatcaatgaaaaaattgagaaatggacataaatgatttagtatttttaaagagagtgaaaaatcattattttatgcttttgtgtagcattagatgaattaaataacatatgcacatatagctttgcgatacaaatttccagaccataggttgtttcatacttagtattaaaaggcttaaataataagtcaataagatagtttaagaagagacaatacaaatgtttcaatgtcattcttttcatttgacaacttgttattcttttcatttgtcatataagcaaagatttctcataactaaaaatgaatttaatttagtacattttggattacctaaaatattacattctaaaacggctttacagggtataaatggacaataagtatcttatagttatctaaattagtttaaataatttccaataataacatgctgaaatgaatttctgaatgttggtatctttttaatgtgcttttctccatcttttggtaaaatttgcaattctcctttttcaaaataagctatccatagttggagtcaccaaagagttctggacttttttctggtttttcatcaacagttatacctaagtttttttgtcaaaagggagtatttgaaatgaagcaaatattcaatatttttaaacagaaattatttcagaaagtttctagaatatttaacgttgaaaaaaaaccctgaaacctgacaccgtataccacaatatacaagcaatagtagtatatcattttacactgattatcataataaaagtcaaattctggcaagcaaggccatgggaaaacaggcatgcttattcattgcttttcgcagtatgaattcctagcaacatttgagagggcagtttagcaaaatatagccagcaccataactcactcactagaacttattcagagcaattttaaaagagctgaaaactttgaataacctaaatgtacaacaggaaatgtgtaaacaaaccgtggaactctaagttatattattgcatagtatttagaataatcaatatgagaaggaaatagaaatagcaaattgtataaaataatacaatagagaagaaagaatttaaatttcttttaaaattatatgttattatgagtctatttggtcaagagaataaacagtcattaagctatctttaagagttatagttaagtgatggcattgtgctcataattttatatacaacatgttactaataaaatttttttcaataaaagaaatttgaagatgctaaacttgctgctgccatctctgaagtggtttcccaaaccccagcttcaacgacccaagctggagccccaccccgtgatacctcggtaagcagcacatcttatttgggagataaatgtttttgcgcagccacaactagaaagaaaatagggcgcctgtttaaagcaaatgaaaataggcagaattattaggaagatcaggcaccttctatttcagaagagccgagactgatgatttagcgagatggcagagattaactttgaaatgattaaatgaaactatatatgtgaaaacattgtacacatagtcaaggaccttaatattattgttgctttataagaattgaaagtgcaataaagtgcattgtgtctatattcaaattactagatttgaaaagttctttagctttcctgataattgattttctcctttatattttttcttatacattctataatttactacccattatttaacctcaagtttattttatggaatcgtcatgtttgagcttttacaaacattttacaaacgtcatggaatagcattgttttcttcccaattcacaccagtaaaaatttgtcactttcatactagcagtagaagaacctcagcatcaatattgttttaattatttacatgctgtgaggcaaggctgtgggaccaaagcttttccagacttccttgactaatcacctgtgcaataccaaattatacattaccaaggagaccacagcacatcaaattataaagggattgccctaaaccagatccccatctcctttggttgagaacagtgcctcatttgctagatggagatgaagtaactttagcgaagtcagctatgcttccattccgtttgatgtagcatcaaagcatatttagtgctgtagtctgagattctgatggattttcatcctgttgcgtcagcttcaggatcatctgaaaatatccagaggcacaaatgacaaagcccagacctggccccgggcagctctaccattagcagctataatcctggattataataaagcacttaaaaccagtaaaatgccccgtgtgtgtgtatgtgcatgtgcatgtgcatgtgtgtatgtaaacacacccacaatgaagaaagtccccatgcaacagaaaggaagaatcattaatagcctaggctgccgtttacacttcagttcttaatattcaggccagagattctgccctgatgaaggctatcagtaaacatttgcaatcaaaaacttttttgcctttaagaagtaggttttacaatgacacttctctgatcacatttcccatcagagaggcttgtttttagttaacattttatttgaagatgtcactaaaacaaggtataaagctttatttagataaaaatattaggaaatcgaagagtcaaataaaccatgataattcacgggagctttctttgctgtgattattagattgttactaacagtgttacatacactgaaagcatttgaagacatgatttcaaagatctgtgtaataaaatcactccaacaggaaaactgcttcaaagaaaatagaagatcatggatgtgactaagcatgacagggaaaagctttatcagtcccaagacctgggttctattcactttttaacaatttgttttcaagcaactgacttagcttccctgagctttttacctcaaaaaaaaaaagcctgcttagttcactgagaaccattgtgggcatcaaataaaactggatagtgtatgtgaaaacattttgaaaatcaactggaaagttctatacagtattggacagagttcagcatggtgtcttatacaatgtagatattaaacacattttaattgaattcatttagaggtggaattttgaatgcaatgtgttgaaaaatatggattttgctataataatactaataataatttaccatttgttgggtcctaacatacaactagtattgttttaaatgccttttcaatcatttacttttctcagcaacttaggagtataagtactactattattcacatttcacggccaaggaaactgaagctgaaaggggttaaataagctgcctgaatcatacagtaaataaatgttagaggaaataagctatcttagttacagtgatattgttgtccataatttttttcctctagaataccagctcccatttctgcaatttcacttccatgagcttcctgaagatgaaaagagaggtttccccaccagttcagaaattctctgaagtctttcagggcactcatcaccagtgtggcagacaagccccttccactctcctgaccccagattgtctctggggttttgtgctttaggaagtattaggatggcagtgccgagctccatggcttcccacaaactgcgggtcacgctgcactttctgaaatgcacccctcaagatcttagagttttagagaggacccacagaaccaaagaaacacttaccctctatagttgcagaatcttgcttcctaaccatctgacaacattagtagatgtttgttttcatatccagttttctaatggtgtttaatttctaaatgaaaggcacacatgattggttcatttgcttttggaccctttatgtgacctccaggtcacccactggatatggctcctgaggctgccactaagacctccttaacctggtgggatcttcaccaagagatgggcagggttgggtggaaggtgctggccctccaaccccagtagggtgacagatactgccgctcttctcctgatcttccattcctaggcttctcttctctgaccctgtctactcccctgccccagccccagatgtctttttcttccaaggaaacaggttccctcctgaaaagatggagttcctgggctaatttgcctctgatacagtttggctaatgagtgactaattcagcattatttacttttcagcagagtgacaaagacctcgatgatgccttggataaactctctgacagtctaggacaaaggcagcctgacccagatgagaacaaaccaatggaagataaagtaaaggtaaaaaaaaaaaaaaaaaaaaaaaaaattcactaatagtgaaattttaatccttgggtcttgactctgtcattgtcataggaatattgatgtgaacttaacctatattttaaacatgaaattataatgaaatagaaaaatcaatctgtactccactggaggggaaggtcactgaatctgtgacagagataccagcggagcctccctgaggggattctgggaggtaggtgtggggtatgcatggcttcctcccatgcaacacaagcagtcagcacatccattcaaattagctgttgtccttcagggttgcttataaataggcaaagttgtaaatgtgacctctctaaatggcaaggtacagtggcctgattttgtattagaaaagtgaaaccatacagaaaaaaagaaaaagatattttatacctttgggttctaatctcctaacatggtttctgaagataattatttaatcatttatttccatttaaaatatagctagaaaattcacagatatgaattgacatacagaagcatacgggattttatattttagccaactagcagtctgttgaagtcatctgtgttgttctgttgcttaaaaaataaaaacagaccatatgttttgcctcatgaaagtacaacaaatgctgaatgctgcatttgacaatgtattttctaagtgaaagaggaaatgaatattaattctatctgctcactgttgatataggaaaaagctaaagctgaacatagagacaagcttggagaaagagatgacactatcccacctgaatacagacatctcctggatgataatggacaggtaaactgaggcaaattgctagatcggatttatgctaccaagatctttaaattcaaacctcccttgaaataaatagtagctatactcctttacaatagcataaaacataccatgactgactgcttctaatgtgtcaccaaagccgaccagcaggtaaatatttatttgagccaatatcattatatatgcatatgctaggctctgtggtataaacagggttgaatgctgttcagtcactcacagatgcttaagagtgatccaagaaatgtgattctctctttcaagaaaaggctataaaaatgactaaggtgataggatttcaaaggaagcaatctctgtttaaggagagcagaaaaggagctggtgttgggataattaatagggaaaattaataaggcagctccaagacctggggtctccctatcttctcctgcatcatcatcagcactattgcaagtgaagacaggcaaagcaatattcccaatcacaaatcctgtttctctgccaaaaagtccctggccttttgtctcccacatgatagaggccagtctttcgtaggtcaaccaggcctgtcccccacctctttcctatttagtttctaatttttgagtcaattagatgataaataaccctttccatgcctgttcatcaaataagaaacaaggaagaccaaattacacccttctctttctgtactgattcattttggtgagtaagatgattcctggtttaaatagcagtgtcagcttcagggtctcctattacaggaaccaattctccttgcttgcattcagtattcctcaagatagcaattccacatcctgctagagcccttcccactttgatagtaccaactcaccctgcttgcgttctttgggaaatttattatttaaggcccttgcctttgaagctgggaaaaatccctgatgactttctaagtgtaataagctatagtaaataagatgtaaaaacacaagtaactttttataacactttaagtagaattataagtgataatacatgatggcagaaggttcacaaatagtgtttctttcacttccaggaccagaccctttcatatgtttcccccaagtctacacaaatgattataaagaatagtaattaagcaaagctggtaaagaaatagtggggactcaggtttattagttattgcaagtctacactccattttatccaagtcaagtcatgggacaatagattctctactgcctaaacctaagtaaacctttacagatatctatgcttaaccaatagtctgccttctttttaaggacaaaccagtgaagccacctacaaagaaatcagaggattcaaaggtaaagaccataggaacatatttccattaaattttgttttattctagccataggggtatttggcattttagaaaactaaaacatattgaatgcctactctgtgcctggtactttgtcaaagcatgcatataaatgtgtgtgactattgtttacctctcttttagtcttcacaaaagccctttagggtggaaaactgaggctcagagaatgctaagcaacgtgtattaaagagtagatggaaaaaaagccatcaagattttcttgtttttctatctcctttacaatacattattattaataaagaatgtcagtcagtttttttcttatagaaacatcttttatttgtaagtgatgtgggaaaagaccccatattgcattttgccttctgcttcttcactgatggttatttctactcatatctcagaaacctgcagatgaccaagaccccattgatgctctctcaggagatctggacagctgtccctccactacagaaacctcacagaacacagcaaaggtactgtgctttttcacatttcactctttgaaatgtgtgtgtgtgtatgtgtacatacatataagttttatttattgattgatctatctatcggtctgtcttgtaacagggtcttactctatagcccaggctggagtgcagtggtgtgatctcagcttactgcgatctctgcttcctgggctcaagcaatcctcctaccttagcttcctgagtagctgggactacaggcgtgcaccaccacacccagctaatttttgtatttttttgtagagagggggtttcgccatgttgccaggctggtctcgagctcttgggctcaagtgatctgccaacctctacctcccaaagtactgggattacaggcttgagccactgcgcctggcccttacaatttttaaactgtagaatgaatcaaacgatgatatagagaacctgaaaatgaagaaaagaaaaaatgcctataattccactgcccccaaaacagtattattttgtggatttccttttttttctatatgtatattttacataattatacttacagtccacttataaaacactgcttaacgttatttcttaactgctactttgtaatttccatagccaccattttttatctccacactatatggttgtgccacaataatgctatgtctgtgttcatttaaagtgagagcaggccctaactacatcaggcactctcatgctcatttgctctctggagcttcctccccttttctgtctgcttagcccaactggtctactcttcattcctcagggcacagctcaagcatcagctccttagggaagactttcttgtcttacatcttctcccttcccagtccaaagttagaggcctctcttccatgccctccttgctctctgttacctctctgtgcttgtgtatcacaccactgagctacgcatttcatacagtagtgatgtgtcttttacctctgtgctcctcattagcaaaatgcctggtacttagcaggtgctcaaaacgtgattaaaagtgaatgagaaacaactgtgtaattcaacaagtgtgaggcattttccctcaagctacaccctcttgtaaatcaaatagaaggaaacgtgaaatgagtacctccttgttattttcaggagagttaattctgcagatctcagtttgctattgttttggctgttctaaggcactgctctcgatcactgaattgtcagcccttccatactgggtagcttaatttctagaccacttcagcatcctatctctcacccctggtaactcgtaagtaatgccttttttggtgaatggactttatttttatacgtaacctgctccagctttcctcggttgtttcccattgttcatttctctcccataacactgaaaacagggtttttttttgtttttttttttttgccttttggtacacaaaagccagtcctgatcgagacaagctctattttgttttttaaatacattttattgtgtatatttgaggtttacaacatggtagtttgggatgcatagaaataataaaatggttactgtagggaagcagatttacatatctatcattctcacacaactactttttgtgacaaaagcagctaaaatctacttagttaacaaaatccctaatacaattttattaaccttagtcctcatgttatacattaactctctacacttgttcattctgcatatctgctattttgtatcctttgacctatatctctgtttcctcctcctgttccctaccatggtcgccatgttttattctctgtgtttttgagctttttcttttatatatattctacatataagtgaaatcacttttctttctgtgtctggcttatatcatctagtataaggtcttccaggtccatccatgttgtgacaaatagtaggatatcgttttttaaggctgaataatattccattatgtatatatacatgacattttctttatccattcatcaacaactaggttgttccatatcttggctattgtgagtaatgttgcagtgaatatgggagtgcagatatctttataaggtgataatttcatctcctttgggtatatacccagaagagggattactgggtcatacagtagttctacttttaatttctttaggaacctatatactgttttccatcatagcccataccaatctacatccccactgacagtgtactagggttcccttttctccacacccttgccgacatttattatctattgacaagctctgttttgattagcaaaataaggtctgggtgagtcaggcaccacgggaattagagcatcaatgtcacccacatttccctccttatttctatcctttttccctcctgctttaaacaattctctgacaccgttgttcaaaaaaaatcatgaaaaaacacccaaagtcttccattatttaattaaattggagatctcagaatggtctggattaatttaactgcagcctagttaattgctagatggattggtgatagccatagcctcattacatttcctttgctttaggataagtgcaagaaggctgcttccagctccaaagcacctaagaatggaggtaaagcgaaggattcagcaaaggtaaatggagcagtaaatatactacaaattagtttagcagttacacagagtagggtttatcatttcagtcatttagtttcctactggaatctatttagaataaaatttcttaaagtactatctatcccatagcatcgcttggtaaagtaattgaatttgtataaatacatatatttttaagtaactggtgctttaaaatcctaaatgaatgttcttgacacaacccaatttgcctgtgttttgcctgtctttcttgccctaattaaaataccaccatagtatgtggtttatatagattttagaacatggaagttggaaacttcctattattaaaattactcaagctgtgatgagaaatgaaaattggattagacaacttctaggtcccttccaattccaagaacatatgatttaaatgattattactatgatcccctggctataaggaggagttaaaggtgtagctttaaagacaatagtccagttacaccaaagcttttaaaacaatatattaaaatcttcctgtagtagattcccttaagggatataggaaacagcattgataattggcagttatgccattatatctcagtttaaatacttatttgcctattatttaatttcagttatacgaagtacttaatcagccctttaacaaataatagaaagcataataaccctttatgatgagtggatttactggacagccatgaccctatgtacaggaaaggaaggatcaccacagaatgaaacattgccatttaagaacacctatgcatattttataacctaccctagccttaaaaaaataaagctgagagtgatacatttaggatcaggatcacttaaggttatttttagcttataagcttgaggaggaagaactcacaatattgtggccagatgaagaagagaaactgaaaggaccatcttatttttccccactgactgccatcttttgtcccctaattctgagaaggccatctcctcatacttaatacagaaaagaaagctcacggatggttttgctttcccttttagacaacagaggaaacttccaagccaaaagatgactaaagaaatacaagttaaggtatctggtaagttgggtgtttatttgtaaatgaagacaactgtatcttctgccaatttatgtgttatagatgagagaagtgaagtccacctcttgagtaattcatgctcactttacagtattggcatgaaatgcatactgcaagatctacagagtaattggtcattctctgaaagcactaaatgggatgagtttgctattgaaatgtttaaaaaccttaatcttataattaaaagcttttaaaaatattaggccaggcacttagaatgaccatctgaggctagttgaatctttgaaatccaaatgctcattactgcaggttattgtggcaaagcaaaattagcatgttacaacttagcgaaatgtcctgaagacattggcattccccagaataccaatacatggtggggtggggagaagtaccctttagagtctggtggaaattacagggttttgggaacaagggcaaaggaaaagattggccatttttatttgtcattattttggaaagtaaagtactgtgtttgattctaatttataattgctgaagaaactggacagattgaagggatttctgagatcttcagaactgggcccttatcttaatcttcagaaaggagagggcttaatgtaagccttaaaagcatacaagcacttactgaccaaagcctaaaagaaatcaaagtataggttaaatcgggttcagctctctcaccatgatccatgtttatttcctaggaaaaaaggagctatattaggtagaactgctctaacatttttcccaaaattaaaaaaaattctattaatccactttcatgtttacttataggaaattccttctgtctgttatacaatgcttttgctaagtggtatatttactatgtctgtaacaagaaaattacatattaaatgattcactgcattttttatttgaaatttttaaggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacatt

SEQ ID NO: 37745 - DNA, 80418 bp, Homo sapiens; identical to SEQ ID NO: 36989

SEQ ID NO: 37746 - DNA, 355023 bp, Homo sapiens
ggcagcagcagcagagaatccaaaccctaaagctgatatcacaaagtaccatttctccaagttgggggctcagaggggagtcatcatgagcgatgttaccattgtgaaagaaggttgggttcagaagaggggtaagtgctccgcaaaccaaaaataatacggttggtaagagtgctagcagtgagtggtgtcttagaagttgatcttttttctgatactgttaaactgtgtcatgctatgtctagtaagagagaaatgatatatttaacgtgtgttaggaatttgcttgttattaagggatttttttgtaattcttgattttgagcatttataatctagttaagttaggtttgactttctggtatgttgtgtgtagcgtgttacagaaagtgttgtatttttctgtggtgtctacaggttctgtaatctggagagatatctttagaatcatttaatatatgtaaaagtacgatcctatatgcatttaatcacatgtaaatatataaataagagaattaagccagtttgaatggttgtaggggaatggcttaaagtagaaaaggggaaagggttcacccgcaaactcatggattaatcccataaatttggtaagtaaagtcctgacgtaaaaggccaaatgaggacaaggattttttgtgtgtgtatgtttatgtttaatttcgtatttttatttttcatcatctaggtttaatacaccttgttcactcctactttagataaataacttaagcacattattattttttattattaaaggaagaacccttcgatgtaaagcggtttatcatctgtgagatcacctgcttatgtggtcaatatatttattagaaatttagagtttagattagttgctaggcaactactgtttacccacatggccacgtcgagtaggatgaggactgttccattctcagaaccttttagttcctgtatatctactttatggttacaagttccctcctaatattgattttaatattttttgaaggtctgtagtaaatacctatcctgaaaagctgttgtcatagttaaatgtgattatggattattttttaaatgagccttattaagtcgtaacttacataataaaattaagcaatgtaaagtcataatttgatgagttttgccagagatacacagtagtgtaacaaacactctgaaaacgatatagtggttattttcattaacccgagaggttcctttgttctcccttgcagcccagtcctcatcccttaaccctggcaaccactttatctgctgttactataattttgcttttctagaatttcatataaatggaatcatgcagtacatagtttttttatggctgatttcttttacatagcataatactgttaatattcatccatgtcttgtatatcattagctttttttttatggttgagtagtagttcatggtctggatatatcacagtttatctgttaatcacttgttggacatttgggctgcttctagcttttggttagtacgaataaagagtctggacattagagtgcatgtctttgtgtaatgtgttttcatttgtcttgggtaataacttaggaatgatattgctgggtcatatggtaagtgtgtgtttaactttataagaagtatatgtttaacaaactgcccagctgttttccgatgtgcctgaccatttgtattgtcaagtgtaatttctttcaatgtcattctcctgttataaattacgaaagcattttcagatttcagtgctttataaaggcttttttgatttactttttaaacgtatttatattattctactttttttggagggggatggcaaatcacttgaacctttttgagttttactttactaatctctaaaatctgctttcacaagatggttttgagggttaaatgagatgatggttgtggatttattttgacagttctaacacaatgtaagctgttgctatctccacatatttatcaaaggtttaggatgattctttagtctgtttaattaattatatctttgaaataccataatagaaagtatttagtccatggactatagaaaaaaaaatgaataagaatttgccatcatttttctaataatgtgtatgtgtttattttgagatgtgtatgtgtatgtgtttctaataatgtgtatgtgcttattttgagatgaatagttgcataaacataaaaatttgaataacacacaaaggtataaaatgaaaaataaaaatctccctatcttttctacctcctttgtcagagataatcattttagaactttttttcctatttttaattgtctcatcattatgccagttttttatataatatactaaactttaaccttcagtaacctaatatctccccattgtgaaaaatagaaggatttaacttttaatactgatcctaccttcttccttttattttttggttgcctttatgattaaacttatagctgtttaacagttaactttagagtgttcagacattgtctctaaacttgccactttataagttgtaaaaaaaaaaaattagcttttctcctcatctttcccttgaattcctcacattccctttccagtttttcaactgtaacatttattttatatgtcaaggtttataatagttatacttgctgattctgaaaagcagttaaaatattacattatataaataatatgactaaacaaagtggtatgatgagattcttagagagcaaatggatttattttattttactttaagttctgggatacatgtgcagaacgtgcaggtttgttacataggtatacatgtgccatggtggtttgctgcacctgtcaacctgtcacctaggttttaagccccccatgcattaggtcctcatgctctcccttaccttgccccccacccccagcaggccctggtgtgtgatgttcccctccttgtgtccgtgtgttctcattggagaacaaatggatttcttacgctctctttgtactccagagctgccatactttaatttggtttctagtttggactgtggctatttttcctggattttctttatttttattttattttattttattttttgagacggagtctcgttctgtcacccaggctggaatgcagtggcatgatctcggctcactgcaacctccgcctcccgtgttcaagtgattcccctgcctcagcctcccgagtagctgggatgccaccatgccaggctaattttttgtattttcagtagagacgagatttcaccgtgttagccaggttggtgtcgatctcctgacttcgtgatctgcctgccttggcctcccaaagtgctgggattacaggcgtgagccaccgcacccggaccttttcctgtattttctgttttttttttttttttgagatggagtcatgttctccgtctcatcaacaacaacaacaaaaaattgatataataaagttataatatagttattactttgaatattagtcttttttcgtaagactatatgcatcaattgttgttatctccagatataatctgatttgtacttttaatgtgagtaagttgcttttcagtaaatatcttcttggaaaataaaaaaagggctgaaagataaatattcattattacgtaggataaatgctttcctaaccttggttattagtgatatattaatagtgatatcctattttttacacttttctggacagttgaaaatgataagtattaattgagataacacattaccatagtattgttggtgttagaaatggcaataaaagaaacatcacggagcaaacatcaagtaaagtattgtctgcgttttcctccttgatggatccaggacagctccttacaacttggttgcacatcagcataggaggcatctctgtatatattaaatacttactaaatgatcttactcaaagacgagcctgtaggtatgttctaggtgactctaaatctctaaattggatttcagcacttctcttaattttttcccttatagctagtggtaatatttgctatgaaggtacttagtgtattaataaagtaggaaatttagccagtttaaaaggtctaaattatagaattaaataaattgcaatagtattaattaagggcttattataatttattaactttcatttgcttaataaaatttcataaaaacctaagtagtcttttataaatgtggaaagctagttccttgataataagttaaaatataatgtataactagtcaattcataatgttactgttttgagattgtcataaatctaagaggtgatttttatcattaaaagcattttgatgaaaatgttccatgctcgtgttactttattctactttttgtattagtatctaacaaactgaactttcatgttgtattctctatgtgtaaccagttttggctttcaaataactttttcccttagttttctttgtactgactttgtcctttgaataatatttttcttatattccatgaaatggtttatttagatgaactacagtgtcggtatttggtaatgccaggataaagattttgtgtctatgagttgtctcacaagatagcttaattctgctgagcaaaatatactttagcaacataaagattgtgaacttggttatgctgtaagatgtgattcttgttatctagtcaaatttaacaagttgttacagaaaacaatttacatttttgagtgtttatctaagtccaggggtcttttcttctcctttattttgtgcatgcatgtgtttttttttgttcattttttattcacaaaatgactttagaaataagttataaaatgattaggagaaagaaaatgacagtatgatttcctgtttactacccagcagcaagctttttccatagagagtaaagagctgtggtagtgactgtgtaaaccacatggtacattagagaagctcactttgactgttgaggttatacatggagagtaaacataagaaaattaaatttattttctaatggtattgaaactctgagatttaactaatgtatttacaatactgtgaaattagcttttcttagagtttcaatgtattatttttgaaagtttcaaccaatagaaccacatggagcaaaccatcaaataagctttcatatacattttgaagttatttatagaattgtaaagttgctgttacacacacacttgctccttctcaatcaacaatcaagttttatgtattgattttgtaagttgaagtctcatgaaattcacttattaatgttagtttaaagattttctacatagatggtcaagttatctgcgaacatccacagttctgctttttcctttccaatctttatgcctctgatttctttttctgatcatatttcactggataggacctccagtacattgttgaataaaagtggtaagagtggatattttgctttattgctcatcttattgggaaagcatttattttaccacttaagtatcacattagctgttccttttctgttgctgccctttatcaggttgaaaaaattccctactattcctagttcggagagtttttatcatgagtggtggtcagttttttctaaagattttactgcttctattgaaatggtcatttgattttttccttttattctcttaatatggtgaattactttcattgctggaataaattccatttggtcatggtgtatttaaaaaaatatattaccaatttggacttactgatattttgctaagggttttttgcatttacaagagtattgatctgtaaatttcttttcagttttgatacagtggttatgctggattcataaaataggttgggaagcacttgtttctcataaggtggattgtattttttcttcagtgtttgacaaaatgtatcagtgaagccatgtgggttggagctttctttgtgggaagatttttgatgataaatgagatttctttagatacaaggctatccatattttctatttcctcttgtgtcatttttggtaaattgtattttttaaggatttccttttcatccaagatgttcgtctaagttactgggtgcaaagtttttaatattcccttatccttatttttatttttttagtagagccaagatttgctccattgcccaggctgaccttgacgtcctgggcacaagtgatcctcccaccttggcctccccgagtgctgggattacaggctcccttatcttttgaatgtctgtaagatcttagcgatatctccttattaaatcctgatattggtaaattatatacttgctctcttttttcctttgataatcttgctaggagtttattcattttatgaaatcttttttttttttttttttgagatggagtctcgctctgtcaccaagctggagtgcagtggcgcagtctcagctcactgcaacctccgcctcctggattcaagttgattctcctgcctcagcctcctgagtagctgggatttacagtcatgtgccaccatgcctggctaattttctacttttagtagagacagggtttctccattttggtcaggctggtcttgaattcctgacctcaggtgatccacccgccttggccttccaaagtgctgggattacaggcctgagccactgcacccagccaactttttaatgattttttaaatgatccattatgtggtcttatcatttggtctgtctgtattttattttttgggggtatagtgttataaatatctagtcaagatgattggtaatgggtcatagtcttctatgtcttcactgactcgttttttttttttcctctagttctgtgactcagtgttatagtctccagctatgattgtgaatttatctgtttctctctttagtcctacctttttaattttatatattttgaagctctattattagaggcttttttgttgttatatcttcttgatgtattgcttcttttatccttatgaaatgttcacctttttctcaagtgacactctttatcttggaattcagtttgtgtgatattaatatagtaactcctgattttttatgattagtgtttgcatcttgtatcttttcaactgtcctattatatttagtctttgttttgtatttaaactgtttctctcgttgacagcatatgtttgggtcgtgtcttttttaaaaaatctaatttgacaatctttaccttttaaatgggagtttttaggccagtcatatttaatgtaattattgatatgattgagttttctgtttgtgtcatgtgttctttgtatcttttccctatttttttgcctttgttaggatttagtatcttttcagtatcctattttatctctcctattggcttgttatttatgtgtcttattttaaagcaatttaaaaatttatagttaatgttattgttggtgtggttgaacttaggcatactgttatttttttaaaaaaatacctctcttcatactttcttatcttcttttgagttaattgaatttttttcagtatattccactaacagtatgcattctcaacaggagtggtaattctcctatagggcaatcataggttcttggaaaagggtacagaatatccttttatattacaattgtttgtggctctccaatcacattatataaacagatatatctttggtattaaaatttcttggtggggaccgaagtgatttagagggagttttctaaagaggctccttaggtgagccaaggaaaaacctttgataaacagttctgtcatcattttagcttgcattgcttttttaggtattgttctaaggtagtggaatacagaatacatgtacaggtttgttatatggataaataacatgttgtaggggtttggtatacagattatttcgtcattcaggtaataaacatagtaccctataggtagttttaagatcctcactttctcccactctccaccctcaaaatacatcctcagtgtatactctctaaagtacaaccagggtgattttggtccccagaggacatttggcaatgtctggagacatgtttgaaatgatgtgggggtgggattgctactggcatctagtgggtagaggccagatatgctgctgaatgttctataatggacggaatagtatcccatggcaaaaaaatttccagttcaaaatgttagtagtgctgaggttgaggaactctattcttgagattacaatattcattcttaatttattacagtctatgtagggttagtattttactgctccatataaaatataagactcttccaatgctatatttatatttgcccccacttctgagagtgccttgtgctgttgttctcctgtatagtatatcaccatgttataaactctgttataatgttatatattttttgccttattcatacgtcttttgaaaaagagcaggaaaagtatggtcatttacacttatatacctattttcagttaaaaaatttttttcctatagatttcattttctgtctgatattttttttcacctgaagaacttttccttagcttttttttttaaacttttagtttccagaatacattattggttagatgttatatgggtaaattgcgtgttgagggggtttggtatacagattatttcgtcatccgggtaataagcatagtaccctataggtagttttaagatcctcacctttctcccaccctccaccctcaaaatacactctcagtgtatactctctaaagtacagtgtgtactcaaatgtgtactcaatgtgtacacaaagtacaccctcagcgtgttcttgaaacatcgagtatacattgtccatgtgtactcagtgtttacctcccatttacacgtgagaacatgtaatatttggttttctactccttcattagtttacttaggtaataccctccagctccatccatgttgctgcaaaggacatgatctcattctttttttatggctgcataatattccatggtgtgtatgtaccacattttcgtctgctgttgatgagcatttaggttgattctgtgtcttttctgttgtcagtagtgctgtgatgaacatatgtgtacatgtgtctttatgatacatgtatgatttatattcctttggtcatattttcaataatggaattgctgggtctaatggtagttctgttttaagttctttgagaaattgctgaactgctttccacagcggctgaactaatttacattcccaccagctatcaaattagaatcctgtacaatttaaaaaatccttcaaaatgaagatgagcccagccacagtggctcaaattagaatccaaactatcaaattagaatcctatatacagttttaaaaatcgtatatgtggccggctaatttttaaattatttttttatagagatggagtctcaatatgttgtccaggctggtctcaaactcctggcctcaagcgatcctcccaccttttcctcccaaagtgctaggattgcaggtgtgagccactgtggctgggctcatcttcatttttgaaggattttttaaattgtatataggattctaatttgataattgtggtttttttatcattttaaatatgtcatttcattttcttctggctgccatggtttctgatgaaaagtcacctgttgttattttgacttgctgtttccttatatagtcatgtgccattgatatggttaggcttcgtgtccctacccaaatctcatcttaaaaattgtaatccctacgtgtcaagggagagaccaggcggaggtaattgaatcacgggggcagtttcccccatgctgttctcgtgttatcgagttctcatgagatctgatggttttataaggggttcttcccctttaactcggccttcctgccgccctgtgaagaaggtgccttcttccccctcaccttatgccatgattgtaagtttcctgaagcctccctagccatgctgaactatgagtcaattaaacttctttcctttgttaattacccagtctctggcaggttttttttgtttgtttgttttttgatatggagtcttgctctatcacccaggctgaagtgcagtggtgtgatcttggctcactgccacctttgcctttcaggtacaaacaattctcctgcctcagcctctgggactataggtgtgtgccactgtgcctggctaatttttgtattttcattaagcgacggggtttcaccatgttggccaggctggtctcgaactcctgacctcaggtgatccagccatctcagcctcccaaagtgctggatttacaggtgtgagccactgcgcccggcctcaggcagttctttatagcagtatgaaaatggacaaatacagccatataatgatgttttggtccataacagattgctaatgatggtggtcccataagattataataccatatttttactgtaccttttctatgtttagatatgtttagatacactaatacttaacatgtttcaattgcctacagtattcagtacagtaacgtgctgtactgagatctccctctcactttccagctattttggcagctctgaactctgtctcttcaaactagtaagactttctgagttctagccattccactctagtttcaaggaatgggagagcgccttgagtaaaaagccacatcagtgcgaatctcatttgtagctcccttctttacagtcagtttccttcaatttctgcctgcttttgcagcttttctactgccttcaaattgtcattctttatattttatacagagtttataattttatatatagaagggttagtctgatacaagttactatactactactggaagtgaaattttgctaggtatgtgttttaatgtatagatacacaaatttatttaagcttcatgattcacatactgctgtattccaatttaattcttaaattatgaggagaagaagtttgtgagaagtaggagtacagtttataaaaatttatcagaaattatgagtactacaagttatgaggtgtatgaaactaatagtttaaaccgagtttgaatcacttatctagaaagatagctttttcttaagctcatatgtagaatttcaacctagaagtgactttaaaagttatctagtcttttttttttttttttttttttttttttttttttttttttttttagttttagggatgagtctttttatgttgctcaggctgatctccaactcctggccttcaggagtcctcatgcctcggcctcccaaaatgttgggattacaggcaggagccactgttggtggcctctctagtcttatatccattcatctgacagatttcaaaactgaggccatatttcaagttaggtatagagccaggattagtacctgagatttcttttttgctgatcttagatacttcagattttgtttctttcttgacgtttaggaatagattgaatttcttcaaaaaatattttgtatcttgttgggggggaggggctcagaagttttgggtggaaagatttaaaatcctctgagtatggaaaagggggagtatcttccaccttgtggaatcctcacactgtgtgagtaatattattcactgctctacttcccagtggagaatgcagagaagctgtacctcttgaacttgtgttttctctctttgagtaactgtttccatagtttctataccctttgacatagagaaactttctttagtttgtgttcgcattttataatcaatcacattaccttttgatgtgtgatagccctgcacctaccactaattttctgtgtttttggttatgctagtttttcggcttggcatgttttttcccctctgtctttttaagtgaaaaatctcctgtgtccttcaaagccaaattatttacccagatcatggtcttacaaaattagaatgatttcttttgtctgtataatattgcaacaatttcctgtcttgacctccttatgactttctattgccttgttattacatagatctgttatttctcctttccattgtaacctccttgacagcactgtgtctaatacaactttatattttgtacagtttgtaattttccttctgaaatacagttcaccattattttgagcacggtagtctcttaatcagtatgtgatacaaaaatggggaagaaaataatgattctagaagttcagataacagtatgtcacagatattagggcaaggaactagaactgggacagctgaggcaaggtaggaaacacagactagatcacagttatgaaagcagcctaatgttcaggagagagtttcggtaagggcagcactggaattctagaaccatgttgtatatctgtcaaatttttgtgtagcaaaacagaactgacagggtaggaattggtagatttgactgaatggttattcctgacaaagatagtgggttgtaccctgattgtcccagaatggactagtaaataaggtatctaaattaggtaagtagaataaaagattgggaatattgtagtttttatggtttggaagattaatgcgtattttaagggtaatttttgctttactcttagaacggtaaagtacctctgatttcatgaaacctaactttctaagcctataagaagaatcttttctactgtgtttctaatggatcacttatcttagatattgtgggcaactaaagttgcactgtatctgtttcattatttaacagctctgagcactggtggtctttgtttgccctcctgagcaatataaaacaagttctgttttccagtttataggccttcggatttttcgagattgctatcctgtcttccctaaaatccctctttctaagcaaagtgctctcaattctttattatgtttataattattataagacacggtttgcagccctctcatacacggtacagttgtcccccagtatccacggggggttggttccaggacttcctggagatagcaaaatctgctgatgctcaaatcccttacataaaatggtgtagtatttgcatacaacctgcacacaccctcctgtatgctttaaatcatctttaaattacttacattacctaatccactgcaaatgccatgtaaagattctatgtaagtggttgttacactgtcctgtttagggaataatgacaagaaaaaagtctgtaagtgttcagtacagatgatttctttttcctgaatatttttgatctgtggttggttgaatccacagatgggaaacccacagatatggagggctgactgtattggtatcttactgtggaaatagctcagtttgtcaatgtttctcttacagcgtagtgcccagaagtgaatctgttactgcagatgtgatcggtgcagggaaaaagcacagtgagactgttagcctcttctcatagtctgtcactgtaggggccttcggtgcgattaaaggctgtagccactttttctcagttttactctttaagggaacttttattatgttttgattatataaatcatttataaagtcagtttattgtccagatgttaccagtttacattcctagcactaatatgtgaagggttctactttcttataccgtagccattgctgggtgttactctttctagtttttgccattgtattgctgttttattttacatttctttgttactgaggtttaacgttgcttaaatgaattattattcttgttcttagttaagttttaaatatgaggcctatccttaaacatgtataaattttatgttcttatttattggtaagagctttttgtgtattgagaatacctttatttgattaatcttttttgttgtgaatatttttctagtttgaatataccttttaatgttacggtatatttttgccttgtaaaattttttagttgttaagtagtttaatatgtcagacttttcccattcaaggagaccattgaggtcatacttacaaactcttcacctttttcctttgagcatcattatgatgaaaacattttgtattatctaagtaatatattctcctttaaaagagccaagcagtaaatatatagggtatcgtgtgattcctttcttccatattctttctcagaaataaccactgccaagtatgtcatgccaatataaagctaaaatttttaagaagtacttaagaactagaagaaaatgccaaattataggtagtattatccccttgtcaagagattcggattgaagagattaggcagggataggaagggggataattaagaaaatgagacttttacactttattctgtgtaaacattgcatctttctgttttgcctcacattacataaatgataccgtaatcacttactatgtcttggagatttatccatgccatgggaacctggaactcgaaaaaagtgactagtttgacttaacttgctcttagtgaatctattcttacttcttgtccatctacaatttcaaagtacatctgatgcttgaaacaagactagagttaggggcacagaccacctgcacggtcaaaaatgcgcaaatcacttttgactccctcacaacttaactactaatagcttgctgttgactggaagcctcgcggataacataaacagtccattaacacacattttatatataatgtactgtatttttacaatgaagtaagagaaaaaatgttattaagaaaatgtattatttttcatcaaggggaagtggatcatcataaaggtcttcatccttgatgtcttcaagtcaagtaggctgaggaggaagagaaagggttggtattgctatctcaggagtggctgaggcagaagaagcaaatccaggtacaagtggagtcattcagttaaacccatgttattaagggtcagctgtacctatatatgtcatttgagtgtaatggttaagaggatgggactgaattccaaatcctggctttgccatttattagtgtctgtgggcacaatccttaatctgtcttaaatttctggtctgtaaaatggagatgataaaagtgcctactttatatgggtataggaatccaagctcataatgtgtgattagctcttatcagactgcatgggacatattaaatagtaaataactatttaataatctgtagaatattactagtttgacatcaactttactaatatttagtatttaactcacccattgtttacttctatatagacagtcgggatacttgcccttttaagttttgttgttgttgttgttgttgttgtttttaaaacattcttcagatgcttttacattgatcaaaaatcactgatgctgaccggaactcaaagtgataagctacttgctaactatcaatatcaatgttttcattatgatatttctctttggagaagaccagtgtaaaagaggagttgatcagtattcctttcctgtcaactgaccttcatgttgtactctcttcctcaggcttcatctttcttaatttaaaaattcatgtttgtctgtagtaattacaaaaattcattataggatttccaagttctaatagttgctttctagatttggtcttcattatgatactgctcctatatttttcaacactttttcttaaatgaaatagtactaaagcgacaagtacgtacatacatttttttcctctcactcaggattgggtaagaccaaatagtcatattttaattctttggttaaactttatgattaaaaatgcttgctgtgtaagaatactaatttccttatcttacacagttaggagctaagacatttccatctaaaattcctgggtcaagaaatagaggcttaagtgtatttttttaatgtggaatacaaaccagtagaaaagctaaaaatgaaaatgaaagtaacaaaaattgggaagaaagggcagagggtatcttaatttctcaatctttatagtaagaagtcatttgatgtggttaataggtgataaatcaagaaacatccacaatgccaaaaatattaaaagtggctgtttatgagaagtggaatggagaatgaggtcttgtgtatatgtggtcctgtgtgtatgggaatggtggaagagatacttttatttttgagtcttacatgcttttatgtactactgagttatcactttctacctgtattagttaataaaacatcctacaggattccagtttataaagataaaagcatagttttatatgttgatatatgtataaaaatgaattggatggaaatataccaaaatataataagtggttatttctgggtattgagttttttccttccttatattattttgtattttgtaaaatttctgaaatgcatgtattttattaatttatataaaaattgttaagagaagttatttaggacttcctaacatttaatttaatttgtcccgggtttaatttgttgtcacacttacttggcatcagaatgtttgctttttgtttgtacaattactagaacttttttaaattaaaggaattgtacatcatagtctttgcatgcttagtaaggttggcattctgctgaaaataacagaaaacctagccaacagtaacaacaaaaaaggacattttctttttttccacttaagggtataggtgggcggttatagttagcagatcaggatagaatcatcagagattgaagctatctctggttcatcaccgttagcttgtttgcttttcatatacttgttgcttcaaggtttcaagatggctgtagtaatgggcattacatctctgttcaaggcagtcaaatgggagatggctggtgtcagccacactgtcccttatattaggaatgcaaaagctttctccgaagctcgctatcagacttacttttccagaactgggttatgtgccactcctagctgttagaaggtgaatatttggctttcaatttctgtagcgggagatggcaagagtaaaggggtttggtaattgatgttgtgttagacaaccagcagtctgctacaaaaagttttggcaaatgtaactaatgtttgtacttcagttctcaatcagatacccaggagagacagtagcctttctagaggtcagattgaaaatttgacataccaacattctctaaaatttactcttgtcgggtattattctgaaatgtagccattttgtctggtcctaggagtactaggtttatgctcctttcttttttttttcttttttgagatgaagtctcactctgtcgcccaggatggagtgcagtggtgccatcttggctcagtgtaacctttgtctcccgggttcaagtgattctcctgcctcagcctcccaagtagctgggattacaggcacctgctacaacacctggctaatttttgtatttttagtagagatggggtttcgccatgttggctaggctgacctcgaactcttgacttcaggtgttctgcctgccttggcctcccaaagtgctgggtttacaggtgtgagccaccgcacctggctatgctcccttcttaaaaaaaagatagttttggtatcctgaagtgataatgaattatggggtacgtttggtaaattatttcaattagttttattccccttgtagaatccaaattcctgtttgtagccggtaatctgaggattgtgaatttttaatgtaacaagtcaattatataagggttttcattgttgtttttaagttacagtgtgcaatgaaacggatagtcacaggttttacagcttatgactccacctctaccaacccaaataatggtcagccaaaaatatccaaattacatagtttgaagtattaggtgttacagttacttggattgtcttaaagccacatattttaatggttattatcccttattttcttattcctctgtcactgactccttttaaaatactttatgatgcagatttgaatagttgtcattgtgatttttttaagttctgggattcatgtgcaggacatgcaggtttgttacataggtaaacgtgtgccatggtggtttgctgcacctgtcaacccatcatctaggtattaagcccaacatgcattagctatttatcctgatgctctttctcccctcatccctgacaggccacagtgtgtgttgttccactccctgtgtccatgtgttctcattgttcagctcccacttagaagtgagaacatgtggtatttggttttctgttcctgtgttagtttgctgaggataatggcttccagctccatccatgctcctgcaaaggacgtgatcttgttcctttttatggctatatagtattccatggtgtatatgtaccacattttctttattcagtctatcattgatgggcatttgggttgattccatgtctttgctatcaggaatagtgctgcaatgaacatacctgcatgtatctttatcatagattgatttatattcctttggatatatacccagtaatgggattgctgggtcaaatggtatttctggttctaggtctttgaggaatagccacactatcttccacaatggttgaactaatttgctttcccaccaatggtgtaaaagtgttcctctttctccacagcctcactagcatctgttgtttcttgacattttaataattgccattctgactggtgtgaggtggtatctccttgtgattttgatttgaatttcttgaatgatcagtgatattgagcttttttttttcatgtttgttggctgcatgtatgccttcttttgaaaagtgtctgtttatgttctttgcccactttcgaatgaagttttttttgtcttgaaaatttgtttaaggtctttgtagattctgaatattagccctttgtcagatggatagattgcaaaaattttctccctgtacattgtctgttcactctgatgatagtttcttttgctgtgcagaagctctttagtttaattagatcccagtcgtcaatttttgcttttgttgcaattggttttgatgttttcatcatgaaaagtttgcccatgcctgtgtcctgaatggaattgcctagattttcttctagagtttttatagttttgggttttatgtttaagtctttaaatctgtattgagttaatttttgtatatgatgtaaggaaggggcccagtttcaattttctgcatatggctagccagttctcctagcaccatttgttaaatagggaatcctttccccattgcttgtttttgtcaggtttgtcaaagatcagatggttatagacctgtggtcttatatctgagatttctattttattccgttggtctatgtgtctgttttggtaccagtaccatgctgttatggtttctgtagccatgtagtatagtttgaagtcaggtagtgtgatgcctccagctttgttctttttgcttaggatttgtcttggctattcaggctcttttttggttccatatgaattttaaagtagttttttcttattatgtgaggaaagtcaatggtagttcaatgggaatagtattgaatctataaattattttaggcagtatgaccattttcacgatattgattcttcttatccatgagcatgggatgtttttccatttgtttgtgtcctctctgatttccttgagttctccttgaaaaggtccttcacttcccttgttagctctattcctatgtattttgttctctttgtagcaattatgaatgggagttcattcatgatttggctctctgcttgtctgttgttggtgtataggaatgcttgtgatttttacacattgattttatatcctgagactttgctgaagttgcttattagcttaagaagcttttgggctgagatgatgggattttccagatatagggtcatgtcatctgcaaacaagacagtttgacttcctctcttcctgtttgaatacacttaatttctctcgcatgattgccttggccagaacttccaatactatgttaaataggaatagtgggagagggcatccttgtcttgtgccagttttcaagggaaatgtttccagcttttgcccattcagtaagatactggctgtgattttatcataaatggcttgtatttgagctatgttccataaatacctaatttattgagagtttttaacattaagggatgttgaattttattaaaggccttttctgagtcttttgagataatcatgtggttttgtttttagttctgttgatgtaatgaattatgtttattaatttgcatatgttgaaccagcattgcatcctgggaatgaagctgacttgatcgtggtgagtaagctttttgatgtgctgctggattcactttgccagcgttttattgaggatttttgcattaatgttcatcagggatattggctgaagttttctttttttgtttcatctctcctgggttttggtgtcaggttgttgctggcctcataaaataagttagggagaagtccctccttttcaattgttgggaatagtttcagaagaagtgatactagctcctctttgtacctctggtagaattcagctgtaaatccatctggtcctgggctttttttggttagtatgccatttattactgcctcaatttcagaacctgtattggtctattcctggattcagcttcttcctagttcagtcttgggagggtgtatgtgtccaggaatttatccatttcttctagattttctagtttatttgcatagaggggtttatagtattctctgatggtagtttgtgtttctgtggggtcagtggtgatgtcccctttatcattttttattgaatctatttgattcttctctcttttcttctttattaatctagctggcgttctagctattttattaattttttaaaaaaaccagctcctggattagtttttttttttttgaagggtttttagtgtctctctctccttcagctctgctctgatcttggttacttcttgtcttctgctagctttgtggtttgtttgctcttggttctctagttcttttagttgtgatgttaggttgtcaacttgagatctttctagtattttgatgtggtcatttagtgctataaatttccctcttaacactgctttagctacatcccagagattctggtacattgtctctttgttttcattgatttcaaggaacttcttgatttctgccttaatttcattatttacccaggagtcattcaggagcaagttattcaatttccatgtagttgtgtggttttgagtgagtttcttaatcttgagttctgatttgattgtgctgttgtctgagagactgttaggatttcagttttcctgcatttgcttagaagtgttttacttccaattacgtgattgattttagagtatgtgccatgtggcaccaagaagaatgtatattctgttgtctttgggtggagagttctacagatatctatcaggtccagttgatccagagctgagttcaggtcctgaatatccttgttaattttctgtcttgatgatctatctaatattgatggtggggtgttaaagtctcccactgttattatatgggagtctttgtctctttgtaggtctctaagaacttgttttatgaatcttgatgctcctatattggatgcatatatatttaggatggttagctcttgttgatttaatccttttaccattatgtaatgcccttctttgtcttttttgatctttgttggtttaaagtctgttttgtcagaaactaggattgcaacctctgctttttactgctttccatttgcttggtaaattttcctccactcctttgttttgagcttatgtgtgtctttgcccatgagatgggtctcttgaatacagcacactgatgggtcttgattgtttatgcagctagccattctgtgtcttttaattgggacatttggcccatttacatttaaggttaatattgttatttgtgaatttgattctgtcatcatgatgttagctggtggttttgcagacgtgttgatgtagctgcttcatagtgtcattggtctttgtatttcagtgtatttttgcagtggctggtaatggtttttccttttcatatttagtctccctttaggagctcttgcaaagcaggcctgatagtggtgaattctctcagcatttgcttttgtgaaaaggattttatttttccaaactaagcctatgaagcttagtttggctggacatgaaattctgggttggaaatttttttcttaatgttgtatattggtccccaatctcttttagcttgtagggtttctgctgagaagtctgctgtttgtctgatgggcttcccttgtaggtgacctggcctttctctctggctgcttttaaccttttttctttgagttttgaccttggagaatctgatgattatgtgtcttggggttgatcttctcatggagtatcttactggggttctctggatttcctggatttgaatgttggtctgtcttactaggttggggaagttctcctggatgatatcctgaagtatatattccaacttggttccattttccccatctctttcaggtaccctaatcagtcatagatttggtcttcttacataatcccatagttctcagaggttttctttgttccttttcattcctttttctctaatcttgggaagatagtcttcaagctctgaaattctttcctccacttggtctctttggctatttatacttgtggttccattgtgaagttctcgtgttgtgtttttcagttctattgggtcattatgtttctctctaaactggttattctggttaacagctcctgtgatgttttatcatggttcatagcttctttgcattgggtttgaacatgctccttcagctctgtgaagtttgttattacccaccttctgaagcctacttctgtcagttcatctaagcgttcgtctagttgagtgcccttgctggagagatgttgtgatcatttggaggagaagaggcagtctggcttttggggttctcaatgtttttttcgttgattctttcttatcttcatgggtttatccagcttcgatctttgaggctgctgacctttagatggaatttttgtggggacttttttgttgatgctgctgttgttgctttctgttagtttctcttttaacagttagggctgggtgtggtggcttacgcctgtaatcccagcactttgggaggccgaggcaggtggatcatgagatcaggagatcgagaccatcctggctaacacagtgaaaccctgtctctactaaaaaatacaaaaaattagctgggcgtggtggcatgcgcctgtagtcccagctactcaggaggctgaggcaggagaattgctcgaacctgggaggcggaggttgcagtgagccaagatcgtgccactgcactccagcctgggtgacagagcaagaccccatctcaaaacaaaacaaaaaaacaggcccctctcccgtagggctgctgcagtttgctgggggcccgttccagaccctgtgcgtttggatccctcccacacctggagatgtcaccagagggggctgcagaacagcaaagatggctgcctactccttcctctgtgatttctgtcccagaggggcaccgacctgatgccagcaggaatgctcctatataaggtgtctggcgacccctgttgggggggtctctctcagtcaggaggcacaagatccaggacctgcttaatgaaatcgtccagctgtcccttggcggaggggatgcactgtgctggggattgtcacactcctctggactacctggattcctcagagccagcagggagaaagacttaagtctgctgatccacagagacagctactgcctctccccgcaggggctgagtcccagggagagcagagttccattcctaaacccctgctggagttgctaaaattcctgcagggaggccctgcccagtgaggagggatgggtcaggatctggcctgaagaggcagtctggccacagtctgccacagccgctgtccttgctgtggagaatttctcctgggtccaaaccgtccagtctccctggcaccagcagggaaaaaacggccaactggagctacagtgctggctgctgcccctccggagctcagtcatcttaggcagcaggcagctgcagtgatggctgctctcccttccctggggagcttagtcgtcttggacagcaggcagccgcagtgatgacggtggcccctttccctgggaattcggtagtcttaggcattctccagttgagtgaccgccaaacatctgcacagctctgcgcttggcacgcaaggccctggtggcatcggctcatgagggtgatatcctgacctgacccacgggttgcacagatctgtggaaaaaacatggtttcctgggcagggtagcacagtcactcactgcctcccttggctgagggtgggagctcccctttctccattgtggctcccatgtgggccattgcatcacccttcttttcctcactctccataggtcgcgccaactgcctagtcagtcccatggagagaacctggatatctcaaagttgctggtgcaggattcactggccttttttgttcttggtgggagcctctggccacagcgatttctatttggccatcttggcgcctgtcattgtgatttttatggacttctgcataacatattgctgaataaaattatcaaattagacttgtttaaaaaatttaagtcttaattgttttcatcaattgttgggtaaactttatgttaagttttcttaccagttagagatactatatttattcaacaccaagccattttttcttagtccaaaaaagtgttattgccttatacttttgaggagtaaaaaattgttcttgtaaatgagcatgtttgtatctagtttttggacaaactaatttctttatttacttctagcgaaatatgtgccagaaactgggatgtgtgagatactgagatgaagaaacacttgccctcatggagtctagagtctagtggggaaaaaagacttcaagatgagtcagtttcctcattgataaaatgggggtaatagtacctatctacctcatgaaggttattgtgaggattaactgagttaaattatgtaataatgacttagaattttgccaggtacatagtaagtgttccataaatgttggctgctgttattatttctgcaaaatcgagatttgtataaagtgctgtggaagtgcagactaagcaggggttgactttctagaaagttaggggagtgatccagttttaatctgctctcaatcctacttcgtagtttccttgtgcatagtaagtcctcaaaaactgttgaatgaatgaatgaagcaaagaatgagaatatacttacctaagtgggattgttaagacagcttctttaaacatcttaaaatagatgtcaataaaatttgaagatgcaatattacaatttagcatttatcttccatgcctgagttaattcatggatagaattcagaatattttttcaagtaagtaaataatggaagatagtttaagaaattaaaaagctattactttcagccaggtttttgaaacaagctgggttttcagactgtttgtttgtttgcttatttatttatttgagacagagtctcactctatcacccatctggagtgcagtggcacgatcttggctcactgcaacctctgccttctaggttaagcaattctcctgtctcagcctcctcagtagctgggactacaggcatgtgccaccacgcctggctaatttttgcatgtttagtagagatggggtttcaccatgttggccaggctggtcacaaactcctgacctcaagtgattcgcccacctcagtttcccaaagtgctgggattacaggcgtgagccaccacgcctggcctcaaacagtttaaaatattattttctagcagggtcttgaaatacaagtatcttatactacagactacagatattattcatatattttggcagtgtcgtgttgttgtagatcattatagctacatcagttaccaatgctgtgtaatggactaccccaatgtttattgccttaaaacaacaatttatctttttttcatgattctgtggtttgagtccatggttctcttggagatgtcacctagagtcattcctatgggtgcacttagaagggtagctgcactgaactaaaagatggtagaatggtttattcctgtatttgggtccttggtgcttgaatgttggctcagagtgcctcagttcgcctccatgttgcctctctctagcaggtcatcctggattactttagagcatgttactaacttctaagaatggaagccaccagttcttctaaagactagttgcagaagtggcagatcattgttccaatacattttactcgtgcaacaagtcacaagattcaccagctcagattcaagaggaggggaaatggagtccatttcctcataggaagaatgataaggaatttatggcctcctgtaatccaccatggtagcatagcaccttattatctttgattagacatttgtagcctatcctccttatctgccctttctccctttataagttttatgttttatcttttttcccttaattttccatgaatgtttgtagtttgtcttctgtttcactgattcagatttctattctcttgatagaaactatttctttctacggtggatttttgttctgcctttgtgttgttttactttgcctgtatgcttttcttatcttttctagtttactagtcatgtatcctacattttagatgccttttcttgatatcatttaattttaactttatgtaatctatttaaaaatttttctcagaatataaataatagttgcagtagtagaactaaaggtagtgtcagaaacagtagggtggtgcctaccatgttatgttagtgaccctgtgtctttggtttagggatctagtggaacatgaccagctatccccttttgcctgagataccctcagcttttgatcatcactactgagtttttacatgttttagtgaaactatgaattactcaaatgttgtgatttaaaatgtggaagataagctgttgatatgctagttcaaaaagcaattcaaactgctatgtgacctagaaaaacaccatcttgactcatctaaaggtggaatggccattaagctgctattcccaccagaaatggaattataagccaaaaactatcatgaacttttccatcatatgagcaagccatagtagaaaccaagtagggtcttctgatgactacatccctggctaacatattgtctgcaatttcatgacagaccctggtgcagaaccacctagctaagtcactcctttcccacagaaactgtataataaaaccttattgtattgaaaatactaattttgggggtaattatagcaatagataatagagattttgagcagggcacggtggcacacagctgtaatcccagcactttgggaggctgaggtgggtggatcacttgagctcaggagttcgagatcagcctgggcaagatggtgaaacctcatctctacaacaacaacaacaacaacaactagctgggtgtggtggtgcacacctgtggtcccagctacttgggagactgaggtgggaggatcgctatctctaagttcttgagcctgggaggtgggggttgcagtgagctaagattgtgctaaaagtgacagaatgagatcctgccaaaaaaaaaaaaaagcaatatagattttggtatcagagtggttttgttttgttgtaacaaaaatgtagtactgtcttttgaatttggaactggctacaagcttgaaggattttgaaacattagtgaaagcatgtagagccttgagttgactgttagtagaagtttgagtagaagtagaagcctttgagaaggctttgctcgagggcttaaaggaaagtgagaaaaatattaacggaaacacgaggaaaggggatccttgttctgtggtggcagaaagtttagcaactctgtcatgtgcaataagatggaaaatagaaaaatgtaacctatgaatgaagtgatctagctaaggagatttcttatcagaatgttgaagaagctacctggtttcttcttgctacttatgtataaaatgtaaaaggagagagataagcaaaatgaaatactattaaagaaaaaagagcagggaactgtagggcttgaaaattcccagcctcttcgtatgatcattgatactaaaattaagaaatgggttctagaaaagatccaatctaggaccctcatgggaaaacttgatctacagatcaagctgaagatgtgactttaatgtcctttaagaccttagaaatatccaggtgttttgaagttgtgactttaaagtcctttaagatcttagaaagatccaaagtgttgcctcaaaacacctgctggatttcagaattgctatgggtcagtgactcccacacacctcctaattgtcctttgtttgaacaggagtgctgatcgtagttttgctatgccttatgcatcactggtcttgaattcctgacccaacagaaactgtgagatcataaaggcttattgttattttaaagtgctaagttttgtggtaatctgttatgcagtgatagatagctaatggagtgacagttaagttgaatttgggaggctgataagatggcagcctggcaacagaggcaggtagtggggttgggggagaacatttgatgcagagtaaaaataagatttgtgattccaaaggtcatgaattgttaggatcatgggatgactgtgtatcattggaagatgtaagctcaagaatattcatgaatatgtgttctattaaacattggtaagaagagttttctgaccaataattatttctaggaactacaaaattttatatgtagaatgaggaagaattttttccatttgttttattcttagattgtaaagttatgtttttatagcttatattctcaggttagtttatttatattgtaaaagtatttaaaataaatgttagatataatagggttctatacttaatctaaactaaatctcttcaagataagcccctctatcaatttactaatgtttacagtgattggaaagaagagaatattactttcccttttaactttttattttgaagatttaaaaatatatagaaaagctgaatgtattgtgttcatgagcacaaaaatatccttaacattttgtcacatttgctttacatatatttaaaaattttattttgtgacctgatctcactctgttgcttaggctggagtggatcaaagcttggtgcagcctctaactcctgggctcaagcaatcctcctgaatgagcctcccaggtagctgggactacaggtgtgcaccaccacctggctaatgttttaatttttaagagttggggtctcactagattgtccaggctaatcttgacctcctgggctcaagtgatcctcctgccttggcctccaaaaatgctgggaatacaggtgtgagtcactgtgcccagtccatatactctttaaaatttttaattgaatcatttgaatggaagctgtagatatcactttatctctaagttcttctagcatgaatttccaaggttaggctattcataatcacagtatcattaacacaactaagaaaaatcatatttcataattatgcctaatatggtagtccataaaagtttataaattttttaaaatccagggtccttacactatatttggttatgtcacctgagactgttttattctagaaaataaaaatctaacgttatattgctttctatgacactgattctaattttttttttattatgtactttttttcttttttttttatttccataggcgtttggggaacaggtggtatttggttacacaagtaagctctttagtggtgacttacgagattttggtacacccatcacccaagcaatatacactgaacccaattttgattctaatttttttgagggttttatatcacttgttttgtgaatatcccacattctgaatttgtccagcttttcctcattgttagattcaggttgaaccttttttggtgagaatactgcatacatgatacatacttaatcaagaaggtgactgctggatctcttcactgtaaagatatatttttctctttttttttatactttaagttctagggtacatgtgcacaacgtgcaggtttgttacatatgtatacatgtgccatgttggtgtgctgcacccattaactcgtcatttacattagatatatctcctaatgctatccctcccccctccccccaccccacaacaggccccggtgtgtgatgtcccccttcctatgtccaagtgttctcactgttcagttcccacctatgccacctatgagtgagaacatgcgatgtttggttttttgtgcttgcgatagtttgctgagaatgatggtttccagcttcatccatgtccctacaaaggacatgaactcatcatttttatggctgcatagtattccatggtatatatatgccacattttcttaatccaatctatcattgttggacatttgggttggttccaggtctttgctattgtgaatagtgtcgcaataaacatacgtgtgcatgtgtctttatagcagcatgatttataatcctttgggtatgtacccactaatgggatggctgggtcaaatggtatttctagttctagatccctgaggaatcgccacactgtcttccacaatggttgaaccagtttacagtgccaccaacagtgtaaaagtgttatttctccacttcctctccagcacctgttgtttcctgactttttaatgatcgccattctaactggtgtgagatggtatcacattgtgattttgatttgcatttctctgatggccagtgatgatgagcattttttcatgtgtctcttggctgcataaatgtcttcttttgagaagtgtctgttcatatccttcacccacttgttgatggggttgtttgtttttttcttgtaaatttgtttgagttctttgtagattctggatattaaccctttgtcagatgagtagattgcaaaaattttctgccattctgtaggttggctgttcactctgatggtagtttcttttgctgtgcagaagctctttagtttaattagatcccatttgttaattttggcttttgttgccattgcttttggtgttttagacatgaagtccttgcccgtgcctatgtcctgaatggtattgcccaggttttcttctagggtttttatggttttaggtctaacatttaagtctttaatccatcttgaattaatttttgtataagatgtaaggaagggatccagtttcagctttctacatatggttagccagttttcccagcaccatttattaaatagggaatcctttccccattgcttgtttttgtcaggtttgtcaaagatcagatggttgtagacgtgtggtattatttctgagggctctgttctgttccattggtctgtatctctgttttggtaccagtaccatgctgttttggttactgtagccttgtagtataatttgaagacaggtagtatgatgcctccagcttttttcttttggcttaggattgacttggcaatgcaggctcttttttggttccatatgtactttaaagtagttttttccaattctgtaaagaaagtcattggtagcttgatggggatggcattgaatctataaattaccttgggcagtatggccattttcacaatattgattcttcctatccatgagcatggaatgttcttccatttgtttgtattctctcttatttcgttgagcagtggtttgtagttctccttgaaggaggtccttcacatcccttgtaagttggattcctaggtattttattctctttgaagcaatcgtgaatgggagttcactcataatttggctgtttgtctattattggtatataagaatgcttgtgattttggcacatggattttgtatcctgagactttgctgaagttacttatcagcttaaggaggttttgggctgagaccatggggttttctagatatacaatcatgtcatctgcaaatagggacaatttgacttcctcttttcctaactgaataccctttatttctttctcctgcctgattgccccggctagaacttccaacactatgttgaataggagtggtgagagagggcatccctgtcttgtgccagttttcaaagggaatgcttccagtttttgcccattcagtatgatattggctgtgggtttctcataaatagctcttattattttgagatacgtcccatcaatacctaatttattgagagtttttagcatgaagggctgttgaattttatcaaaggccttttctgcatctattgagataatcatggtttttgtcgttgttctgtttatatgctggattactttattgatttgcatatgttgaaccagccttgcatcccagggatgaagcccacttgatcatggtggataagctttttaatgtgctgctggatttggtttgccagtattttattgaggatttttgcatcgatgttcatcagggatgttggtctaaaattctcttttttttgttgtgtctctgccaggctttggtatcaggatgatgctggcctcataaaatgagttagggaggattccctctttttctattgattgggatagtttcagaagaaatggtgccagctcttccttgtacctctggtagaattcggctgtgaatccgtctggtcctggactttttttggttggtaagctattaattattgcctcaatttcagagcctgttattggtcctttcagagattcaacttcttcctggtttagtcttgggggagtgtatgtgtcgaggaatttatccgtttcttctagattttctagtttatttgcatagaggtgtttatagtattctctgatagtagtttgtatttctgtgagatcggtggtgatatctcctttatcatgttttattgtgtctatttgattcttctctcttttcttctttattagtcttgctagtggtctaacaattttgttgatcttttcaaaaaaccatctcctggattcactgattttttgaagggttttttatgtctctatctccttcagttctgctctcatcttagttattttgttgccttctgctagcttttgaatgtgtttgctcttgcttctctagttcttttaattgtgatgtcagttttggatctttcctgctttctcttgtgggcatttagtgctataaatttccctctacacgctgctttgaatgtgtcccagagattctggtatgttgtgtctttgttctcttggtttcaaagaacatctttatttctgccttcatttcgttatgtacccagtagtcattcaggagcaggttgttcagtttccatgtagttgtgtgattttgagtgagtttcttaatcctgagttctagtttggttgcactgtggtctgagaaacagtttgttataatttctgttcttttacatttgctgaggagtgctttacttccaagtatgtggtcaattttggaataagtgtagtgtggtgctgagaagaatgtataatctgttgatttggggtggagagttctctagatgtctattaggtctgcttggtgcagcgctgagtttaattcctggatatccttgttaactttctgtcttgttgatctgtctaatgttgacagtggggtgttaaactctcccattattattgtgtgggagtctaagtctctttgtaggtctctaaggtcttgctttatgaatgtgggtgctcctgtattgggtgcatatatatttaggatagttagctcttcttgttgaattgatccctttaccattatgtaatggccttgtttgtctcttttgatctttattggtttaaagtctgttttatcagagactaggattgcagcccttgccttttttttgttttccatttgcttggtagatcttcctccatccctttattttgagcctatgtgtgtctccgcacatgagatgggtttcctgaatacagcacactgatgggtcttgactgtttatccaatttgccagtctgtgtcttttaattggagcatttagcccatttacatttaaggttaatattgttgtgtgtgaatttgatcctgtcattatgatgttagctggttattttgctcgttagttgatacagtttcttcctagcattgatggtctttacaatttggcatgtttttgcagtggctggtactggttgttcctttccatgtttagcgcctccttcaggagctcttttagggcagacctggtggtgacaaaatctctcagcatttacttgtctgtaaagtattttatttctccttcacttacgaagcttagtttggctggatgtgaaattctggattgaaaattcttttctttaagtatgttgaatattggcccccacactcttctggcttacagagtttctgccgagagatcagctgttagtctgatgggcttcccttttgtgggtaacccgacctttctctctggctgcccttaacatttttcccttcatttcaactttggcgaatctgacaattatgtgtcttggagttgctcttcttgaggagtatctttgtggcgttttctgtatttcctgaatctgaatgttggcctgccttgctggattggggaagttctcctggataatatcctgtagagtgttttccaacttggttccattctccctgtcactttcaggtgcaccaatcagacgtagatttggtcttttcacatagtcccatatttcttggaagctttgttcatttctttttattcttttttctctaaacttctcttctcgcttcatttcattcatttgatcttccatcactgataccctttcttccagttgatcgaatcggctactgaagcttgtgcattcgtcacgtagttctcgtgccatggttttcagctccatcaggtcctttaaggacttctctgcattggttattctagttagccattcatctaatcttttttcaaggtttttaacttctttgtgttgggttccaacttcctcctttagctctgagaagtttgattgtctgaagccttctgctctcaactcgtcaaagtcatcctccttccagctttgttccgttcctggtgaggagctgcgttcctttggaggaggagaggtgctctgatttttagaattttcagtttttctgctctttttttcctatctttgtggttttatctgcctttggtctttgatgatggtgacgtacagatgggtttttggtgtggatgtctttctatttgttagttttccttctaacagtcaggaccctcagctgcaggtctgttggagtttgctggaggtccacttcagacactgtttgcctgggtatcattagcagaggctgcagaacagcaaatattggtgaacagcaaatgttgctgcctgattgttcctctggaagtttcgtctcagaggggtgcccggccgtgtgaggtgtcagtctgcccctactgggggttgcctcccagttaggctactcgggggtcagggacccacttgaggaggcagtctgtctgttctcagatctcaagctctgtgctgggagaaccactactgtcttccaagctgtcagacagggacatttaagtctgcagaggtctctgctgccttttgtttggctatgccttgcccccagaggtggagtctacagaggcaggcaggtctcctttagttgtggtgggctccacccagttcgagcttcccggctgctttgtttacctactcaagcctcagcaatggcgggcgcccctccctcagccttgctgccgcgttgcagtttgatctcagactgctgtgctagcaacgagcgaggctctgtgggcataggaccctccgagccaggcatgggatataatctcctggtgtgccgtttgctaagtccgttggaaaagcgcagtattagggtgggagtgacccgattttccaggtgctgtttgtcaccccttcacttggctaggaaagggaattccctgacgccttgtgcttcccgggtgaggtgatgcctcaccctgctttggctcacgcttggtgcactgcaccccctgtcctgcacccactgtccgacaatccccattgagatgaacctggtacctcatttggaaatgcagaaatcacccgtcttctgtgtcgctcacactgggatctgtagactgtagcttttcctattcggccatcttggaactgctccctatttttctcatttataaatctgtgggatgattgttcccaatagccttttacctccattgatgatattgcctgaatcagtttttacgttatgaattatagggaaattgctttttaatggccatatgtaatccatatttgagatccatatttgcaaggaaagatgcattactaccactgaaagaacccactcttgccttttctttttaaaagttaatatattatttggatcatggatttgaaggtatttgagttccatgtatgcatattttccttaatgagtaattttgaaaaactgatttaatttaaaacaataagttaatgacagatctctcagatagttttagaactcctaacaatgagacacatcaaatagctatgtgatatttattgagaccctactaaggtacaaggaatcacactagataatacaatgtacttaacattaaaagttgtagtctgaaagtacttacccatttaagaagataagacacatatgcatgtaaagatggaagtatatttgtggcaggaaaccaaaatgctaaatgactggtgtagtcagttaatgcttttggtattcacaaagctagcactttcaactttgatgcttgcaaagcactgcaggtatatgaagtgtcttgattatgcttctgacattctgaactgggacctttcaagtgttttttttcccctaataaatacttaccaagtacatgcctatcatgttatagcaactaaagaaacaaaaagaataaaacgtgctccttgcacctggacatagttattgggtgagatgaaaaacatagcaacctaaaatcatttaaaaagtgctatagtaaaggtatctacttagtgccatggttctatagaagggagaactaggaagtcatgttcattgggtgatgggtgtgtggcaggaaaggcttcacagaggaaggggcatttgagactgataggaatttttttgggtgagaagggaagaagggtgttctaggcaatagaaaataggaagcatgctgaggagtgtgtgtgtgcatgccatggttttagggaagacaagtgatgccattttcagaaaatttgggagtagtcctaatttgggaaggaaaatggttattcacccttttgtatgtgtgttgtaattttgccttatattggagaacaacacagttttaatgatagatataatttttcagagaaagcatatggaaaatgaacattgaagaatggactgaagaatgaatatgagaaacacacactttactaacagggaatgagaggaaaaggagacctctttagagaagtccaacagcaagagagctaaaatggattataatgtcattgaaccaatgggcaagattttacaagaggatagtgaaataacgccacatacagcggtgtgcatgaggaaatgaaattaaaggggccattggatttgacaataaaagaaatatcatgaattcagtttcagggatttgaggggagggaggaagctagacttttggggaataagggaagagtgatgcttaaataccagatttaaaccattcatttgaaaaatctgtcagtgaaaagtaggagagcaataaagtgagcagcttggttaagtgaaatattttttttaagttagagaaaatttttgtatatgtgatggcagaggggaacgtgctagtgtggtaggaaatactatagctggcagagaaagaataagatggagtgaaggttgggaggagatgagaacataggtgatggggttaatctttgaaaggaggagaggcaaactcccagttggtccagagggaaggtgagcatgagggatgagcagagggaaggaagaattactgaggaacagaagaggaaaaaagagggaatttctctgtgatggttgtgatgttctctgtgaatttggagaaggcagaatcatcacggttttagaacttcctcttctatttatgtatcccgggagtgtgaatgaagaaatctctgcccacctaacataacctatagttggtgagtggtatggcagaagtttgaaaagccaagggagtaaagttgtggtatgttctaccattagaaaaatgttaatacaaacaaaatatcaggcaatgtaacactctaatactatttaaaaatgcagttattgtacagcatgatgactacagttaatgtatattatattcttttttgtttgttttttttttttgagatggagtcttgctctgtcacccaggctggagtgcagtggtgcgatctcagctcactacaagctccacctcccaggttcacgccgttctcctgcctcagcctcctgagtagctgggactacaggtgcctgccaccacgcccggctaattttttgtattttttagtagagacagggtttcactgtgttagccaggatggtctcgatcttctgacctcgtgatccatccgcctcggcctcccaaagtgctgggattacaggcgtgagccaccgcatccggccatgtatattgtattcttgaaaaatgcagatatagtggatattaagtgttctcaccacaaaaatgataactatgtgaggtaatgcatttgttagctagatttaactattctacaatgtgtatatacttcaaaatatcatgttgtatgtggtaaataagtgcaattattgctaatacataaagatttagaataaccttatttaggaacactaaatgtattactagtttaattttaaaagttttgttacagtaatttaaaagtatattttagatagacaaaatgattaattgacctaattttaaaatgtttcaaattttgcagtgtagtgttattttttaactgagggcttctctctgagactagtcagtactattaaaaatttaagcagcacaaatccaactcaagcagtcaagcaaaaaattaaaagacagtggatatgttagattaagtaaatgggagtccaagatggactgatctcaggcatgcgtggatctagaaccctgatgatgatgtcaagggtcttcttctgctgtgtgggctggctctgtttccacctgccatggcttcattctcaagcaggcttctgttgtgtgcttatagcctcagggcaacgtcatcacggctcactgtctgaaaggaagatagactccttctcaccagttatatggtaaatttcagaggtgactctgtgttcctccttatgtcagtttttcatcccttaatgtatcacggtagccaggagtcagggggatggcaaacttgattgtctggatcctgggttatgtgctcatttcttgaaggaggtcactgtggttatgagttgtcggggagtagtggcttttaacatttttggcacatttcctttcagtcttatgtgtgtgtgtgtgtgtgtgtgtgtgtgtgtgtgtgtgtgtgtgtgtacatgtacgtctttgttctgtaacaaaccaagttgtcaaatgaaagccttgtgttgaaatcacattccttaggaaggaattagtctttgattgcttatataagtgagtcttcacaacttttttagtttatgttttcataaagatgcagtggaagccttttcttttttataagtaaaagtgtttttcatgtacataacctaatatttttaagtccttcacaaaaatgaagtaactctatgtggataacttcagtagtaacaaaaagaaacaaaacaaccatcctgtcccccacttgccccaccaacctggatttctccttgggattatgaaagcagtatgatggaagagaaggtacagctggctttggaggcagatagatctggacttttaatgttgttgggaggatttgagataattacatagaatccttaatatagtagtgctaggctcataataggtgcttgataagtgataactgttattataattttttaaaaaaaattattgagacagggtctcactctgtcacccaggttggagtgcgatcatagcgcactgcaaccttgaactcctgggctcaggacatcctcctgccacagcctccctagtagctggaactacaggtgtatgcaaccatgcctgctaatttttaatttttttgtagagatggggtcttgctgtgttgcccaggtgggtcttaaactcctggcctcaagcgatcctcccatcttggcttctgaaagtgccaggattatgggcatgagccactgtgcctggcctgttaaaattcttactgataagcattgacttttttgttttgctgaaaagcactggatgtgaatgaagtcctgggttttagtcctaactcttttggtaaccaactgtatgcaaccaaaatataaaactacttgacacactgggcctttgttttcttgcctgtaaaaataaatggatggattagaaattttgtctagctctaaatttctactatttaatagagtaatttgggttacacaaaaatataaaatagaaggaatcctagtatactgtaggaaaattaatgatcttggttttgatgtaaaaccaagagttccagcttctcttcccaaacttgctaaactttaagaacaacaataatgactggaaagtttacagtaaaaatgcatcttatttatgttcaataaaattttgttttgattagtgtccctaaagtctcttctagctccaatatttgatatttcctttccaataaattctagccaggaatattactttaaattataaatgtatagctattttcgtcacagctgcctgtcatggtttcgtttgctaccatgtcatgtagcgtagaggggtcatatggaactttttgtaacagaatttgactctaccttaccagtagttaggcttaatagtgtattgtgttggagtatacctgaggaaagagaaattaagccagcaaaaaagtatacaaacttacaaaaaggaaaattctgaccaggcatttggaaatgagctgcggcctttggggtctgttaagattcctacagtcaagccgggtattatttaagatgattgtgaaaaccaaaggaaataatgtatgcaaactttttagtgtagtattttccatatatattagcccccactattgtttttatcctataggaatatttttcctcataacagatttcaggaactaacataagatcagaaagaataaaattgtagtttggggtttcggttggccttcttcagtttttggatataagattccagtagcatccatataaaaattgcattagattttccattggatatttgctgttgactaaatgtggctcgataatttttgcaggtcactactataagactagtgcttcagcttttttgaaatagtagattaaattggtaaatatgcaaaactgcccttggttttttgatgctcccttctgcaggttctgctttatggctatcatgatctgaatttgtttctttatttctaagtagctcttcttgaactctgtttcaaagagtttccctaacctcagaattctcacacctggctgattggcctctagggagtattcagaaggcagtctttgtgctattatacttttttgttggctggataaacatcagtagtgtttaaatgaaataataaccctgaaaagatttttattaccgtctttaaaactttatccatggcatggcaagtcctgtttcattgaacatttacatatgaaatacatgggttgatggaattattaggtcaaaaatggcttttaatggtttttaagtagtgaacaagaaaatttgaattatctttttttcttttaaggatttcattctttgttacaatctccatatctctcatagttcagagataatagaaattgtttttaatattcattcattcattcaagaaatgtttatttaatactcattatgggataggccctgaggaataacatagataacataccttatattttaaaaagctagtagctcattttaatttcatttcagaataactttgtagctgcaaaataagactagtttaagctataaagtcaattagcacaccagtgagttttgggtaggctagatggtaaacttcatctttccaacatacttagctttatttaacttgatgtttctgaagtgttttgacctattcagccatcacccctactgaacccactttcagaaataatagttaagtatttgctaggttttcattaactggaactgaacattattaggttaattatatgatatttatagggcagaaatggtgcatatcattgtattttatggcttatcctaactagttgggtgatactgtcttaatttgcctaaggtagttctggtttactcttgtcgctccagtgtgattattatacataatctctcttttttttttttcctcgagactgagtctcactctgtcgctgggctggagtgcaatggcgcgatcttggctcactgcaacctctgccttgtgggttcaagcaattctcctgcctcagcctcccgagtagctgggactacaggtgtgcgccaccacacccagctaatgtttgtatttttagtagagacggggtttcaccatgttggccaggatggtcttgatctcttgacctcgtgatccgcccaccttggcctaccaaagtgctggcattacaggcgtgagccactgcacctggcccataatctcttccttaaatcttagaagtgccctgggtgaattatatggccctcttatagctaacactcttagttagaaaacatattatgtgccaggcagcattgtaagcatttgatatatattaactgaggcctcacaacagccctgtaaggttggcactgctttatccttgatttgcagatgagtagactgaggtacagaaaagttaagtaacttgtctaaggttgtacacctagcaagtagtagggtcaggattcaaacacaagcacatttggtcctggaaggtatactcctaaacagtgtgcttttctggtacagatgagattgctcaatgaacatgtttaagagaaggatgagaggatagcactctggagaatactgacatttaaaagcaagtaaaggaaatagaaacttggaaataagacagagaataagagctaaaaaaaaaggaactttaagttatagacagaattcagttacttggatccccccactccccaagaattgtcttcatccttttttaactagaaagaaatatttttcttttcactatttaataagtgccccaaagtgctagatagttttcctttgaaatatagtaaaagagcatttattgaaagcagcttgtttatgtgtgctttgtttaaaaattagagacattttattttttcttaagtaacagaaatcagactttcaaaaaagctctttaaacctagactaacttatttatgacaattttgtcatatatttgaaagttaattttaggaaaattacagagccttttaaccaccctatggccagacttcagtgttgttctttttatttctacctcatttcatgttgagtcttaacttcgctgtctctctttatcatcccctacccctagtctgaatgttgaagaatgctaaagtatattttattgcttcattgactaaaactatgtttctaaaactatgaatttgcttaatgagtcagcaactgtaactataattaacagtatagtttttacaaccatagttttgtggtaaatgtgcagttctcagaatttaaatgtaaacgttcaatgaaattaaacaaaacccaaatcttcatgcaataggtagtatatatgtattcagtaagggtcaccaaacattaattgaggttctattatggttaacttttctactttgtacttagggataaaaagatgagtaaaattgtttcctgcatttttccccacccattccctccccattttctttctttcctaccttccacagccccattgagtgtctacttaatgtgccaagcacacagtatataaagatataaagagctcaaggatgtaaagataaatgaggatctagtgcctgccctagttcagttatcccttaggaagacagaccagtcctatgtcagtcagctcagaaaagtgcaataactgttgaagccagggccacacccagtcttgtctgggttcactaccccactttccactcatactttagcgatgaacagaatttaagtcatctaaaaggaggagcaagattaaaacagtgaaggaggtatgatgagtaacagaaaggagctcattggtgactaatgaaagagcaactgctgtgttaaggggttgatgaccatattcgccagtgtggagttgaaggttaaggagtgaatgggaaatgagaaagtagacttcaaaaaagctggatgttgtggagaggaatagagaaaattagaggttgaacatgtagtaagagtgagtgaatattttttagaatggggagataagtgtgtttgtttgctgtctaggagtgagctatagaattgtccaggtgagatggaaagataacagagagaagatatgagaacaaaatcctgtaggaaattagataatatcaagaacataaatagaaggcctggcacaaagtctcatgcctatgatcccagcactttgggaggctgaggcaggcagattgcttgagcccaggagtttgagaccagcctgtaacatagcgagaccacatctctacaaaacaaaaaaaaaaaaaaaaaaaaaaaattaaaaattagccaggtgtagtggtgcatgcctgtagtcccagctatgtgggagatcaggaggctgaggtgggaggatcgcttgagtccaggaggtcaggctgcagtgagcagtggtcatgccactgcagcactccagtctgggtgacacagtgagaccctgtcttaaaaaaaaaaaaaaaaaaaagggcctggcacagtggctcacgcctgtaatcccagcactttgggaggcctgtaatcccagcactttgggaggccgaggcaggcggatcacgaggtcaggagatcgagaccatcctggctaacatggtgaaaccccgtctctactaaaaatacagaaaattagacgggtgtggtggtgggcgcctgtagtcccagctacttgggaggctgaggcagaagaatggcatgagcccaggaggtggagcttttagtgagccgagatcacaccactgcactccagcctgggtgacagagtgagactccatctcaaaaaaaaaaaaagaaaaactgttttttggtttttttttttgttatcctaacttttgaattacttcataaagaagtttagtgatctatttgattatgtagaagctcttctgatagttatacatgcttaatcatttaagaataattaaaggaactatattgtcatgttatcaggcattcctttatgaaaatgttagaaactcctctttcatctataccttccccactgtttaaccctccaatcaaaagcacatattctgtggtaagaacagagaatatctattttaaaggtcatttgtgtcaaattgtcctaactagctgttgggattgggaggtgctatttgggtcataaatagcaagttttctctcccaataaagcaatgtctgagaatcccaagattctcatttagtagatctgggttgagacctagaagacagttaattcatttagccaccaaatgtgtattgagtgtcttcctattatatatttattaccatattgtgtaggtagtgttagaagacatcccaggtgcctactctgtaactggcggagagataataaacaaacaggataattttatatagtgctaagttctgtgaagaaagtataccatgatatgtgccagataattacctggcaggggaaaggagagagagagctttgcatagagtgatcttgggaggtgtcttttgaagagataactcttattttttatcttgcttttttttttaaaaaagtattttttaggttgtagtaaaatatatataacataaaatttaccattttaaccatttgtaagtgcacgtttcagcgacatcaagtacatgcacattgttttgcaaccattcaccaccatctgcctccagaacttttttcatgttgtgaaactgaaactctgcagccattaaacagtaattttttattttctctctcctctcagcccctaacaacaaccattctttctgccttcttaaatttgactgctttagtgcctcatgtaagtggatcgtacagtatttgtgtgactggcttatttcacttagcgtagtgttttccaggttcatccatgctgtggcacatgtccgcatctccttccttcttaaggctaaataacactccataatatggatgtaccacattttgtctgtccacctttgaactgagatctgaaaaatgagaaggggccatgcaagaactagaagaagaacgttacaagcagaggaaagaacatgtgcaaaggccctgagatagcaataaactggttggtggtctaggccagtgttgtcagaatatattaatagtagagaaaagtgcctggaaagaatggtattaaatgggatcagagatagacatacattggccgtattattttaggctttgaaagaccttggcttttaagtggagtgagaagctgcttattaggaagttttaagtgggggagtgacttaatctgatttccatgtaacagcaaaagcaaaaatcacccagactgctgtgtggacaagcatccttgtggattctaatgcaagtctgtgatcggactttgagaaatactaatttagtccttaagtcagtatcctgagatagctgatttcaaaagagctctctcagggcttctgaccaaaagtgacagattggctacacctgtacatctcttcttatttcctaatccctgcctaaatggaagaaagaaatcagagactgggagaggttacaacaggagacagaagctgctatacctctttcaaataagcagatggacaggtagtgactgactttgcagaggaatcacacagtacctgtaagtgcacaaaaatacctgtaagaaatgcagtactgtgtttgtccgaagctcccaagagtctcagcatttggaggcaccagatactaaggaagataggggtcagaaatggagctgaaaacaggggagctggtcggaaaatctgtgtacactgacaggtggacccctacgattttctccctatgtgcccttgtggatgggtgagtcccttcactaccaactccctggcctcaggagaacaaggtttattctttgcaaaattaatgaagagctgtctggactttgaaaccaggggccgtggattgttgcttggtttaaaacaaggagatcggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaccaaaaaaaaaaaacaaaaaaaaaaaacaaggagatcaagggaaacctacgcctgaactatagaagtgttagctctcttcctctgctctccttccagaactgcacagtcaagcctgtcctatccttctcctgtggaagactgaagataacagcatcttcagatactgataggctttctgctgagagtaccttaagtgaattctaccagtcgttaagccctgttttcccacacagatctttcagttagttcttttcaggggcttattcttaaatatgagcaaacaatctaacaccattggtcatctgggggaagactccaacattaaaaaaaaaaaaaagtagacatagagaggtggagagggagtgatacttggaacactgggagaaaacagataccataagggatcaaaagaaaactttaaaaatctccagtattatcagagaagacatgtatttccttccccacttaaatgatagtgaacacatataaaagcagaaatccatgagggtaaagagaacgagatgagagatgacagcaggcaaacaacgtcaactaaatattggaagctgagaacctggtgcgtgagtggtaacagaatttagcagagctgagaaagcagaaagtcctatggtgtgggtagttgtgcaaaaactggtattcttttaattaatgatgtgctttgctctatttggactgctgggttcttatttttgagcagtatgctctctcccagttgaagctgttaatgggctgtccaccaatggagaaatcagaatgattaaaatgtagttcttgtatttttatggttctcttaagcagtcatgcattatactcttcttcttgtgtctgagccaacatttcataggagtagataacacccatttctggtggcactgacagcagggttgaaaagaatgttataaaagaaaatatgaataacatttaacttaagaatatgttccaaattttgtttgtaaagtagttgtttaaaacttggtagttctttttgatataatgttataaatggcagttatcctagaccaaactttaaaatatgtttcattagcaattaaatgggcatttgtaagttcccagggaaacctaatcacattgtatagtattttttaatgaagaaacactagctgggtacagtggcttatgcctgtaatcccagcactttgggaggccaaggtagatgaatagcttgagtccagaagtttgagaccagcctgggcaacatggtgaaacctcatctctacaaaaaatacagaaaaattaggtgggcatggtggcttgcgcctgtagtcccagctaattgggaggctgaagcgagaggatcacctacgcctgggaggttgaggctgcagtgagctgagccatgatcgtgctactgcactgtaccctgggtgacagaatgagaccctgtctcaaaaaaagaaaaaatgctttttaatggtaaaatggctacatggatttagatttagacttgaattcaagtcctacttctaccatttttctgctatgtaaccataagtaaatttctaatgtttctgggtctcagtagaatgagaataatatctaatcagagggtagttgtgatgattaatggatgttaaagtagatgagctactcagtcgagctcctagaccctagggagtcaataaatagtcggttttcttcaccctttttttttttttttgagacagttttgctctgttgttgaggctggagtgcagagtgcagtggtgcgattatagctcactgcagccttgatctcctgggctcaaaggatcctcccttctaagcctcctgaggagctagggctacaggtgtgcaccattgtgtctggctaattttatttttttatagatacagggtttcactgtgttgcccaggctggtcttgaacccctggcctcaagagatcctctcacttcagcctcccatagcatgtgggattataggtgtgagctactgtgcccagctgttgttttcagttttactcttctgtggtatgtggtaagagggagcatttgttttctagagcctgcagcatgtgtgggtcagttgaaaatgtataaaaattttgagttacgcacggtggcttgtgcctgtaatcccaatactttgggaggctgaggagggaggactgcttgtgccaggagtttaagactagcctgggcaacatagtgagaccctgtccctaaaaatatgtaaaaaaaattttaaaataaaaattttgaaatgcaatttgtgtcttaaaattctgccttatttatttgcaacgtgtgtttcttgtcatgtatttgctgctgtatgctggtagaaaaagcatagagagtggactcaggcagtccatgctctagcctcctgttctactctgaactagatgtgtgacattgtaagtgctgctgcttcacttcgggtgttactcctgatttgcacagtgaaaagtgttttattacaagatgatttctagaagtttgtttctgttctgacattagatgacctgtgatatgtgaagcttaagacatcttttttcattactgggtttatacggggtgttgaggcttgtgatacatttactgttataaattcattttaatgtgtttggaggacttgagatgattggagattattagattgatagctgatgtttggctttattattggaaaatagttctagctacgaaacctgtttttgagtgaaagtatgctaggaatggccattgcttttcttcctacagagataagtgatctcttggtgttgtacacatgaagctctcacctttatttttaaagtcatggattttaccttggctcctataaactcttctcccctcccccatgtagctgtaagcattcctactcctaggatgatttggaatgtgtgtgtttcaaatcatgtttagtgattgtaaggctaatctcagcttaattatcactgccaaaggaatcctctgacccccagggccagatcatgttgtttgctttcatggtatatttttcccttttcatagtccgggttatatatatagatgtataattccataatatcttgtcagcaaaactggaagctctgggagggcagtgactgtatctcttttgctgacttttatctataatgtcgggcacatgattggcagcattggagacatatttttgagttaagtgaataaattgtttccccacaaataataaattaatagaaatttaatggtaaaagctcaaaatgtttattagaatcatgatggtagcctttgttattaccagtgaatttaaaaggaaagaataaccaaggtgtttgtataaatgacttattattgtttgtgcaagaacagtgaacgttccctagtacaggaagcagctttaaaaaactgctggcagaactaagaagtcagactgtccttgacccctagatcaaatgtttttgagcctgagtttccttaaatcttcttcagttgagaataaacattttgacaaaatagaagatttattctgttaatttttggtcttcataaacctaactaaatttgctaaaacaacaaaaactttctaatttttactagttttgttttttaaaaagtttgtttccttttaagtgcataacactttaaaatgagctcagctgtattagcagataaacatgttgattcatttggtccagagctactgaatgaagcttgcaggagcacagtttgttctttatgccgcccaggggcagaatgtttctcttcctctcctccttattgagagaaggggactggaataagtgactcctcttatttaggtttgcctgaattgttgacgagggaagggggcaagatttcttcaccatttatccttcgtctcatttaaattctgttcattaacataaagtatatgcactcatactgtgatatacatgttgaattattagtgtcatatatttacagtttttacaaaaccattttacttaatgctctggtttgagtaatctgttgtttaaaggtataatgaatcagagttgtttttaggcgtattgcgtttttgaggatggacttaattttggaagcaaagagaagtatgttctatccagtggagtggagttgagataataggtatgcagttcgcctctcatacccattgtgggttctgcatctgtggttctatcaactgtgtgtcaaaaatacttgagaaaaaaaaaaaagaatggttacgttcatactgaacatgcatagactttttccccttattttcccctaaacaatacagtgtgactatttatatagtatctacattgtattaggtgttttaaataatctagagatgatttaaagtacaggcctagcttgttttattgcactttgctaatactgcatttcttacaaattgaagatttgtggcaaccttgagtcgagccagtctatcagtgccatttttccaagagcatgtgcttatgttgtgcctctgtgtcacattttgggtaattcttgcagtatttcaactttttcgttattattataccggttatggtgacctatgatcagtgatctttgatgttactgttgtaattgttttggggcaccacgaaccattacccatgtgaggtgatgaacttaataaatgtgtatgttcttaatgatccagcaactggctgtacccctgtctctctcactcctgagacacaacaatattgaaattagtccagtcagtaaccctaaaatggcctctacatgttcaagtgaaaggaacaatcacacgtctctctggaaatgaaaagctagaaatgatgaagcatagtgaggaagctatgttgaaagccaagacaggcaaaaagctagtcctcttgagccaagtgaatgcaaagggaaatttcttgaaggaaatgaaaagtgctattccagtgaacccatgaatgataagaaagcgaaacagccgtattgctgataaggagaaagtttgagtggtctgggtagatcaaaccagccacaacatttccctaaaccaaagcctaatccagaggcaggccctaactctctttaattctatgaagagagatgagaaagctgcagaagaaaagttagaagctaacagaggttgattcatgaggtttaaggaaagaagccgtctccgtaacataaaaatgcaaagtgaagcaatcaatgttgatgtagaagctgcaacaatttatccagaagatctagcgaagatcattgatgaaggtggttacactaaacaatagattttcagtgtagacaaaacactcttctatttggtgaagaagatgttatccaggacttcatagctagagagagaagtcaatgcctgccttcaaagcttcaaaggacagtgactttcttggtcgtagctaatgcagctggtgactttaagttgaagtcagtgctcctttaccattccaaaaatcctaggacccttaagaattatggtaaatctgtattctgcctgtgctctatcagtggaaaaagagagcctggaagccagcacatctgttcatagcatggtttactattttaagcttactgtggagacctactgctcagaaagattcctttcaaaatattactgctcattgacagtggacctggtcacccaagagctctgatagagatggacaaggagatgaatgttgttttcatgcctgctaacacaacatttattctgcagcccaggtatcaaggactaatttcaactttcaagtcttattatttaagaaatacattttctaagggtatggctgctgccataggtagcaattcctctgatggccctgagcaaagtcagtgaaaaactttccggaaaggactcaccattctagatgccattaagaacattcatgaatcatgggaggaggtcagaatatcagcattaacaagagtttggaaaaagttgaatttcaaccctcatggatgactttgagggattcaagacttcaaagaagaaagtaactgcagatgtggtagaaatagcaagagaactagaattagcagtggagcctgaagatggaactgaattgttgcagtattatgataaaacattaatggatgaggagttgctgttttttatctgtttattaaaaagatttttttaaagacaaagtctcattctgttaggctggagcagaatacagtggcacgatcctagctcactgcagccttgaactccctggctaaagcgatcctcccttctcagccttctaagtagctaggaccacagtcacacaccactgtgcctggctaattttttaaaaaaattatcttttgtacagacagggtcttgctttcttgcccaggctgttttcgaactcctcgcttcaggcgatcctcctgctttggcctcccagagtgctgggaatacaggtgtgagctaccacccctggccaggcattgcttcttatggatgagcaaagtaggtggtttcttgagatggattctactccttgagaagatgctgtgaacattgttgaaatgacaacaaaaggatttagaatattacataaacttaattgatacagcaatggcatgatgtgagaggattaactcaaattttgaagaaagttttactgtggataaatagtatgacacgttacagagatatatttcataaggaagagtcaattgatgtggcaaactttattgtctcattttaagaaattgccacagccactctaaccttcagcaactgccaccccaatcagtcagcagccatcaaggcaagaccttctaccagcaaaaagtttatgacttgctgaaggctcagatgatccttaattaaggtatgtgcattttaaaatcataatgctgttacacagaagactatagtatagtgtaaacataactgtcatatgaactgggaatccaaaaaatttgtgttactcactttattgtggtggtctggaacagaacgtgcaatgtctcgaggtatgcctgtatacaggataatgtgtgtaggttatatgcaaatactataccatttgatataagagacttgaatatctgtggattttagtatccttagtgggtcccggaatcagtcccccccacgaatacccagggatagctgcactcacacataatgaatttatagtggaaattctatgaaatgtatatagagttgttataatatacctaggatgatcattggtatttcggaatagcttttagaatatgaccaagatacatgacatctactattatataaacctgtgtttgtttcagcatgtttttttcctatgttttgttccatgttagatgtcatgagtttgcaaagtataataagctatattccctgccttcaagtagcttaccatccatgtaccatttcccaaagtgtacatcattagcaggtaggtattcctcaaaaatagattattgtctctgattaagtttcagagatacctggattaatcaaaattgaaagtttttttttagaatagggttctcaaatgcatacattagggaattccagaaagcgactgtatgttgcaaggttttccaagctttgtcgacacactattttttttctcatgaaacttctgtggtgggatctgaggggaatggaggtggggaagagagtggcagtggtgtttttaggaagaagattaatgtaggagaggagtgggaggaacacctaggacagtagctgtgtacctggcctaggttcctcagtccagatggtagcaagtctgaagacagggagagacttcttccagaagatgaaattcatagaaacctgaggcaaattggtatactcaaaggagctttgtcagactggagagtctggggtgaattgggataaatatatagtagataagtatgtagaaaactaaagaaatgagaaacaaattattaattgcaagggaaacaaaatgttatgcaggaaaagaaaagtaattattgtttactgcttggttcagctctgaataccctatgtagttataatgacataagcctcaaatattgatctaaccaaagttaggattgtgttgagacatcgggggtgggaagtgtggaggatgccaggaccaggaaacagctatatctcaaatttcctcaactggcagtcactgaataaagaaagcttttgggaaaaggaaatattggagagggagctgggactagtttttcataacaagccttgtagatctagttaatttaaaaaaatgtgcatgggtaacatttatttttacctttatcagatatttttctagatcaaaatttttacaattgttttagcttctcattgaaatgttgtcttactaggttaaagtttcacgtgtgtaattggatttgaaaaatgtaaattcactttgtcgttgcctttatgatttagctacaaagatcttacttatggatgagatgatgactggcagttattccacaccaaccactctgggaccaaggttttctagattaacctaatcctacagtccttttattctgtgtttcccactcctacattttaaactttgtatctgtattatgctcttctgtgcttgttagaatacacactgtgttctcaggtcagttcttacatgggcctcttcttttttttgccttctttaatttccttttcttcacagcttttttagcatgtcagtagcagagctgactttatgtagtgagaagctactgtgtgcttctctcttgacccttctccccaaacatggatggaagggcagaacaagagacctgtgggtgagtaggaagggctgaggaatgccatcaccctccagcatttctggttcaacagcttctaatcatttttaccatctccaccgcgcacccccccaccccgtgcttttaataacttcaagtttcatgattgactggtttacttttatttgcttattacatacttatttgttggattcagagctcttaattgttagtagaaatgaacttactagttaacttttgctaatttaagtataaacagaattaattgaagatatttgtggtttcttgagctgatggaaaggccaggctattaagattggggctgcacagctaggaacaacaataccaccattcctaaaatagctgtagaacaacacttaaataactgactatcctgcttttaaagactgctattctttttttacaaacttgtaggttgagaaatttttacttctattttcaattagaagtctttgggaaaattatgggatgactggatttgtgtatatctataatccagagataaggaaaaagaggaaacacagattttcaggagatggaagcataactttgttctgctttgtgcttgaatacctctttttgatcagggttagaggataaccttaggtcagtgcatttcccttgtgtttttgttaacaaaacatagttcagatcccttgattaaaaccctccactggtttcttgtctcatgaagaagaaaaaatcctaactgttcttgatgatctttaaggctcagaatgatctggacagaggtatttaccttgaagctcataaagcataggcctttctcacttgcagagtatctttctgaagctggactaaattggttaaggccactgtacttttccactttgtcttctttcctgtcacacaccctatcctttcaggctgtgttgggatggacaaaagcagttctggagtcctaaggagaagatgagtgggatatgtttctgtgacctgcagtcattttaaagtttagctgttgctagctgactccatgtaagaataccttccaggaatttgatggctgtgcactctggcagtgcagctggcatggttatagggtgcttggccgaaggtttgcatagcaatatgaacgcatcctacgacacatctagccaacactggaagactgtgggtaatggacgagaaaccaagattgactttttgcaagtttttaaaaataatcttcttgtaactcacatgtgaaagaaacatgagaggttttcacaaattcagtaatttgagacatttacatagcatcaccaatagttgtgaagctgaaactttagttctaaactataagtagtaaaaaaaaaacgttgattctctattgtaaacaaaagacaactattttctgtgttctctgtgtagaaaattatattataaaattgaggtggggctgggcacggtggctcacgcctgtaatcccaacactttgggaggccgaggcgggcagatcgcaaggtcaggagatcgagaccatcctgactaacacggtgaaaccccgtgtctactaaaaatacaaaaaaaaaaaaaaaattagctgggcatggtggctggcgcctgtagtcccagctactcacacctgcggctgaggcaggagaatggtgtgaacccaggaggcggagcttgcagtgagccgagattgcaccactgcactccagcctgggcgacaaagcaagactccatctcaaaaaaaaaaaaaaaaaaattgagttggacagtggcttgtacctgtaatcccagctacgggggaggctgaggcaggaggatcacttaagccgggagttgaaatccagcctgggcaatatcgtgagactgtgtctctacagaaataataataaaaaatagctaggcgtggtggtgcactcctgtagtcccagctactcgggaggctgaggtaggaggatcccttgagcccaggcctttgtggctgcagtgagctatgattgtgccactgcactccagcctaggggtgggagggggagcacaggaggccgtgaaggccagccctgctggctgtggctactgtgcgtggaccaagagcatgtgcagcatgagggctatggtggtgcccagagagcagtgtccagcgtgagggagattgtggtgcctggagacctggcagtatcacccggcatgagggagatgctggtgcaccggctgtggatgtgagcttgcctggtgccagaactcggaggggccagactctaatttagtacttttttatgtgattggcagtttctaaaaatttgtaatttgatgtcgtttcctttcttattctgaataaatattcaatttaggacctaaatttgtttttatagttttatgttcctttttttttttgaagagggctgttcccccaattttataagctttaaaattccgttaaaacctggattgacccctgggtttccttgtctgcctttttaatcttgtctcatactcaccccctcattccctgcagtctaggcactttcatctttctgttcctcaaatggattatgtttgttctcatgtcaggatttctgcacttgcctggtctcctctttccttagctttttgaaggatttttcattatgtacttctcaggacgggtgtcttctcagagagtcttagaacacccaatctaaagtatcttttctccctccctcatctctgtcacgtcatccattttgttttcatagcatttatcagcatcttttttatttgtttatatttttgttggctgtctctgccttttagaatataagttcagtgtattaatatgagagctgtattgttcactgctgtcttcccagagtctagaataatggctggacttattagcattcaacaggtattttttggatgaaaaattactaaaaagctggaatttgtacattttcccatgggtttatttataatactagcataatttcttattgttaattttgtgtttgtgtatggtactgctttctattatcaattgtataaactcgtttgatcttttctgctgaaaatgttgactaagttattatttaccattcattttggttaaacatattttgttatagactattcaagcagtcagaagactatagagaagaataaagtgagcactaaagtacccatgtcctagctttgtcgtactttttcaccagattttttttaagaattaaaaattttttaagttaacttttcatttacaaatttttaaatttttttttaaaaattcaccttaattaactgaagtttatgcattcttctctcatcttactcctcatttttccctacttacccagagttatacctagtccagatgaagatatagggtgaggtacagaaggggcctgagcacagaagcttctgtcctgtggagttagggtatgccaccctgctggcacatggatgccatcactaacccagaagttcttcaagccccatggttttggcttttatgtgtagacataattaatcaaatcattggccatcgatgatcaactccatttctagctcctctttccttcccagaggttgagggtgaggtgaagctgaaagttctaaccctctaatcatgctttatttagtctttctagtcactggccattatcctgaaccgatctagggaccccactcaccagttcacttcattaatatacaaaggacactcttgtcactccagaaattcttagaagctcttgttttaggaactggggattgagaccaaatttataataaaagatgctttatcactcctattactcaggaagcgggaagagctttaggagctctgtgctagggacccaggagcttgggaggaagataaaaatacatatttcttgtaatattacaatatcacaggcttgaataccagggtgtgaggatcattagaagccatcttggagggtagctaccagagtctcatatatttccttataaaatacctaaagttctttcacatttactgcttctttaatccacccagaatggggtgtgtatgtgtgcatgcgtgagtgcccatacgtgtattgtgtatggtgttaaaggaatctaatcttttattctttcaaagatacgctaatcgtcccagttccatttgttaaataattcatcagcattgttccatttatatatgggtttgcttctgggttctctgtacttctctgctatgatctgaatgtttgtccttccctacctccccaaattcctatgtcgaaacctaatcccggatatgatagtgttaagaaaaggggctttgggtgaggtgattaggtcatgagggctctgcctgcataaatgggggcaagaaggtaccccagtgaagtagttagcttcttcttctgtatgaggacacaacaagaagggtgccatctatgaagaatgggcccttcccaaacattgaatttgctggtgccttgtacttggacttccagcctccagaactatgagaaataaataagttgtttcctatgtttataagctccctactttatggtatttttgttacagttgcccaagcagacttaagatgttttcctgtagcctatttttctattcttaggccaataccgctttacaagttttgatctctcttaggcaagtctcccctttttgttcttcatgtttggcttggttctcttgtctccaaagggccattaagagagactagttggctgggtgtagtggctcacacctgtaatcccagcaccttgagaggctaaggtgggcagatcacttagcccaggaatttgagaccaggctgaacaacatagcaagactccacttctacaaaaaatacaaaagttagctgggcatgatggtgtgcacttgtagtcccagctgctcagaaggctgaggtaggaggattgcttgggctcagaaggtcgaggctgcagtgagctgtgattgtgccactgtgcagcagcctgggtgactgagcaagaccctgtctcaaaaaggaatgattaaataaatccatcaatccatgtgaattttagaatagttttccaggtttcatcaaaaatcttgttggaattttgcttattttaaggaatataaaaatatgacctttttaacttaaaaagtaatagatacttactaaaggtattagatacatttaaaaaactgttaaaaaaatccataggtctgtcactcaaacatcaacattattgtggcattaggaatccataaagatttgatattgtaaaagtgaaatcatctctgcaacaaaaggtatatactgggtaaaaaatagggttaatattcttatacaatgtgtttctataaatcattaagaaaaagataaatgacccaatagaagaaaggacaaagaatgtgaagaggcattcgacagaggagggaagtacaaatggctaagaacaaataaaaagaggaggaaaatgtgaagtaaaacaaaatgaaccaacgcttccccatttttacagcattgtatatgaaatgaaaaaagttggagacagtcttaagtactcaccaaaagatgaatggacaaatgcattcattcgtactatggaattctaaccaaccattaaaaaaagattatgtgctaacatgaaagaatgtctacggttaactttaaaaatgtaaagtaaaacaagggtttatatatgtggtatcatgtttataaagaaaattatatatacataattttttccatagaaaaaaattttagaaggctgtatagctctattaacagtagttaccaagagtgtaggagtatgccatagaagagactttaactgtattatttggattttttaaaaagaattatgccctactttgcaattaaaacaaatttaaaacatttttggtgtaattcctcttagtgtttgtttttttccctaggcataagtttatttacttatttttttaaacagtagtaatctatagaaaggaacaattgtgttcttaaaatttttcactcagtggaaggattcattcaaaggaatatttgaatgcaaattggagttagaatcaatctaggttataattccagatctactgaaaattttatcttgacataattcagccctgtataaaagttagaacaattacaaagtttatatgctcattactcaaattttaacatttttccatagttgtattatctttcttttttcctcttcttcctttcttccctctgttccctctctttctccccttctgtatatattttaaatatatttatatagattttaaacatatttttaaatacttaaatatatttatgttcaaatatatagaattttttcctgaaccattttagggtaaatttgagacatgatgcctcctttagtcttatatacttaagtgcatgtttcctgaaacaaaagtggtatcctacataattatagttaccaaaatcaagaaattaacattgatataatatggttatgcagatattgccaataattgcctttatagctctcattctacaaaaaataatcttgaatcatatgttgaattcaattgccatgtctttctaataatctttaatcaggaggcacatcatattgatttgtcctagtcctagtaatgttaattttgatcacctggttacagtagtgtttaccaactttcttcttcattataaagttatttttccttctttataattaataggaatcttgtcgtatgattctttgagattatgtgaatatctggttgctcctcaaactttggcccaccaattttggcatccatttagggttcttacttgaatacattattaatgatttatggtagttttctaattctgacattcctttttcattttagttggctttttactataaggaggaaatttctttctccctcgtgaattctgtcttactcaatgggttataatcttttactatcatcatttattttgaaatgcttaaatgattctagattgggcccatgaaagcactttcaggccggcttttaaattcttttgacatgtctccatcaatttttgaggacttgctgggacaacaagatattccagtctcgtcatatactttcctacctctagaagcagctctctagggagctctggttcttcttagtggaaaatagtattaactttcctttatttttaattcttttatttacctttgttcttcatgcagtatttttcttttccttatcctgtcctgatccattctatttttgcatgaataccgtactgttttaatcatttaggttttgtattttggttaattatttatcttattaaatatttctgtgtatttgacactagtgagaaaccactcttgcttgtcccctggaaccttatgatctcctgtttctttttgatctgtttgaatgttcttctcattcttcttttgaattcttcctggatgagatttttaaagggtagagttccctaggattctctttttgctctggaaaaccaggcattgtcactgctcaggtattgctggaggagaatctacactgtaggagtccctacaaactttagagacggtttgacaatatatatcaaacttacaaatgtatcttctcgtttctggaagtggatcctataggtaaacttaggaatgtttgttatgtgatatatacaaggtgattcctacaactattgtgtgtaacagcaaacgatttgaatagtatcaacagtaatccaaaaagtttgttaacatttttctccctttttctattcatatctgcatgaggctggattttcttcatatatgccaagacaacatacagcatcagagtagggaaaagcccaaatgtccattaataggaaattggctaagtaaatcatggtacagcaatacaatggaatattacatagtcgaaaaagaatggtaggatgaggtccattcagtgacaagaaaaaaaaaagaatcggaagaatagtatttatatggaaaatcatggaaaaacctcaatttatgtaaaggagaggagataagatgttatagttgtatttgcttatattgtcataaactctggaatgaaaaacaactaatattttatccagaaagcagggttaaacaggcagatggatgggtgtgatgagactttttactgtatacctttttaacgtttgatttttgacatacacatgtacaatctgtttaattcagttttaaaaaatgatttccagtataacttaaacctagttttgacacagcacacacttatactttgtacctctaaaccattggcctacagcacagtattcttaacacagtatggaaagccttttgtctgtctctataggatgatactctgcaacttccagcttcatcctttacattctagtgacactgaatttctggtagtagttctccacatgtggtactgttttatatttgtgtatgctttacctgtatcttcttcatatcttttaagaatcagtttgtgtcatcttctctgggaagctggcctcaacctttgcaaggcttagttgagtgattcagtcataatactctgtataattgtctattattgctcttatattgcattgtaatcattagcttttttattgtacttagacacagataaccaaagatttgctttagtgtatttttttcactgtattcccagtagaaaagcattaatgtatgttatttgatgtctttttctgcagggtagttgccctgcctcaaacagcttatagtctttaatggagacatgcaggaatgcaactaacataagagagagtgtactaagtgaggtaataggcaaggtcatacttttaaaggaagccagtctttgaaatgaatcttaaagatggtcccagagtccagatggaaacattctaacagggcctatttaggagccccagataatgtaggggtagcttcagtataaaggatacatgcctcaaggtgagtcagggagaaaaggaaaaacagggacagattgtgagaggtctaacattccagtctaaggaatttgaatttgaatattatcttgtgggtgaagtaggattctttaatgcttttgaacgaggaatcagtatctgtactttcaggatgattttatgctttgtgtaatgtcttccaaaaaagatgagagatggggcacctgttaatatattttatattataaagtacagtgttgaatatgggatcaaaaaaggaacagccagccacatttccaaatcccatgtttttgaccagatagtcccttcaacctagaattatgtctcattcaagcagtgtgattctattcatctcaagttgtcataagaaagacaacttatatgttacttccactagtgatccctgataaattccttccaaatgttattaataactgtatcctgttttgactgcattgtatttatttctgttacaatttttctcataccctacctgttttacagtgcaggggtccccaacacccatgctgtggaccagtaccagtccatggcctgttaggactgccccctgccaggccacacggcaggaggtgtgcattaccacctgagctccacctcttgtcagattagctgtggtgttagattctcatagggatgcaaaccctattgtgaactgtgcacgtgacagatctaggttgcactctccttatgagaatttaatgataaatgtaatgcacttgcatcatccccaaaccatcttcactccccaccgcccccgtctccccccaatcccatggaaaaattgtcttccatgaagccggtccctggtgccaaaaaggttgaggactgctgttaaagtgtttgccttaatcacaaccacaattgcttcctcctggaaacccttgttttactttatttaacccactcgggtaacacttattacattgtattactgtctgatggttttctgtttatttcaccaaacatttcttaggtgccagacctcaaggaagtcattctttgtcagttcatgtgtttgactatactacttgattattattagatatacgaattccttaagggcaccttatctttttttattgcacttagcacaactcatgatacatttaggcactcagacatatcagagacatcagcggaacagtactggttaaaagttgagtttaaattctggccctatcactatctcttggatccactgtagggaggttatttagtctgtgtaagctataattttttcttctgtaaaatgggggaaataatagtttccatctgaattagtctgttcaagctgccataacaaaatttcatagtctaggtgttttctcacagttctggaggctggatgtttgagataaggtgccagcatgatggggttctggtgagggctctctttctggcttcttgctgtgcctcacataatggagagtgagcaagctcttttgggtctcttctgataagggcactactcttatgagggtgagggccccaccctcctgaacttcatctaactctaatcttttcccaaaggcctcatttcaaatatcacactagggggttagcgtttcaacatacggattttgttacagtctttagtggagacaagcaggattaattaatttatggaaagcatgcagcagtgtgcctctaacataaaaaatgtcttatttaacctgtcatcatcatcatcattttgacttggcctaaaatttcgcatatgggctagtggagaaaaattagaactaatttggtgattttgctcttcattgatggaaagtatgtgataacattcattaagaagggcaatgtaggaagaaagagacagttgtaggcatgctgtggagagatgcttccttcactgtatcagtagagaagaagatggttgtcaacctcaggtttatggatgaatcctcagtatgctgtaaatagaagaaaagagatgctttagtgttctttatatctatgtggcctttaaaatgcagtcctttaatttgtttttattcaaatctttattttttattttcttttctctgatttaattgatagatcgggtttttcagtgagcctgggaaagcagaagtaccatttttatgtctataaataatactaaatttattttgctggattttgtaaagttctgtattaaacattatggatcttaaatatattttggtattttaaaattagagtataatcagtttctgttctctagcctttggatttagactttttcttctctaagttaatgagtccaggactgattttgttagcctttctggagctgttaagaattcctattctttcgtttttggtagtcattgtctccacatttgctttatggagtcctctttggtggatcccacaggtggggaggagacacaggattcataagatggccggtgggtgagtgacttagaatttgggttagaactggccgggcgcagtggctcatgcccgtaatcccagccctttgggaggccgaggtgggcagatcacaaggtcaggagattgagaccatcctggctaataaggtaaaaccccatctctactaaaaatacaaaaaattagctgggcgtggtggcaggtgcctgtagtcccagctacttgggtggctgaggcaggagcatggtgtgaacccaggaggcagagcttgcagtgagccgagattgagccattgcattccagcccaggagacagtgtgagactctgtctcaaaacaaacaaacaaacaaacaaataataggaacaaggacgggtgcggtagctcacgcctgtaatgccaacactctgggaatttgaggcaggaggattgcttgagttcagaagtgtgagaccatactggggaacatgacgaaacctcgtctttacaaaaaatacaaaaattagctaggcgtggtggcacacacctgtagtcctagctactcaggtggctgaggtgggaggatccattgagcctgggaggtcgaggctgcagaaagccatatttgcaccaatgcattccagcctgggtgacagagcaagaccctgtctcaataataataataattggaatacaatgtgaaatttggacattacattgtcttggtgaaatctgtaaatacaatgtaatggttttgagttttttccttatgtgaattttattaataatttatatggcagagctatcatgccatctgtatgtactaggatgttaccaaaatacatgcagttgacagtttgggaaagcatagagcaaatagtatatcctaagtagatcttttctttggctgtagtggttaaaaagatatccttaaattgtggtttggggcttttcttttttttaaacaacaaaaatttcaactcttaataaatactattttacttgtgataagaaggcaggtatgcttctggaaccacagaaatcaaacttgagagaaaaaatacaaacaattatagagagacagtctctgattaacatgaacataaaataaccatcaggtgacaaaccttttcacaagaaaaatgatctgtgcccaagatcaattttatagacattaactcaaagctgtgattttatacacaaagcagtattgtagcaatggtataaacacaggaaaaattcttgtgaaaggagtggagcctgcaaatgtggaactatgtggaaaagggaaaagtttgtagtatgtagaactatggcaggtgtttatatttcacagtgtaaaaaataaacttaaattgatatactggtttactaatgaatttatgaattttcaatgaatttatgtagagcttattctgttagatgggactaatagtaagaaatactacaaagtaggaaaagtttgtctctaggacccttttgtgaccttttttttcttgctctttcacactcctcatgtaatggtcaccatccatagatccttctctgttcactctgttcaaaagagatctccaagacctgtaggctttgttaagttatcttaaaaatgatgaataaacacactagagtattgatggattgtttcacatttaattgggactcttgaaagtccaaacagaattttcttatggtaaaattcaaacattgacgtctgttaggggagatatttatagagaagagaactttttgagtctgctccttaatttacaacctgttgtcagttgggaaggaaattaacattgttaaatgcttatatgctagtgtctgggtgtctgtgctaggtcatacacagtataatttgattctcacaatgagcttgtgagtatgacattcttattctcattttataaaacttttttttgtggggggcgatggggtctcactgtgttgcccaggctggggcacagtcactattcacaggtgtggtcatggctcactgcagcctggaactcctgggctcaagctatcttcccacctctccctccccagtagctgggactacagcttattcaagttttataagagataaactgaaagaggcatagaaagatgaagtgaccttcctaaagaggtcacagtggaggtaaatcattaaaatcaggatttcagatttcaaagcgtctacttttaccaccaagccagtatttcatagtcattttactcttctgttttactcatactcggtgaacatgacaatatctttaattaccctccagaattcctttacatgtctctaaagagatgattcttcagtttctttttgttttatatatatatatatatattttttatatatatatgtttttattatactttaagttctagggtacatgtgcacaacgtgcaggtttgttacatatgtatacatgtgccatgttggtgtgctgcacccattaactcgccatttacattagatatatctcctaatgctatccctcccccctccccccaccccacaacagcccctggtgtgtgatgttccccttcctgtgtccaagtgttctcattgttcatttcccacctatgagtgagaacatgcggtgtttggttttctgtcctggtgatagtttgctgagaatgatggtttccagcttcatccatgtccctacaaaggacatgaactcatccttttttatggctgcatagtattccatggtgtatatgtgccacattttcttaatccagtctgtcattgttggacatttggattggttccaagtctttgctattgtgagtagtgcctcaataaacatatgtgtgcatgtgtctttatagcagcatgatttatattcctttggggatatacccagtaatgggatggctgggtcaaatggtatttctagttctagatctctgaggaatcgccacactgtcttccacaatggttgaaccagtttacagtgccaccaacagtgtaaaagtgttcctgtttctccacatcctctccagcacctgttgtttcctgactttttaatgatcgccattctaactgatgtgagatgatatctcattgtggttttgatttgcagttctctgatggccagtgatgaagagcattttttcatatgtcttttggctgcgtaactgtcttcttttgagaagtgtctgttcatatcctttgcctgtttttttgatggggttgtttttttcttgtaaatttgtttgagttctttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtctttgcctatgcctatgtcctgaatggtattgcccaggttttcttctagggtttttatggttttaggtctaacatttaagtctttaatccatcttgaattaatttttgtatgagttgtaaggaatggatccagtttcagctttctacatatggctagctagttttcccagcaccatttgttaaatagggaatcctttccccatttcttgtttttgtcaggtttgtcaaagatcagatggttgtagatgtgtggtattatttctgagggctctgttctgttccattggtctgtatctctgttttggtaccagtaccatgctgttttggttactatagccttgtagtatagtttgaagtcaggtagcatggcatccagtttctttttgaatcaccacatgagaccattctgcttgtcattgattagtcttacttgaaccttttgtggtatttttagctaagagtatatagaaatgccttgttagcagagatgactgacaactacaatattcagttctaaatatattgttaggtttttgttttgttttgttttttgcagatagctaactctgaagtttgtacttagagcaagtaagtattggcaagttatgtgtgaataatgtttggaattattacagcaagaattaacaaatttcttgttatcaacactttagaatagatgtattcagtattataagcagtcttaaaatatccattcaacaaagagttacaaagtacttacatgtgccagggctatgttaggttctgcacagaatagaacatggaaaacacatggtctgtgccctcaatgagaaggtagtttaggagggaggcaaacatgatgtaattaatagaatacactctaataatcatagtaatggaggtgtgtagtaggaagagtgggagcaataggaaaggaatagttaactgcatttgagggactctgggaaagattcagagaagaggttgtagtttcaactgaggcttaaatattttgactacaagaacattcgtggtctgcttatacattttacatatacaacatttgcacaaacagcatttccctcacatgtacatatgaatgcagtatttagcttgaacatctagcctcttcctttttccctgaaatcatgcattatcatgtggattctcctccccccatatatctttttagaagacttctctcagagcttctcagttgtttccctttagttctctgctctccagcttttaaatttctctggcttttggaagcaggcagactctgtttctacagtctttaaaacagtaatgaatgaagaatgacaacggtggtgggaaatgtagaagagaacagagtaatggaactaggtccctgaatatttgatcatttttgctgtcccaaaaatgttttttttttttttctatttagaataatctccaggcttaaaagtgtgactaggtatctctcaaacacaaaatgaagttaagaaacagctgtctggaaaggaacattgtattctgtggtatactattttctggcacattttggttgtaaggctttttggtgatacaaaggattccactctgattgagcttacatatacatgcctatctctgtcttctcatatacatgcagcttctcccagacaggcacattggtggatgttaaagcaattagttttacttgaaaaaaagtatgatactatggcaagagctctggattggaattaggagactgaaattcaggtcctaccttgacctatgattaatttgttctctttgagttagtcagttaacctctcttaggtttcagttttcctgtttattaaataatgggataggataatgccctctaaggcttttcctaccccagaaattctatcattttactattgatggagttggctgttcaactcacaaatctttattgagtgcttctcaccttcaggcactgtgctaggtgcagtcaaaaagagacatagaggagagaagtagatcaatggaatataattgagaatccggaatttaaaccatacatatatggctaattggtattcaacaaggatggcaaggcgattcagtgtggaagaatagtcttcaagaaatgatgatgggacaacccgatttccacatataaaagaatgaatttggactccttacctcacaccatgtgtaaaaattaatgcaatgtgtattaaacacctaaattataagaactaaaactcttagaagaaaacataggggtgaatctttgtaattttggattgggcaatggtttattacatttgacaccaaaagcacaagcagtcaatgaaaaagaaagtatacttcatcaaaataaaaaacttgtatgtcaaaggccgctgtcaagaaagtgagaaggtcttcaggaaacaacaatttttaagaaagtgaaaagaatagagtatgggagaaaatatttgtaaatcatgaatctgataagggcctagtatccagaatatattaaaaattcttatatctcaacaatgaaaagacaacccaattaagaaatctgaatagacaatatgaatattttctccaaagaagataatcaaatggccaataatacatgaaaagatgctcaacgtcattagccatcagagaagtgcaaattaaaatcatgtgagatatcaactcacctattaggatgtctgtaaacaatgataaacagtgttggtgaggatatggagaaattggaatccccatacgctgctggtaggtttgtaaaatggtacagctgctttggaaaacagcagttcctcaaaaacttaaaacatagagttgtaggtctcagcagtctacacctgggtgtatttctaaaggcatcaaagtcatatggttgtacaaaacttgtatgtgaatgtttgtagtagtagtattcgtaattgcctcccaaaccacaaatgtccaatcaactgtagagtggataagcaaattatgattattcataaaatggagcattattcagacagaaaagaaatgaaataaccttgaaaagctcggctaagtgaaaaaaactacacacaaaaggctacatattgtatgattcattaatatgaaatatccaaaataggaaaatccttagggacagaaagtggtttcatggtcaggagatgaggggatgagggaatggagaatgactgctaatgagttctggatttatatttggggcgatgaaaagttctggaattagtagtggtagttgcactgccttgtgaatgtaataaaaactatggcttgtatactttaaaatggcgatttttatggtatgtgaactatcgctctctttttttttttttttttgtggcggatcactgtcttgcccggactggagtacacaggcgtgatctttgctcactgcaacctctgcctcctcggttcaagtgattctcctgcctcagcctcctgagtaggtgggattacaggcgcatgcctctacacccagctcatttttgtatttttagtagagatggagtttcaccatgttggtcaggttagtatcgaactcctgacctgtgatctgcccacctctgcctcccaaagtgctgggattacaggcgtgagccaccacgcccggcctatatctcagttttttaaaagttgtggcacctaactaaaatgaactgtttttgatagggatagagaagggttctgtaggagtatacagaatgacattttgacctactgtgtgaagttgacagcaaactcctgaaataagtaatatttcaacagagacctgaaaaatgaattggagttactcatgtgaaaaaactgttagcaatggaaatgaggaaacatgtaagaatatatcagttaaaattaacagctgaaagccaattttagctgtaacaggtataagctcctacttgtgtcactatgtaagattttgtcaaagactttttgccttaagtaatgtaattatccatggagaaccatagcaatataatatttgttataaaatatatatattatatatatgtatgtatatctcctagcttctggggaaaacagggcatttattttttattttttgattctaaatatttttaaattatagtttatggcattttataattttaaatattcttgaagccagaactaaattctagagtttgtttatgctttatttttttccccctctctatatattttataaggcaattttctaagctttgatcctatggaaattttaccgttttcattacttttgacagtttgagattagtttcagaaccctgtaagcaaatagtaaatataattagggaaaattaaaatatttctgtttcctggtaggcaataagacattaagaaaaaaattcagacttataccaaagtagaggcaagtataatcagcacccatgtaatcatcaccagcttcaaaaattttcaactcatgaccaatcttattttatctatatatccacttactcctttacccactgggttattttgaagcaaatctcagatactgtatcatatgtaaattttttatctctaaatgacaaatctttcaaaaaatatatactattgggtatttttttaacttgaaaatacttctttcttgtgaagtattaattaaaaagttatctattagtggaaatactctatatagttttttatttgcttatatatccattctaataaatattaggtatgtttataaaaataataaaattgaggttatgagaatgtggttcatatattagtctatgctcatctttgtgattaattatgatcaacgaaaccataggcatgataaaactcttctctatagccactgattatctccttttatcataaccaatggccttaactctgttatgccttctgggtgtgtctatcatttaatttattgattgccccctcctcattgaaacattcatctcccatggcttccctgatgtttggctttcctgtttcattgctgcattggactgtgctcttttactgacatactttcttttgatacctacataatgtgactataacccatccttactctgttcttgagccttttctgccctctgcaaattcttagctcttctgctgtcatggctacaaatcttctttgtgtatcagtgaattccaggtacttattaaaataacaaatcaaagaacttctctttagtgttgtagttgaaaaaaacttccccatgggtatgccattgtcatcataagttcagatttttaaaaactgagattatcttctttttcattaatatcaatttcctttcagctttcctctactgacaaatcaccagactagaaacattcatatcttctacctacttcagtcccctgtgcacgtgctattatcttctactgttaattattccttcaaaatacatgctatttatgttttcatttattgcctattctaggcattttcttcttctaggaaacttttcttcactactctagttgcctaaatgttcatctctgtgattccataaagtctatgtgttctccacaatcaagataatattttatgtgtcttttcctcatttgaattcaagctcttgagtggctgagattggagattgggggttgtttatgtttgtgccatagaacatgagacattgtaatgtttgttaaatgttaattgaactcctaatctctttacctgtattactgcaatatctacctaaggtcttgcctttccctggcagaacattgtgtataaagtaatcttaattctttgtgaagccaatgaagacagtagattctctattaaagtaccctgtacatttccatcataggactaattgcaatttaaaattattattaattttcttttttattttctttctccccctgggataccctctgtaatggtagtcttacacacagtagggccttagtaaatgtttattgaatatgaatggatgcccctcctcaccagttgagagcagtgcacatatatgtaatacaaattatttaacagtgattacaaaccttaagcctttgctctatttgctaccagactgattttctaaaatagtgtttttaaaagttcactcaaacttactctgtgccagacttacaataagttttgagaatacaggcacaaataaagacataattcctgcattttatggaatttggaaataaagaggaagaaatgcttaaacctctttggacaggccaagaaaagctttgtagaggacacctgatatctttaaggttcttttcagccaaaaaattgtataattcacaggtgcccttttctgtggcagtaggtaaaaaccttggtagctgcaaagagaagacagctgccagcagggtatttttggctgttcctgaggctgccctcattctgattaacttgaacgtttacttcggcctgaggagtaactttgtaacttaaatctaatttcttactaaatagagattatttttagattatccattattttgttagcagagataattgaaaggagaatttagtaatgttttctgtgactttactgaagccagttcaaactttattgtttaatttttgtttggttaacaagggaatcaggagacattagcacttcctactaataatacatcatataacttatttatcctgttaattttctctttcaatcccgctagaatgtaaactctataagaagggatttttgttcttcgctcaataaatatttgtgaaatgaatacttaggaagtcattggtagccttaccagggtagtttaaataaagtggtggagatggaagctggtttacatggttgagggttgcctgggtttgcggttcaaaatcaaacagtaatagtagtatttttttttcttttccttttgaaagtttggtggtaaggaagatatttatgaaaattctcttcttagtcacttctatttctttttactgctggtaacttataaaggcttttaaaattaacaagtcctcttgtttctttttaaaatttaaataagttttatacacattaaatgtattactgtaagccatataatctcaaatacttaggactttttagatttttagaataagtaaaacttttaggtatttttctctttaccctaaacacagccgtgaaatgatgtatcaataagtggttttggattattttttaacatcaataaatatgcaccaaaagtaaatatatgtataaatgaatttacattattcagaattctagaattagacatctgtctaatgaatgctgttctaaatgttgctaaatgattaatagtaattaaaaggttaaatacaagctggagaaagctttgaattttgaaatgtttgcaacagctagtaatctgactgatgcagacgtttttgtcaaagttgaaaaagttagagctaattaatttcttgggagacatatgatgagattgtaggtgtgataacatatttgagtaacatatggtagttatggggcacctttctaatgactgagcagccagttaaatatagacttttttggttttatttattttattaccattctttgttactgtgtatttttaaaccaattttgttttctgtaatagaggtcagtactcgggattttaacaatttatatttaaaatgttaataggaatatggtacttctctttgaaactgaaataaattttagtgaaagttttcttaaaaatacagctatttcctaccaacgtatttgtgtattatacttttaagattaaatcaaatgtatagggaattgtactctcagtacacagtgtttcactgagattactattgaatgagtacttaaaaaatgttacttttgatacacggcacaaatgtatttttttcccataaggattcattatttgcattttgactaattttcttccagccccttttactttatagagttttatttcagtttctgaatattaataatgacaaatgacaacagattaaaagggaattaaaattatttttatatctgttattaaaatagtatcttaacaccttggtagagaaaattttgacatgagaattttgcaaatagaggcataaagtagcgacttagatgtttttatttttaaagtttggaattttaccaaaatttatatgattgtaatctgttgtataagccccaaattttctgtcattcagaaatatcggcagtgaaatccgagttcagggtaaaaatgtttctgttgtgctgcagagccagccactggagggtgttcatgttaacttcgtagtctcagtattctgctgattagattgatgaaaaagtgaagactgtccatttacaagtcttttgaaattaaagcaaaagtactattcgtgtctgaaatggaaataaacagaaaaggagttttaaaccttaaaggaaatatgatatttaaattctaaaattagtaagcaaataactttcttttgctttttactcaaagacactggtcagtaataactgtaattttgaatatacttacaaaattatatgcagttatgaggttctgataagtacacaaacatcccaaatttatttactaaacttttttgacattgttctaatcgttttcatttaaatttgagtatgctatagaattttgatgtgtacatctgctctgtgactccttccttattttaaatctgttgcaaaattttccccaatcagttggcatgcttttaagccagtagtgataaacagatatccatgaagggctggtagagtcttttgtcctgaatgggttttgagctcaagcctaaagtaaatattaaggtgaacttccaagtgattcacagtaaagcactagcttctcattcattgaatataattgataaagtttgtattattacatagttatgataggattttaaagacagcaggattctctgaaatatagcttaccaattggaaaattactttagtgtgatgtattctgaggctgtaaagtttatatcatttttaattgataaaattgttctaagttcttattagaatcttgagaaacaaaaattctactgagtaggctgtttattcactttttaaaaatgtatgcgaatttcagtagaataaaatgatgatttagaaattggttttagtttattagttaacagtagtaaaataaactttatattgtttttctttattagagtaataagccgtacaattttgtatagctagtaggcaatacttaatggagaatgaggggataatttttcattcagtagaaaaatttgatatttgatttcatagttgagtaattatacttagaaatatcaattttttgctttcataagttgttaaaatattttctactcagataagtctgtctttatgtcataaagtaagtaaatgacagatatcagatccataagccaacattaaaattcactataatatacttggccctaatcctgaaagctctggttcgttctagaaatgtttctggaacagtgagtacatgattttgggagattagaagatttacattttaaatacagtgtcaatgatctttaccttgccatgcataaattgtgttgccagatgtgcttaggtcaatgttttaaccattcacatatcctgtttattttatgaaattatttcatgagtcttgaagtgggacttatgattgaaacgaagggtttgagagaaagtatgttaatagtcttattaatagtacggaaaacagtccgtttggagcatgatgcgctctgtcacatagaaacagtttttggatgctttcatagccatctgtagagggtggatcattgattatacatcagtcagataaaaaagataattttgacattatctcttcttcctgaaataccttgcttctgaaaaatgtgtgttagcttgatcaaattattacaaaggagtttcaaagggggtatttaataaacatattacatagcaaatttattgtctatgatttttagtattttctgttgacataaatttaggaacagatgatcagcaatctaaacagaataaatgattatttttcccctctaggaatgaaagataactttaataaacataatttaagtatccatttcacatgatttagtcactaaatacatgccagaaattcttagacactcagaattcctaagaagatattaaacgtattcttcagaaatttgggggtaactgtagatgtttttattcatttacagttgccaggtatcctgaccaaaatgtgttattttgacgtttagaaattgtcctagcatcccaatttcttatgaggtactcagtttggattagtgacagtgcaacgttgagacaagagagattccaggataaaggaatcaaaattctgtgcctttttgcttcagtaagaaaatacttattatatttcttaaaatgtgtacatattttttaaagtacattcatctttccttaaaaaatttaacatcattaagttaatagtatctcttcccagctaacagttacttcttattaaatatccaacgtggtgctatgggctttgcttgtagttgtcatttaatgtgtttaaatggttaagggtaaagtaactcatgtgagtgggatcatacaatatttttccctttgtgactggcctatttcatttagcttaatgtctttagggttcacccattttgtaccatgtgtcaaaatttctttttttaagactgagtaatgttccattgtatgtatatgccacatattgtttatccatttatccattgatggtcttttagtttttatttgtgcgaaaatgcattcattttttccatatttttaaaggatgtttttactgagtaagacagttctaggtcagggtttattttcttttactcactgaagataagcattcctctgtctaaattatgatatttagcttgtccattgagtctttatttttggacatcgtatttttcagttctcaaaatttgtttctcttccaaattagacatgtctcttgtatagttttatatttcactgaggaaaatttcaagtttggcttctgttttcttgtacatagagtaaatgtagttgtttcatttacactctgtgtctgatactttcagtatttgaagtccctgctctggtgtcttggcttattagatgctggttataaatactggctgtgctggttattattcatgttagttatgttacataaaggggccacagatactgacccattgctctaggtgaaatacagggctgggttcttgcaagtctctggtcacgtcttcatcagctgatcaattacataacctggttttatgtgtgtttctgtttgaggacatcttatttaatattatttattaattaacattgaactcatggccatgaacactataactcatgcctgaatgaagcttatttaaacaaacatttattctccataaggcatatcatagccttcttttgctgagaaacactaggtgagacttcaacactatacatgagggccattaaactgaaatcaccaacaggaagcacaaaaatgtgaaaaacatggcactaaatactgtgaaaaggacattgtttgtaataggagagctgaaggaagaaggctgagtgacaccttgttcagcctcatgtgagaacatgggcatcagtttattcaaatttttttgctgctctatgcctgcaaatgacccctaaagcacccagattttttatcacaaataattttaggtgagtaggtgaatttgcaaatacagaatccatgaataatgaagattaaatatgttagctgggcatagtatttgaaaattatttgtagaaatatgaagccttgggttgggcatggtggctcccatggtaatcccagcactttgggaggctgaagctggaggatcacttgagactaggagttcaagactagcctgggcaacatagcaatatcctgtctccatgacaaaaaaaaaaaaaaaaaaaaaagccagatatagaggtacatgcctgtagtcccagctatttgagaggctgagataggaggatgcttgagcccaggaggttgaggctgcagtgggcaaaggccacaccaccgtactcctgtctgggcgacagagtgagaccctgtctctaaaaagacaaaatgaagccttgagtaaagttatcttcatttaatatctgctggatgccttggatagcaatctaggagtagcctaacccaagtttaaagcctaaagtttcctggtccactcaggtgacatgaatctagggtgcagatctgtgcaagatttagtttattttttggttccccattgacattaacgatcagccatttgtgatttcagcttaatgtggcaattgacttatcagagtcctaattttgtcttacattttaaattgttctcagtggagtattcatctgaattattcaatctgatatttacagaagcagaaccttccttttatccttcttaattttaatttctcctgccttgtgattttcgtattaccatctcctctttttccttcttctttcctaggtttgtgaagcatttactacagttgttataagattaaataactgttctcatttaagtacatttcttaaacttacactaagatgtgaccttcagattgctttaataatgtaagaaataagttcattttaaaaagaaatctggatgttggaacaagaccttgaatttttattttttttttctttttaattcataatattattcattacccatcatgttattttgggaaggtatagcataaaatatgatttagtaatttagctttcacctaagtttttattgtactttatgatataggactggctgtcatgaaaaagttaaatttgatggacattctctcatcaaatttgtccttgtattattttattttatttttaatttaatttaatttaatttaattttattttttggtgagacagggttttactctgttgctcaggctggagtgcagtgcagtggtccgatcatagctcactgcagcctcgacctcctgggctcaagctctcctcccacctcagtttcctgagtatctgggactactggtgcacaccaccacgcccagctaatttttgtagttttttatagagacgaggttttggcattttgcccaggctggtcttgaactcctggacccaagtgatcctcctgccttggcctcccaaagtgctgggattacaggcatgagccacctccctttattctgtttttcagggagcagccccactgatcctacttaacttaagtcagaatgatttggctcttctgctcagaaacctcctgtagcgtcccatatcagtaaaagccgaaagtcctttcaggaatctataggactctagatgaggtgtccccaacccccagcctgtggacaagtactggtccctgacctgttaggacctgggacacacagcaagaggtgagcgagcattaccacctaagctccgcctcctgtcagatcagatgcgaggttagattctcataggagtgcgaaccctattgtgaactctgcatgcgagggatctaggttgcacgctccttactaactctaactaatgaatctaatgaaatctaatgcctgatgatctgagtggaacagtttcagcccgacaccttctccccctacctcttccaaggtctatggaaaaattgtcttccatgaaactggtccctggtgccagaaaggttggggactgctgctctagatgatctggctcctcattacctctctgatctcagtttctgctacttcctgcttcatgctcttattgcagcttttttgtcttcctggaacatgtcaggcattttccatcttaaagccttgctattccctatgtcaagaaaactctttcccacaggtatctatatcgagcttcctcacatcgttttaattttccttaaaagttgccgtctcaatgagacttcccttggttactttagtcttccccaaagtattatattccctcctttgctatatttttctcctagcatttttcgtactatataaccttttttctcccccatggaaatataaactccgtgaaagcagtgatttttgtctaccatcctcccagtgcctgtcagagagtctggcacttaatatttgtcaagtgaataacaaatgcatgaaatttattaccataacctatttaagagctttaagtgttaattagatagctgggtgtggtggctcatgcccgtgatcccagcactttgggaggccgaggcgggtggatcacctgaggtcaggagttagaaaacagtctggccaacatggcgaaactccgtctctactgaaaatacaaaaaaattagctggatgtggtggcgtgtacctgtagtcccagctactcgggaggctgaagcaccagaatcgcttgaacctgagaggcggaggttgcagtgagccgagattgcgccactatacttcagcctgggtgaaagagcaagattccatatgaaaaaaaaaaaagtattaattagataaatctgtatcaaaaagtaagtagagactgcaagtgtaagaactttgacattgcatttatttttattttgaaataatttcaaacttaaagaaaagttgtaagaataatgctttttcttctttatctttttttctgagatggagtttcgctctttgctgcctgggctggagtgcagtggcacgatcttggctcactgcagcctccgcctcccgggttcaagcgattctcctgtctcagcctcctgagtagcagggattacaggcacctgataccacgcccagctaatttttgtatttttagtagagatggggtttcaccatgttggccaggctggtcttgaagtcctgacctcaggtgatccacccgcctcagcctcccaaagtgctgggtttacaggcatgagccagtgcactgagcacataatgctttttctaatgaaccatttgagagtgagatgctcctttactgttgattactttggtgcatttttgtagcattgacatgctcttatgtaaaaagagtataactattaaagcaagatattaatagtgatatatcaatcactaccatctgatcatcagaccccattcagattttgccaattctttcgataatgtctttcattgcaaaattctaacccaggatctgtgcatttgattgtcagggctctttactctcttcatgtggaatggcttcatagtctttccttttatggcttttatgcttttaaagattacatgccagttattttgtagagcatcccataattagagtttgtctaatgtttcttcctgattagatgtaggttatacatttttggcagcaatgtcacaaaagtgatgttttgttcttattgtattctgaattgatactcaattttggtttattccattattactgatgttaactttgatcacctgaaggtagtgactactagttttctccactgtagaggtactcttttgtcctttgttattattttctaaggaggtaatttgagaccatgtaaatattatgtttctctttgactcattagttttagcatttattgatgtttcttgcctaacttagttgtgactaagatgaatgtcaagtggtgactttctaatttgttgtttcttcaacattcattagttgggattctcttataaggaaactctccattcatagattcattatttatttttatcaatatgggctcatggattcttgttttattcaacaaatgagtcatagtgttttcgtattatgtattttgatatccagattgtctcagatgtggccagcgggattcccttcaaacttctgtgccctttaacatgtccccatcattctctgagcaccttcttactctctggcacagtaagatggtcccagctccgcttgtgatatccctgcttcagccctggaatcagcagttttccagagactcttgattcttttttgtgtggagaatgatatttagaaccctaaatctgggtatcaattgtgttccctgtattgagtgtcactgttgtcaagctctttcattaaaaataaaattaggaaataattgtatgacatactcacttattcttacgatttctgcatctgtatattaaaaactgaatttgtattgacatttcaatttctatctcacaccaaagagtccattctagcttcatcctttttatatttgtaacttccagtgagaaacaggggttcagttatctacaatatatgacttatatggttcatcttctgtatataaccaatctctcaatcatgctggccactacttcttgtggtcacttccttgattgggcttgacccttttctcctagcttccccctacagtaccagcagattcttacttcctttggccatgcctaaatacttaagaaaagaaaggccttcacattttaatgcatactttggggattcccatatcccaccaaagcttatgctttgatctttaggtggaattgctttatgataaaagggttcttttactgttcattttggatgatgtggatgagtcttagagttttattctggtctttacaaatatgatttgctattttctaaacttatctaatgactaacttaaggcttgttatgataagattataagaaaacactttggggaatcttgagagttttctttgtaattataatttataattctgtaacatagagaacatgattaacatgaagctctaaatgtatccaatagttttgctttcttatcagtgaatctatcagtatactagtagtaactggagaatttcaaagatatgcttacactttaaaccctcaatttccagtgcttcaggtgggtttgcacatatgacaagacaggcaaggagtaagaaggagccagtataagaattaaaaaggagaccgggcacggcgacttatgcctgtaatcctagcactttggtggccgaggcgggcagatcacttgggctcaggagttcgagaccaccctgggcaacatggctaaaccctgtctctactaaaaaaaaaaaaaaaaaaattaaccaggcgtggtgtcgcccgcctgtaatccccactgctctggaggctgaggcatgagaattgcttgaacccaggaggcggaggtggcagtgagccaagattgtgccactgcactccagcctgggggacacagcgagactctgtctccaaaaaaaccaataataattaaaaaggacttgagtgatacatttattaatttggcaaatatttattgatgatttcctacatatcaagctgctctgctggaagactgtaagtcaaaatagggttcttgacttcatggaatggtttcctcacttcagcatttttgaacccgatcattcttcctcgtcatagcaggctgtcctgtgcgctataagatgattagcagcatccctggcttctgcccgtgaggtcagctgtctccagccttcttggcaccgggggctgctttcatggaacacagtttttctgtgaacctgggtggtgtgtgggaggggggacggttttgggatgaaactgttgcacttcagaccatcaggtattagttagattctcaaaggaccatgcaacctagatccctcgcatgcacagttcacaatagggttcgcactcctgtgagaatctgttgccacagctgatctgataggaggtggagctcaggtggtaatgctcgctcacctgctgctcacctcttgctgcgtggcctggttcctaacagccaccatccgcggcccaggggtggggaccctgcacttggtaacagcacctcctatctctccatccctcagcacattggcagtaaccaagaatgtctctatgtgttgccaaatgtccagtgagggtggggagcacatcactactcctggttttgagtaccactgctcacagtaaaatcaaatgcagatacaggcattctacagctaatcattcagtgtaattatcaactgtggtaaatgctaattatggaaagtacagagggccatgagactgtaaccaagaaaataatgactccataataaatttggagttcagtcaaacaaatcaaagtttcccttgagtgtatagtaggtatttgatgtcagaaaagaaacttaagacatggtcttttactttaaggataagctggctgtgtatcttccaaaccagtaccctgttgagagtgaaagcgtgctctataataaggaaactgggaaaataaatagagatgaggcaaattgtacataatctacttccaggctttcattatctacccagagaataagaccagtatatgaaacacacagagaataattcaagacagtatatacattaagcgctaacctatgtcacattattagaagagagggttcattgttacttctccatctttgctttatagaaggcttcatgggaaaagatgggattctagcccttcaatttagttctggaggtttgccataaaatatctcaatgttcctattcagttattttacactctactacctaagcccctaacctgttcaagagttgtgtttgacatagcagacaatagagaacaactggagagtcttgatgaggaatatattatgatgaaatggttacaactcctagaagaaacattcatttctctaccaaccttgatcagcattgaggtacaaaagaacagtattatacaactatcagatgtacatactgaaaggacatttctttcttaaaccaaattctagaagttttttattgaaaacagatttcctagggtcatttgtgtgtatatatatctaaggggacattgttggcttgtttctctttcaatttttaggtcaattttgaagatactagattttgagaaactatgtttaggggaaaggggaagaaactgtaggaaagtgaaaaatcgtacgcttttaggttagtgctaatctgcttacgtaggaactttctgcatccaaataccttgctttatattccctagctttctttttaaaatgttgcttttactttaattttttacactgcttaagaccccatagattatacatttatttaagttcatagtcatggaacttaattacttttaaaaaggtttaggcatgttctttcacttactccttagaagcagttcgcattctttgtgttgcctgtgaaatcggatggtgatatagggcttaaattttgaaatatgggacatttggagaacttaaggcaaatcaaaatggcataacatgatggaggaagcatgaagaccttgtgactggtagaaacaacaagaggatgtaggaaaagactatgtattgggaaagggggtagaaactatgccaaaattccatttgcccacttcagatgtctgcttgggacgaagtctgtgcctgggaaaagggatgaaaactttaacttcctttccccccacactttcatcccaagagcctagaattagagctgatttaatggtactaactagtactgttaaactaactagtactgttaatagacctttatgacagcatcctcagagttaactatttatataattgttctctggagcaaagcattcagagttcccagaagctacagtgaatttcacaccacttataaaccaagggactacctgcaaagtgtttctgttattttaaaatctaaagtctatttgaatttgaaaaaataaaatgaaaagttgaaaataccaaatctaagacttgtgtgtaattgaaatgaggttgttttagaaaattaaatttggcaagtgattaatgcttaataaggagtaattgttttatctattttagggaaaaattaatttaacaaacctattattatgtgaaatttaggtaatgaacatgggcagtacataatttccgtaacatttatagcatcgaccacaaaaaggctgaattagtgtcatcaaatacaaagaatgttcatttcagaatcaaagctgttcggaaagcagtgctcatggttactataattaattcaacatttcaggactatttaaaattgttatgtcatatcactttagtagatatacctttcagatgcatatatgcctgattttggataagtgtattttttgtacttttcagtttaaaaatttttttcttagttaaaaatgttctctcatttaatgatttttggttttgtatcaaaagcaaagaaactttcagttatctcttaaataataaaacagaggtcgcccaacctgcactgttttggaccctgtatacagcattaacccagctcaacagctggctgtgattggctagccaatcagagtaccaattctgtagtgtcctccacctttccctgaagctagtagagttttggttgagtggggtataaatgtgaatagcagattagctaattaaaatggtcctagatagttgtaggctccagtgctgaagttcctggaggataatccaacctccctaaactctcttgataccgaagaactcacctggaatagctacagcctacttttctgtccccctccccaccttccctgcaagctctcttcccctgtgggctgggtcctgtttcagctcttccatgcatgtctcaggaactgttcctgtagacaaaggtccattcagcactagaatgctttttccaggctgcatttctaaatctgagtccctgtgtatcttccagatcaaagtgcccctctccccacaacaatggactagatttgccagggcctcatagcagaatatcctgtctgactctctcttcactagactaaggagaaaaaataacaaaacaaaaatgaagaatttattttaaaagatgaatatagcattcccccctcccctaaaaagaaatgagcaactattacttacacaaaatgtagatacaactgtattccttgtaggattacttattaaagctttcttgatacgtaaatctaaatccaagcgtttggcatgaatgtctgcttcatttatcattgccttggatatgctttaaagagtctgtcacagctggtctacaaatggatttttgcacacaccaaaacttgccttgtggcaaatgttttataaaagttgtatagaggcttcaaatattgttcttcatgattctttgctgctaattttccagaagtccttctctttcagagtctttttttttttgagaagcatttaagaaaattatgttgagtttggtgtaaattagagttgtgacaaattatagagcagttttcacaagtaaaattgggccagttagctcagaattagaaaattaatctttttccaaagcattatctcactttctgtgtgtttgtagtgtttatagactgatagtatcagtaccaacagctaaaacaaaagtcagttttttttcttttaaaaaacattatttctttttaatgaacagttattgaagtattggccttaattggctaggtgtggtggctcatacctgtaatcccagcactttgggaggccgaggcgggcagatcaccggaggtcaggagtttgaggtcagcctggccaacacagtgaaactccgtctctactaaaaataccaaaattagccaggtgtgatggcaggcacctgtagtcccagctactcgagaagctgaagcaggagaatcacttgaacccaggaggcagagtttgcagtgaactgagattgtgccactgcactccagcctgggcgacaaagggagactctgtctcaaaaaaaaaaaaaaaagattagccttaatcaacaagcatttactaataacttaccggtaaagagtagtatattcagatttaaaacattttgaagaaatgcccagaagtggaggacaaaggcattgagcttgctgtccttgtaaaataccgtgtgtgcgtgcgtgcgtgtgtgtgtgtgtgtgtgtgtgtgtatacgtgcatgcatgtgagaggggagagaaggtgggagaaggaggcatacagtagttgcaagttaacataatagagaatttttaaaaccttaggacacatctaaagatgatacaaaatgtatgttaatgcaagataaaatttggtttattagggacagtgaattatgatttgaaataattggggcaaatttaaccaagtagggttaaagcattactttgaaggaaaggagggtattaagcagtacataattttgagctaaattcataggcaaatcaatttctatttagaaactgaagcactttctttataaaagcatgacttcgcctctttatttgctcaagtatatatgaggccatattgcatttagcctatatgagaaggagaagaaagcagagaaggagttatgagggagattggaagagaataaaaagatcacttcactttagatgccaagcaagagcaattattacagcattatttcaggattcaaggacaacaaggcctgtaaagaggccactgataacctcattggtgactttgtggagatcagtagtagtgatggtaaatagcaaattggcaggagttgaagagtgaatggatactgaagaaatggagacagtaatcatagatttttcttctgagttattttttgataaaaggaaagaaaatagattacagcaagccaaagaaagatgatttttggatgggatgttttgagcatattcataggttgaaggaatggagtcaaaatacagagggaaattcagaaagatccaagagagagattcatcatttgacataatcaaatcttagatgacagtaaagatgggacacaagaaagaggggttagttcttgaaaactagaatgtatatgacttcctttgttataagtaaagggggtattctgaatgtttgaagtagagagctgggaagttgaagttattcacgtttaatggtttccctgctttctaggaagtagggatattataaaatgagaaagatggggttgggggagaggggtttgaagagggataaagaagatgtggcatgattcctttagaaaacaatcatgatcaagtcaactagagatgaatgaaataatttcccaggtttgcatgaattatgatagatttatttggtttagtttcgtgatttagtatagcagtactcagaagagttccacataaaatggattatatcatatacctaggatggagactgataagatgtgtataatgaaagaaaaagtggattagaaaaatatagaatgatcagggattccatagaatgagacaagtagaagggaacttttcaactgagaaaatagggagagaatgaaggactagaagtggtaaggaaaaggaaggaggaagttcagtagaactgaggaaattataatattagcttaaaatattaaagtattcatgcaacagtgtgtgagggcctgccatatgctaggtactgttcatttgtatttacaacagatgaagtaccaagtagtacttcaatggagttgccactagatgtcactctgattcgtatggtaaggctaaccttgacacgtactcaagattggggctttgaaagtcagacctgtataaacaggcaatttttaatagcctatgcagatcaattattatccagaaatcttattcatataactaaactacttttgagagaatattctcatgagaacaaaacctctcaaatttgaaaacttcaagttattaatactgtgtttgcattattgatttatttttattatcttaatcacactaaatagtatttctcagtgaactttaacattttctgaaattctacattaaagtttgtgaatttattttctttatattgttttatttacttatctgctgaattggttctggttttatagggactaatgaatttttataagcactaataaagctgcttctttctaagtggtgaagattgtgcatgtgaacaccaaagttgtgagtatagttttacactgtgtggccttcctatcaactagaaggaagaacactgtctatccaactcttgtttttttttttaagtcccattcttgttttctgttcaatcagtatagctttgcctctttatcttcatgttgaaataaagggtcatgtttagaaagcttgtcagaattcctgcctatccacaattttttacaacttggttctttcaaaactctgaacaattttggatagctatgcaatataaatattaaaacacaaaaaaccagacacaccagcaaaccatgttgatttccactgaatcatataaacaatacccaggcatgctatatgttttaaaagatatatttatgtttgtgtatcttttaattttttcttcatttgacaggggaaagatgtgagattatacagcattgctagaaccgttgggccttagtataaaacaatttacaggtcattatggttgaaaaagcatagcatcacattttttgcatgtgctatgcctaggtatatttcagtgcttgcttcagacatcgtttcattactgactcttaccgatccttgttattcattatggtgttaagtaatttttagccatgtttgcaagaaacctatactatgtcttaagtgaactgtcttacatttatcccttttgattttttttgtgtttatggataaagtcagtttacaataagtttaatgtggttttctatggtaattcccaatgtgatactaagagtttcatttgcaaaggtacctatttactaagcatgttgttaggtgacattttggtctgttcattgaagatatctccctttaatctcttcattgtgtcttgggaaagaagtcattttgctttggacaagtgaacgtgaacatgctgcatttactgggctgtactgggtagaatacaagtacaagagagaaggtcagttacaacttagcagcaatggcaatgtaattttactttccccaaattttgttgaagcagtcattaagaattacactctataataaaaaaagcatgaaaatatgatgcagaaatctccgttaatgaaattcctcttgaaattatcctctaattcccttttaattctcaaattcactttgccgtataactttcaaaatgaaacttctgacatttttgtttgttcttggaaaaagtgttcatttctttgcagttttacggtgaaaataatatcctatatttctttttaggaatatattcctttgttgtgctaggaacagtaagtttatttagataatagccatctacactctctatctctaatccccaaaggccttaacctccattaggaataaatgtagatttttgtttgcttgaaatagcttcctgggcatgtaaaaacccctttgacatcattatttaggggctcccatcctcccaatggaatcacagcctaatacaaaaactttgcagctggtgagctcccaaagccccttttgatgattgttgttaaactcagcatggcagcttgcagttgttcctttcctgtactgccccccaccccccatgttcatgttcttcatgacaataagaattctccagaggtaaaacacagggctgaaaatttctgatgtctccttcatcctctgtttcttctcattcatttccattctaagcatatttataaagtttagtggagattatcaagggaaagattcgttctctctctgtctctaataaactaatttctttaaaaacaaacaattgaatatgaaagcattgaatatgcagaggttatgagacccctcatcttttctgtagagtatgttagtttcaggtacattagaaatcagaggtcctggctgtgacttagttcaaacttggaagtttcttatgtcatactgtgttctttattgataaagtgaggggacaaataacccaagcaagtggtaattaaatgattcattaactcagtgacacactaattgaccagaaattttctctaaagtttttgttctaactttaactggctgtatcaagtataggcttatgttggtattatttaggggaaaaaacatttatcactcaagataaagcatgtttagctcattgaaatgtaaagacagaatacattttaatagaacaattacatatgatatgatttagatattatgaaaataacaaccataattgagaaagatctaaaaagacctgggactgataggcaagttagaaatggacgttaaattattgaaaaaaacatacggagacaaacatgttagaaaataaagtactccctatgtttgagtttagtaaaataagcattaaaatagggctaaatggaaacagaaacaaagcaaagtaaaaaatcatcgaatgaacctgaaagatctttttgattccacatagggaatttgtttttttgaagtttttgatacctgcattaaagctgaattttagagttaatgcagattttgctacattaatttttttgaagttctgaatgcattgagttttggaaactattttcaggatgaatactacgggtactgcagatgctcactttatataattatgtgtcttgaattaattaaatccaacttcaaaggcatgtatcggaaattcctttgcataataaaacctccattcctagtgccagtgataaaatgagcagcagaatggtttagcaggggtgtccagtcttttgacttccctgggacacattggaagaggaattgtcttgggccacacgatgagctaaaaaaaaatcaaaataaatcctataatgttttaagctcgtgaattgtgttgaggcgcattcaaagctgttctgggctgcatgtggcctgagggtcacaggttggacaagcttggtttaaagggaatagggacaaattctcattccagagagctgagtactgactaatatcatctattaccacatacttttgtgaccctgggcaaatcacttttcctgtttttgtaaaataaggaggattgaccaaaatcatctctaaatccatacatgtttttagtatgctctgatcattttaaaataaataattttgacatcatatctcgttttcttaaaaattgatatgcccaatactcttattttatttttgagacaggatctccctctgttgcccaggctggagtgcagtggcatgatcatagctcactgcaacctcaacctcctgggctcaagtaatccttccacctcagcctcttgagtagctgggactgtacaggtgcacaccaccacgccgggctaatttttaaattttccgtagaggacgggcttaccatattgcccaggctggtcttgaactcctgggctcaagtgatcctcttgcctcagcctccccaccccaaaaaaatcctgctaggattacaggcctgagccactgcccccagcctacttttattttagaactgagagcttcagtaagatcataacaggaaaatttaaaatctcccccattacttgtaaaagaacatctttttgagaaattaaaacaattttttttttttaatgagccaaggactcatgaatacagtgatcacaaatgagatcccctcatggtgatgagaatagccatttcagaaattaccactgaacatagtaaagaatactggaactaatagttggtggtgtaaaatgtgatcaatcaagagagtctatttctgttatgtataataattttttttttttttttttttttgagacggagtctcgctctgtcacccaggctggagtgcaggggcgcgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgggattacaggcgtgagccaccgcgcccggccaataattttttaaggtaaactttttcttaaagtatgagatacataaaagtgaaagaatcataagaatacggctctgtaaatattcatgaagtaagcacaccatgtaacacctatatttaaaaaacaatattaccactaccttataagccttcccttcctctacccttacagtcactatgtcccaccaagcaaacaggatgacttctacagcatatattagttttgcctgcttttgagtatgaaatcatatggcggctttttcaaaattttatttgtgagatttattgatgttgttgtttgtactaacagttcattcaggcccattgctgtattatatttccactgcatgactagaccctagtttatctgttctatttttggatttgttttgtttttacattttggctgtatgtctttgggtgtgcatacatacacatttctgttggctatgtacctagaagtggggctgctggatcatagaacgtgcatatgttcaacttttgtagatgctgctagatgctttccttaagtgtttattctttatattccagcagcagtttgtaagtttcatttgttctatatcttcaccaacacttggtgatattgttggtagagatgggcctcttcctatggttgctgaggctggtcttaaactcctgggtgtaagcaatccttccaaagtgctgggattacaggcatgacaggtgtagcatcaaccttggccagtaatgtggttttaatttgtattcccctgataactaatgaagtagaactctttttcatatatttactattcatttggagtactaaaaaaattttatgacacttgcattttaaaatattaaactttcctatgttaagaagggctgttgtaaattagttattttctaaaacatttggcataatcattcagtctatctctgtatttgataagttgtgaaattctttgaaaatatttttttccttaataaaactatgtatttcaaaccatggaattgatttcaaatgctaccttctgagtgttattaagactatttattcatagtatttttgaaaacaagactagaaaaaatgaagtgttttaaacaaacagtggtttttccttccagggaagtcttctccaggaaatttctttgccaggatggtcaagtcccttatatacaaagtttttcttccagggtaaaattattaggcattgtagagggtataattaaaagttgatctgcctaattttaggtttaccggccaattacaaccttatcattgaacacagagtttggaagattcttgagcagtattttagagctgtttttgagatggagaccaacttttctatgtgctcctacattttcgagccttccgtgcacttcctttggatctatgtgactaatttctggccagtgaattgggagtgaaaatagtatgtgtcactttggcctgagtcagttaagagctacctccttctgacctcttctgttgcagtggtgaacatgtacatgttctaaagtttatgtaataagctagtgtttgttgttgcagtcaatgttaagtaacctaacagagtttcattttcgtaaatggtctacacattaaaaaaaaaaaaagataccctggagcccctgaagtatttttatgcccataattttttgtgaggagagtgctgcttttaaaaaagactagggtttggagaatattcttatgaggagaaatcggtttatgatgggaaaatgaaaaaggacaaacgtttgttttatcattctaccaaatgagaagaaaactttcacaaaaagaaatgtttaaggtttctgattatcagagttttatttatttattgagatggagtctcgctctgtcgcccaggctggagtgcagtggtgccgtctcgactcactgcaacctccacctcctgggttcaagtgattatcctgcctcagcctcccaagtagctggaattacagacacccagcaccatgcccggctaatttttgtatttttagtagcgacggggtttcgccatattggccaggctggtcttgaactcctgaccttaggtgatcgcctgcctcagcttcccaaagtgctgggattacaggtgtgaaccaccatgcctgacctctgagtatatttattatttacataaaatccgattctttttataacattaaaatgattttaactagttttgcttttttaaaaaaattttcaatttagaaaggtggtaactatcagagaggcatatgacacagacatagtggccccttggtatccacaggggattggttctaggtcccttgtggataccaaattccaaggatgctcaagtcccttatatacaatggtgtaacatttgcatatattgttctattgttattttttactgttttttttttttttttttaattttctatctgtagttgtttgaatctgtggatgagaaactcatgggttcagaatggcctatcacaaactgaggattatggaaaaatactgtagtttacaggtatttttttgaatactgttaatacacagattactcatagtctaattggaataaaaatattgagaaaaataaagtccttttcatgtttaatttctaattctttgcacaaaagtaattttttggaaaagctgtttcttggtttcattttagaattcccagcaaccaaaagtaagcctgagtttgtaccaaggtaggaagtattttatgttttatcatgtctgctagtcttgttctattaaattacttaagcaactttttattataggaaatttggaaatgtgagatgtttagcgcaaggaaatgatcttaaatggaacaaagctggttaagaaattgaaatgaataaaaagcatgttatgaaaatatgcaacactctcattgacctaattaaaatagcttatataagattattgttggactatgtcttataaacttacaagggaaatcttgattccctctctttaactccttatagttattgccaagattaatattcttacatgtatatttttacaaatatgtatgatagaatggtcactgtaaaaaagttctatttttaaaaacattggcatgagaaaaaggtgaatgcttcttaataaagtattggaataattatttattagtgttactggaaatgggtgattcagtgtcactttttgggtaatgtggatttgttttgagagagaaacagagaaacaaggaaacaaaaatcaacaaagactaacaaaatttctgcccagaatacaggtacgtgcttgcatgaaacaaaggtcctatcatgaaaatactaaaagtctttgaagaactaggctggagtttatactgttagtgttctttattgacgatatatggaacatacagttatatatgtgatgaagttaacattaatgatataaatttcccagatgtagggctaacacttcttcaaaaatcagatttccaggtatttcatagcttgaacaaatatttgatgagacccctcccctgaaattttataccctagaacttaataaacatgcctggaaattttatgtagatgaaggattggggtttctagaggtcatggcataagtcattctttcctacctggcctttgtacaataccagatacaaaatgaagagtaaagatagaggccagaacgtacctactaatgataaaagtccaagtggaggtctgagtttgagagccaaatgacctgctgattgaattgcagaaccaggccaactttttcaagcactcttcaggtaatataaataagacagtgccatagagcagggatctttatggtttttgttgcaattgtagctactctgtgattgtgatgcaagaaaacagccatagacaacaggtaagctaatgagtgttccaataaaactttatttagaaaaataggcatcagccttttgtagtttgctgatctcttgcatagaggaaaaagacacatttgcattttctgcagcctactagtttcaacaggaagaaaaggggcccagcagaatcctgcataccaaggatttttcctcaccagtttttcaccagattaaaatactccatcttaccagaattagagggagtaaagggagagaaagaaacctgaaataatactaatgagctctccttgtaagaaggggggcaaacgcttttctcacaagtcccttgacactagaatttactctgttactcaggtatactgcctttccagtggactcaaaagaacctataaaacacaaagtattactttgtactgcattttccaaacttgagagtctaagtgttttggtgctaattttggcgtagtttctctcattttttggttagtgatagtaaaaccatgtaatgagctcccaggaagacccttctcttccggccacatgtgttgacatgaggacatgcctttggcctattttgggcagctaagattactctgtggattgattcatattttttgagtgcctacaaaatatgaggcattttgataaatgctggggatacaataatgagcaatagtgatccagttcttaccctcacaagagcttgtgctgtgtaacagaaagggctctaaaaagaaaaagtgatttctaatttgaaacctgagggactagcagcacatgccaaaggggacaaagttcagcatgttccgggatttggggaaagcattgtttatctggggaacagagtgtaaggggaaaatggagatagatagctgaggctggaaaaggaggagggagcctaggttgcaaaacctgtgtaagcacttgggttttgtcagatcagcaggacgtggttgaggggctttaaagccataagatgatgtgaatgatctctgtttttgaatatgttcagtctaggttagaagaggcaaaaattgaagacctacatttgtactgttcaacaaagtagccatgggccaaagtggctgttgagcacttgaaaggtaactagtgtgatgaggagtgagttttacatttttgttaattttgatttaaaaatttaacttaaaattttaaacaatatgttttcctttaactttagtattttgattggactacatttcacataagttattgaaaatttagagtgcgaattgacctatattataggtgtaaaattcacactggattttgagttcaagatataaaaaacaagaatgtaaaatatctcaattttttctatggttatatgttgaaatgatcatattttggatatacttggttaaatatattattcagttaaattttactctttctttttgctcttttatgtatggcttttagaaaatttaaaattacatgtatgtgtcacattatgtgtcttattggactactccggccagattccagttcagaggctctcataggaatctagatgagagatcaccatgatctgtgctagggttgtggcaaaagcataaggtttgagagtgatctaggaaataaaacataggatttgccatttgattaaatgagagatggtgaattcgttataaagaaggaaaagggagcctccaagcacaaaaatacaagaaaatgtatggtagcggaatggcagattcagacatgtaaacaagcaaaaacaatgcatgttattttttattgacaaactaaaataatgtagttaaaacaatattcttctaccattggattttagcatttttaatgtttgctttttagtatatactacctaattgcttctttagagttacatagttttgcatttcttagattgtaactgaacactaaattttacagtgtgtaatggtttaccatctttatttccgtgtcattatctgttcatcctcaacgagtactaagtgggaagtgggactggagacatttatgtatacttttgagcacataaattctctaaacattttcaaatttgataatataaaatttatttacattttctttaagatgaagcttattccttcttaaaagaacaagtactttatttacatgtgaaggtttactagacacctccctaaagttgaagccctaacagtatctgatgaatgttaaacgtttaatactttcccccattgtcctcctaagaaataagatgcatttctagcttcattttccagtctcttaagcttatgaaagtagtcgagacagtttgttgaccccaaagagaccttttagtctctggcttgttagacaacagggtctgtagtcttcattggcattcagatcacaggcagccactgggctcagtgcaaagccaagcacagctttaggatttagacaaagccaccctggcaaaggaacccagttgtcagggtagctggctgtattgtaaagaactgttgcataatggagagaccaagtagaactattaggatgcaaatgtgaaaaaaatggtggagctaacctgcaaaaacaaacatttcttttttggtgaagagtctagtcattgttgctttcttctgttttaacttctctgggccagggatgtagtcggtgcaatttgagtatattagttatcttcagtcataatgccatcctatattactttaaaatgaacagttaatttgtaggaagagaccacagtacttcaatgttttggaatcttttcataatttacaagtgcatcctactttagtctagatcaattttatatgtgatttttattctagattagatgggaaatcctttttgctcctgattttatttcatctgatttataacaaaatattgttctaatcattgccatccaatgacttctccctgtggattctcatagttgtcctatttattgtagaatttttggctcaagaggaaagctactgaaatccttaaaacaagaattgctttattttactaatatcttaaggaagtctaccctgtcccttttctccttttcactttcttttgtttgttcatccctgtattgagtgctcactttttcttttgctttctacttcttcattagttcttttctttctacttttcatctttcttagcaaaacattgtagaacccacactttgataaatgctgtggtagggaaagggaatactagtaagaagaagaagaaggaataacagaaggggctcctaacctggatttaggagtcagggaataacaattacacccatgccttactgagctgttactacacgccaagcactattttaggtgttttacctgaattaatctcatttaattctcatagcaaccttatgaggaaagcgctatcacccccattttgcagatgagtatgaggcacagagaaataaagtgacttgtccaaactcacattttgtgtatgatagagccaagaaaggctttctagaagttttgagcttgaagctgagatccgaaggtagagtaagagttgcctggtacactgtgaatggaagcaggttatgggaagagggaccagcaaaagtgtgacagaaaggactcttgcacctttctggaagtgaaagtagattagtagggtttgagggattctgtgagaaagggactagtgagaaatgatgctggaaagattgctctatgttcagataatttacatatgttatttgtgtgtgacggttcatttattcagcaaatacttgtgtctatgaaatgccagttgcatggctgttatctgttgggaaggtggaaagaaaatagcaatataggggtggcatacatctggatgaagttacgtggactttgaggtgttttaaagtagatgaatcttaagcaaagtcttagtacgtctgttttgtttcaaatcagcatatgccttgactttctcattttgttaggcttccatttctttatcttcgaacttagtacttgcaaggctcctaatttctttaagattgctgtataataccattcacttcattcttgttttggtttgcctttgaaatagctttaagaacaaaatacctctatagctgttatttttctgacttttaaacctttattggtagggccattcttttttctaattcttgcttctcattttcttccaggactatgattccttcagccttctttagttcctttctttctagtaaattccattaacagtgggcatcaagtacagccatttaaggccttttatgtttttcttgaccccaggtttttggaatctgaatgttgatttatcactaagacaatgattggtaattgtaatttctaacattgattactcactatggtatgtgccaggcactatgctaattggtttatataaaataacctaagctttagaacaactttctgtggtaggtgttaccaaattattatcatccagttttctagtgaaatgggagtttcagagggattgttatccaggttacactgataataagtggcagagccaggatttgaatccatgtatttgactacaaagcatatactttttacccccatctcaagctttctgtctagcacttgcattttcttatttttacagattaaaaaaagtatgtggcagatggtttaggctaaatataaccaaagctaaatgcatctccccctaaattacttaccactgtacttaatatttatttaggatgtattttgtgtttagcactagcacaaggaagaataattttactttttaataatatttgaaatacatactttgaacttcaaattcattctcccattctatttattcttccatggcattgtctcaaatacctgtcattggcttctctcctctacagtttgacccatcagttgggtttacatttgtttcccacaggtgattgtggtgagcatgcacccacttttgcagctatctaataaaaagatggaaatagttggacaactcatatcaactatgagaatgactggtgatgactgatagtaagagctggctactcatgctaacgtttgttgctaggtatgttacagtagtctctaataaaaatggtggaaaatgttatgagaggaaacgcaacgaaatatttttctgggtataaagtaatgttacaaattgcttttggtatgagtagccagttaaagtttcaaatatcatacttagatgatatttttagaaacatgttgaaaaatagtcatgtggtgcagaatgatgtttcagtcaatgatggactgcatatatgacagcgatcccataagattataatggaactaaaaaattcttattgcctagtgatgtaacatcatagcacaatgcattacgtttttatggtgatggtggtgtaaaccaacctattgcattgccagttttgtacaaaagtgtagcacatacaattatatacagtacatagtacttgataatgataataaatgaccgtgttactggtttatgtatttattatactgttgtcatttcagagtgtactctctctgctttattttcttttttaaaggttaactgtaaaacagtctcatgcaggtccttcaggaggtgttacagaagaaggcgttgttattggagatggcagccccatgcacattattgcccccaaaagccctccactgggacaagatgtggaggaggacaatgatattgatgatcctgaccccgtgtaggtctaggctaatatgtatgtttatatctaagtttttaacaaaaaaggtaaaaaaaatttaagtagaaaaaagcttatggaataaggatataaagaaaatacttttgtacagctgtacagtgtatttgtgctttaagctgtgttactgcaagagtcaaaaagctacaaaattaaacagtttatgaagtaaaaaagttatagtaagctgaatttattattgaagaaagaaaaatattttgttattgtagcctaagtgtacggtgtttatgaagtccacagtagtctacagtaatatactagaccttcatattcactcaccagtgattcacccagagtcacttctagtcctacaagccccattcgtggtaagtgccctatagaggtgtgccacttttttttttaccctgtgtactgtatttttactgtaccttctctatgtttagatttgtctagatacacagataccattgtgttagaactgcgtattcagtacagtaacatgttcagatttgtagcctaaaaactaggtgtttctatgatgttcactcagtgaggaaattgcctaatgatgcatttctcagaatgtatccccatcattaagcaatgcatgactgtaatggagtaatgtgacctggtattctttttcctttttatagttcacactgtatatttttaaacaatacttcagtgtttcagtttatttgtgaactttgatttgtgcactcatttacacattcatacatacattgattcactccttcataaatactttattgatgaaatattacttactggaagtgccagtgaggtacaggagatacagcagtacacagtgctgaaatagtcacagccctcatggacttgacagtgtgtttatcattggattggatttaagagaattagctaatttttttctgttgagagttcatgccatatttgacttttggattttctgagatttatattaatacatttgaaaattttggttttagaattaggctaatggttacagttgtacctcagtttattgtgctttgtttaattgcactttgcacatattgcattttgtacaaattgaaggtttgtggcaactctgttgagcaagtctatctgtgtcattttttccaacagcatatgctcacttgattagcatttttagcaataatgtttttaattaagatacgtactttttaaaagacataatgctattgcacatttaatagactatagtgtagtgtaaatataacttttatatgagctgggaaaccagaatttcatataacttgttttattgccatatttattgtagaggtctgtaactgaacccaaaaggtctctgagatataacttgtatatagattttgatttggtcactacatatgtttatgattgttagcttatacttattggcattctgaaattttccttttttcacttaatattgtttttgtgctctgtccgtgtgcaatgtagttacagctgtagctaaagctattggtaggttatgccttttagctgctgtatagtattccatttgaatatgtagcactactttttatttattctttaattgatagacttttagaatatttccccttttcctcttctagtcagttaatactacaataattgaggtctcttatgagtcaaaactttaaacagctttgaaagagagctatcttttgtctcattaatgtaattttaaaatagaagtatttgaattttgcctttagtatttttgatatttggagaaagttccagttgacttagtttaaatggagtctagtttgtgtgcttttcataccttaccagtaaaagtcctgaactggtcattttacttggagtgtatgaattggcatagcacagtactgaacaggtaaaaggaaacaaagtataggaaagcagctaattatagtaattgcagctggtttcaaagtacttctaacagtttgtgcataatgcttacttgaaagcatcaaatgggtgctagttgtgaaatagaacacctgtttgttgttgagcatgtgtttatgcagatgattgttgttgtcaaagcaccttgatgtagagtagtcctgtttacatttacattctccccaaaggattaacagtgttctctcaataaatttgcagtctattctcctctcaaaggctgctgtttggagggtggtgtgaaagaggcaacaagtgcttgctaatcacttgaatatacataattagctgcagtctggtgcactggattctttgtagaaccataacaatactgattggcaaatgcacataacaatagatgtgtcaccatatagtccttgagagtgctggttgtttgttcattggtatttattacttatttttctcaacatgagttaaatttttattatcagtacacaaactcttttcctgttcttttaaatgaaccagtgtgttatataacaactccgtcatcactaagaagcagtgttgtaaatttctagactacctagagtctgagggtattatttaaaaacacatttgctgtatttagtaattccaaagattgagaaacgtccagtcagccaccatctcttccctttggtaggctcagcaagggagtggagaagctttttaatggaagaaagaggcagctttaggtatgctgtggttggaaggctgttggcatgggaaagctggaagtgtgggtatcttgtgtgactggtctggggaacatcttagctttttctgtttggtccttggttgtcattgcccaagtcctgaccgttctgggctcttggctgcagagcttgtggtttgccatcctgcgttggttgcaaaggttgtggctcagagttctgtggttatacatgatctcactgttgtccattttatattcagcctctcagtgggtagtgttgttaagatgaggcgaaatttatttagaaaaaatatgtaaatctatatgaggaacaatattaagtaaataatgtagatggcatgtgaatatgacacaaattgtgaaggtggtaaatgaaattaggaagaaaggaaaaaccgttacatggtaattacatatgaggcatttcactgagtgttttcccattttatttcattttatcctcttcaaagctctataagtacaatatcataatcctgaaattataaatgaagattctgagggttagtgaagtacattggtccatggttgcacagctaataaacaggagctggaattccaacccagagcttactgacttgagcttactgacttttgactctaaaaagaggcacaaactattagtttacaaatgtgatcattccatgaactgagatctttcagtgcgtcacttctagtgccttctatttctcttcacagaacactctttttggataaagagggtttaaaaaataatctctctattgatttttaaatagctgcggtggctagcttccaagtctgcaactatgtacttccttgtttcaagctggcctcactatgtgtgtagaggacgccttggcttatcctagttactgttgctgtactgagaccatccagtaagagtgactcagagcttgcccattacctcttcttgccccttagttcttgctgtatatcaaagcaagtgttttctaaattcttgcagactctttgttctctattgccttattattggtgatattgcatgccatttatcttaaacgtatggatggtagaaaacatgagctgctacaacaacataatatatatctacagcaggctattatatatattttttgctttcattttggcatgtggtagatacttacatataagagtttatgctatgagcagaaataatcgaaatgtcacgggatccttcaggtgtcactctgccagccgggaaccattgtggcctgtggcgcccctgcttgagtttcactcactcccactgtgctcgttccacccactcagcccggcaggctgcactcagttcgcccaacccggatcccacgcctgatgagggcaaaccaggctcagagcactgaagggtgtgtgagagagctaacacagggtccggccagctgtggtggggcaggcagctctgggtgctggcagaggtgccggctccttgccaggctgcagctggagcaggcgtaccacacgtagtttctggtgcaggtgctggtgtctggaaaagggggatgcggtggcacctaaaaacttggggacgccagcaactgcagagcctcaaggagtgggtcaggcgtgctctctcattctctccacccgcggctcggcgagcagggggagcaggtttcagcttgttcagtcccaccacctcaccccagccggcggctcccaggctggcccagctccactgccacttcctgtcacatggggcagctgcccaatgcaggcagaaggcaggaaggctatagtgttacagccctggcttgggaaatcctgatgtctcggcccccagaagtgtcactgcttttcactcctgcagtccagcaaatgggagcatgtcaccaccacagtttggtgagttggccaggaaagtgttgcagcccttttcatgcccactgttgggtgggtcccgaattctggtcctttgtccaggaagaatgaggttacgtggacaactggaaggtgagcaaggtggagaagttttactgagtagcagaacagctcagcagagaggagacccaaagcgggcagctcctaagggtagtccttacttaccttgagtccagctgaagctggggtttttatgggctcaaaatggaggaagtgtgtgctgattggtccctgggcaggaggaagtgcgtgctgagtggtccatgggtggacctggaaaaaacaccatttcattggctgaaaggcgtaaaggaaattctccctccaggttgtggattccagctagaaggagcagccaggttttcaggcttcatgctgtgtgtgccctgaaggttgggtttcactggggacctgtcccaatctgcctaggaatttgtctgcctcctgccactatcacaattttatttctgaaatacacaaatatttaaagctgttaggaaggtgtcagtagagagacttggaaaatacaggcaagatgaaagtaaattattctggtaataaagtgacccattcttattagggaaaatgaaaaatatacataaagaagaacactgtaatctatcatttattgtccagagatattactaatattttatgtctccttaatcttttgtctatgcacatatttttatttttaaaatacaacatttggaattttatatcttgctttttttctcttaatattatgaacgttttcccatatcattaaggacttttaatagcattttataattatttacctaacagttctccctgatcattagacagttaagatagatttcagatctttttttaaggtagatttttatgagtgaaattactggctcaaaggatatggttactttcatgtctctttataatctatgaggtacttgatttttttcctggaaaggctgtacccatttatgttctcaccatattctcatgctttaaactcagtgcatatgctcttattttcactagtattttgaattccacccttttaatcttttcaaaatctcaaatcattacctctcttgtattaccagtctctccctctctgctttatcattcacaccggcatataaaggtgcaatagtatcttccatcctaaaaagaaaagccccctcttgacatattgcttcccattctgctactgcctctatttctgcttctcttttaataaaattttattgcatggtttgtccacactggcatctttcatattctcaccttgtagttaattttctgccctaaactctagtttatttggatttcttactcctctgaagagtctagtaaaaatcattgacatccgcgtgaacatttttctctttctttttctccatctcttaatatcattcagcacaagtagcaactcaattcttgaaacccaaccttggtttctcctaactcattggctcttcctttctgatcttgtatcagttcttgatacactacctgatgcctacttattggagggccatgtgactccatggaggactcctttccctaaggaaaaactaagtttccctgaagtcctttttgtctctaataactttttacctcttctgggatgtctggcatatgactcttgccttagagtccatagactgcaaatgagtttgtgcttttaatgacacgtactttaaaactcattgatcttagttttattaagtctttagatttttgaaaattttctttcaagtggttattctttgaaatcgtgaagaactgacagcatatgaccagacagtttttctacaaaagcattgggattgcctgtcctgtcctatctgttcccataaagttttaggtgaaatacaaaggtttatgatctaaattcacaattgctagtatgatgcattagcacaccataagttcacagtactctttgcactatattcctgaatgattaaaacttacagctggcatagtatcaagtgctggctgcccaagtgtctccctcacaacctatagatagagtttattgcctgtcacagaaagggagtacaccacctggttagaactttggcggtttcttggagggaagaaagcaaggatagtatgtactgagaatcaaagtttggttgaggttgagtgaatactgggtgtgtgtgtgtgtttgattaaaattggatgatgaccattatgcaacagcaagggattcaaaaaatcttacatactgttggggctttctattgaatcgttgatgcgtgtttcaggagtttgctgtgatgaacaatcaaaccgtttgccagggtgaggctctccctgaatagtcaagtcatgttaacgtacactgtgagttgtttagggagttgatagttttagtcttcaagttgtatgtggtttctgttaaactattaatgtcataggactacaacatactacttcaagctcttaaaatggctttcccttatttttgagagatgtagctgagtgctgcttatagtcaggtcaattcttataaaacaccaacatccctctatgcctaaatatcaaatcagtgttataattatttttttaaactaagattatatcaaattttttagtttgatacttacaaaatagttatgatgcttttttttcttggttctctttttttctttgctagaaagactttgaactataaggatggaggttccttttctgcagacttaagaaagaggatgtgaaacttggtgtcatgagttctaaatacctcaagttattgttgcaagaatagggttttcagttttgcaatttcagcctataaattacaatgaagagtaagagtccttataataataaacttttggggctgggagcagtggctgacacctgtaatcctggcaatttgggaggctgaggtgggaggatcatttgaggccaagagttctagaccttcctgggcaacatagcaagaccctatctccacaaaaagtgaacaaaattagccacgcatggtagtgcatgcctgaagtcccagctacttgggaggattgcttgagtcaggaggtcaaggctgtgttgagctgagattgtaccatcgcactccagcctgggcaacagagcaagaccctgtctcaatcaatcaatcaatcaatcaactaacttacttttggtattgtatgctgatttatgaaggttgaacctaggattaaatgttgtcttttgtctgccctttatttttcttcccttaacagatgccatgttgagctgccttgtcctgattttgacccacaatgtgtattcagcctcagcacttattatgtaggttaggctccttttaaatgttaatgtttcacatttatgcttgtgtgaattgctcattttctgtcataacctgggggtatggaaggaatctgttgaagaccaaggaggtgggctttaccacaatactgacatctcttctcagctcaggcagggagccttggctaggccacctattgccactgcctaagtagaaggtgattggcagaatcttatctgctttgctttgacttttcattgccagagtttgttgaaggatgccagatgtttgggaaaacaagtttctttttgctttctatccctattcttgccaaattcttacctgttttttcatgaggatgccctggcttgcaagaaaaagcaagaaaaataaaaacataagtttgattcttaatttgagcattctgacccattttcagctttatatatccttggtccatttttcttcctgttattttgacaactctcatggctgtgggactgagtgcttgttcatagataaatgttaactttcttttgggttgaaaaagagaatattggttgctaagttgagcaaccacagactgagattttcagaaaattgacaacttcttttgagaatttacctgttgtaagttatagaaactgaacttaaatattaccaaacaaccatattaaatatttgccatattttagattgttccctgcattaattgagttcactttataggtgtaaaatatttttatatttagtaagcagatcaaataatattaaccccacaactttttcccacacgttaaaaaacacctgactcttcatccagataatttttccagatttcaccactggaatttacttatacatcctttaatacctaaataatcagtcttgttctgatattatctgcctttcgtaaataattgaaatggatttggcttacatattggggcgtgggttaacctccagttggaattctaaatttatcaaacttaagatctgttaaaatgcccagcaacagaataattaaaacagatttgaaaagatgagtagcacccaccagcatactagacattaatgttggaggtatgaaattccagacattaatgttggaggcatgaaattccagagctgcctgcactaggcctttatgagaactaaccttttaaaaaggccagtagctttcctagtcttctacgaagtgccagatagatgagtgaatgtgtataaacacctttctgtgtgtactttttagctattactttgaaaattgtaacaacatatatattgcttatccattttgaatcaactgtgacatcttttagccatgtatatgtggcatatgtattgttttcattaaatcgtcgaaattatataagccagttaccacttttcactaattttttttggcaatggtattttggaagaattaaatatatttgaactgtatattgaagtagtcaaagtgaccttcaaaaggaatgtaatgatcttaaatataatattttatcttatttagttgtcacaaggaccttatttctgtggttatgcccccgacccttaacccttgcaaatctccgtatgcagtgagcagtgttactgctggagtatattattcttgtctctgaagtagagacacaaaaaaggctgagttctgttctgttattctgctagattggtcacatattcctggagagtggtgttataattttttttcctgcatctttgcagatagcacagtgcccccatggaatacttcactcactctagtcactggtgaagtcctactcatcaacccttcaagttatagctcaagtttcacctcttgtatcttgtcttcccttgtcaccatttgaaagtaaactcttccttctgaaactgtcaacactttccagaacttttcttactgcccttattgcagtttcatttctttttctctttttttttttctttaaagacaaggctcgctctgtctctgaggctggaatgcagtggccttatcatagctcactgcatcctcaaactcctgggctcaagctaacctcccgagtagctagaactacgggcatgcatcatcatgccaggctaatttaatttttttttttttttggtctagacaaggtcttgctatgttgccgaggctggtcctggactcctggcctcaagtgatcctcctacctcagcctcccaaagttctgggattataggtgtgagccactgtgcccaaccctacttttgtttcttgtgtacctgatttttcttctatattgtaggatattttataacaatagttgccttttcttcatcttttttccctcagaaactggaaagtattttgttggccagagatctgaatgatttaagaatgattttagtttaaaattcagttttttctcccaggagatactgagctcttaaattagtatttcttaaagggagggcaatagtccacctgtattagaacccccttaatccttggtaaaagtgtagttttccagaaaatgaaattagaacttgtgggtctggatcccagaagatggatgcatttgtattaagtgccatggtaagtcatatttacacaaaaactgaagattcattcccttaaattattatggaaataaataaacattaagataccataagtcttataatgtaggaaaaaattccttacttttgcatttgaaaaaaatatgcttttgaaaactaaattccttattgattctctgtttttggtcttgattactgatttgctcacctaatagttctctaatgtatgtaggtttaaggaactaaaaatagagatattactgactgaactagttagtatgtaaagtagaaaatggtacaactgcatactcagtaacgggtagttttacctttttctggattcttttttttttttttcccctcaatttttctagattttggcctaccttgtattatcttgtttgtttggtgttaactttttcttttgaggactgcagggatgacagtcttgttttcctctcctgtatcacacagcattgttacagtggctcagaaaagcatttctgaatactttgaggattatttatgtttgttataaaatgaaatttgttgtttctgactcggaaaataaggatataaatttcataggaatgcattttaaatgaagtttcttgagagagacagctttaacttgaattttgcagcagcatctaaaacgaagccaatgaaaacacctttttttccccagacagatattactctgtctctcaggctggagtgcactggtgcattatggctcactgtatcctccacttcctgtgctcaagtgatcttccacctcagactcccaagtagctggaactgctggcaggttccactatgcttggctaatttttttttgtattttttgtagagacaggatctctacccaagtctcaaactcatatgatgtcctcaagccctcccaccttggcctcccaaagtgctgagattacatgcatgaatcacagtgcttggcgtcagtggaaacactttactcttgattgtgccattttccataggggttggtggctggattgtactttctagttgtgaaagtaatggtgaggtaatggctttgagtctagggatcagatccttcaatcagtagtaatataagtgagaagtattaatatgacatagtgaattatctataatttctagagaacatttaacttgcattcttagatctggagatggaggaccggttgattcagactacattggcttcaaagtgataaattctatattcacctctactaggacatatagaaaaagaaaatagctttgaaagtatggctctttctttcttctttttctgaatagtgacaggcatctatgaatagtgatgaattcaggaaaactcctaggctagacgttatcttgacagttggtggacagatgctcctgatttgagtgtgagactgaggtattcagaaagcacttcaaaacactctcctatgccagctaacattattttcgttatattgtgattgagtttttagttgctttgtaataatccctcagataaagggcctggtgtgagctgggaaaaatgtttatgatttattttgagcataacagcatatagtcatttttataaattgtttttcagaccttattattacttgtaaactaatgtattaaaacacatattaacatattaacaatttcacattgaacattttaaatgaaaataataaatgttaatgtttaaatgaaaagtggccttgataattttgaaaatgggtgcccagacttactgcatttcttgagaaagattaattgcttcctagacagggttcttacggtgatagttgtttttacattgctcatgtctaatataatatttgaggtataatttgccatggtatttctttttctgagttagttgatgttttattgaagacatgaatcattatgtgattctctccatttaggaaaaaattttccatctttttcagtggggattgggcaggtcattctcatccagggttctctagtttagaatttgttcttcttagtctgaaggaagttgttgactttttatgtgtattataagggccttctttaacttcgtgctttggtctgggggtgtgatgattactagaaatggtgaagttatgtgatgggggaaatgccttttataaaacaaattttggcaattatgttgttttccccttagcattttattcatatgcatgtactcagaagcatgcacagaatatttagacatgttaacatttagatggagctgctttgatggaactttatattatagagtaaatttaggttgttgctattttaatgtatatctttttctctgaagttttatagtataatgtttcttttttatgataaccagttcaaatgtaagcataatataataaaaccttaagctcgcagtctagtccttgcaacacgaatatatatagcagatgtgtcaaaatatatgaattgttcttaatgttaaacttttgttcgtgagaataacgtaacacctgctgtgacctgctaagctgtgtaaattttaatgactgtaaaactgaaatgtattcatagccaaaatgtgtttggaaattatttggaatgtcttatgcttggctcctttagagattttgttatataatatgtagaaatttaaatctgctataaaagttgaaaattattataacgtctatgttacttaaaagttatctagaaaattataatacctaggttacttatatcttttcttaaaaaagttatctgtagggtaatctcacctctgatgtgccttgcctggaagcaacaggagtgttatctaatactacacaaatttgtttccttttagcagtggcattcttttaattctacaaatattttgataccttctaaaagtaggtaggattacattggcatagtaaatttcccagggttattaactcctttttctctccattatgtaaaaaatagtaagaaaatataagaattataagggtactactagtttatatttggtagtatagtagtggaaagggaatgatccctttcctccccatcataagggttatggccaacactcctataacaaaatacagagtaataagagaaaagcataacaaatctgtttaattatagttttacatgacacaggagccttcagagtgaagaccccaaacatatgggacaactatccatttttcagtgcttaggttcagtgaaaaatggacagctatgtagaaataggactggacaaaaaggttatgatctaatattaatagactgcatataaaaactcaccaagacctgtctgttcagattcttcttggcctctctcttgtaatgtttcttcctcccaggtatgggacaggacccctctgatgagggtcttatgacctatattattgggacaagggtaggtcagagaatttctagacagaatttctgtctaggccagttcctagacagaaaggtgaggggaaggttagagtagtaattgtagtttttatggctggctttggagaagagagatctagtctttattatctgctttggtgaggaggaattctggtgtctgtacttgctttgggggagaatgaggggcaagagacaggagggcaggagaagatgagagagatccaggttctgaggctgcttctgataccttccagtgcaaagtactttgtgtgctgaagtgccatattttggagtattgttttctgagctccagcattagccctatttgccagtagaatatggtgtggcaagtactttaaaagaatgctttacatgcttattttctcaagagtatataccgtgagcttttcggaatagttggaccatctgggaatacgtaaaaaataaaaggaaaaggacaagagattattgcattttgattggctccaaattgtattaacccttaatatttatctactttataattttaagatactaatatttgaggagatctctttattcgaattactggtttaagataatattatgatattaacaagtctctttttttctcctcacatcttttagaccagagcagacaggccaagtcaggctgagatcctatttatgataaaaatcatagaactctatgtagtattgataaaacacatgaagattatattatacttagcttttaattatattttgacatttgctcatgtttgatttagaacttttttttttttttttttttttactatgtcttttggtctcatcaaaaagattttaagatcctttttattttggcaaaaatatatgtaacatgaaatttaccattttaaccatttttaaccatttttatttttattttatttttaattttttttgagtttgagttttgttcttgttgcccaggctggagtgcaatggcacggtcttggctcactgcaccctcacctcctgggttcaagtgattctcctgcctcagcctcccgagttgctgggattacaggcatgtgccaccattctccgggcaattttgtatttttagtagagatggggtcaggctggtcttgacctcctgatctcaggtgatctgcccaccacagccttccagagtgctgggattacaggtgtgaggcaccgcgcccggccaccatttttagatatacagttgctttcatttcttatgtctctctcttaacaccaaggttattaagtaagtatttaagaacatacaagagatgttcagtgtagcagagattggccaaatccgtttgcgcgtaatacacctactctgccctagcaccaatctagactgttttttgcagctgtcttggagttaggtgtggccatacgactgagttctggccactcacatgtgagcagaattaacgcatgcctcctctaggcttgggtcatgaacatctgtgttcagtgttctttctctcttcccttctgatggcagtcatgaaaccaaggagatggaagagcctctaaaagggaggattctaggtccttcagtcactgccattgaaaggaaacattgttttgaccttacatgagccagaaacaaaactttcattgtagtaaagcactaagttgtcatgatttacctctctcagcagccagcattaccttcactgatacactcaacagtgatttgagtatgtaatttagtttactcaaaatatacttctcatttcttagcaattggaattggtagtcaggaaaactaaagttgaactgaggagtgagaaattggggtgtgactccagttggaggaagacttggtgtggaactcgatgagatgaataaaagatagaacaatttggaatgttttgttagggaattgatacaaaaaacttaaagttagcagagagttatgtgaataaattagagtaattttgggagttgtaggagtaggggggcattatgaaataagaaaagtctctgagagttgggataggatttaaacactatcggtttttttaaaaaggaattttgccacattccacatgcagcttgcaaatgtttttgcaatgactgtcttgacatatgtgatactcagaaaaaggtggaatgtttaaatgaatagaactgcataccttatatatcttgtttgctgggagttagattcattacttgaataatttccctaatgagtcattcccttaggggaattatccctaagggaattatccccttagggaatgacttatcccatgaaaataattggattatggcttgttttgtgcatatatgaaatccagtttgttggacttctacaacacctaaatataggtgaaatttaccttgtgttttggacatgcaaaatattggatagaatatttaaaaagaaaaaattcatcaattcattttgctagcatttactcttcataattgaagctgaggctgggtgcggtggctcatgcctgtaatcccagcactttgggaggccgaggcgggcagatcacgaggtcaggagatcgagaccatcctggctaacacggtgaaaccccgtctctactgaaaaaaaaaatacaaaaaagaaaattatccaggcgtggtggtgagggcctgtaatcccagctgtaagggtagcagcctcgggaggctgaggcaggagaatcacttgaatccaggaggcagagatcgcagtgagccaagatcatgccactgcactccagccttggcgacagagagagactgtctgaaaaaaaacaaaacaaaacagtagataggtaaaatgtttgtggctttagatagcttttttttaaaaaaaactttaaagtgaagatttaataattataaattaaaaatacactacatgactcacttgatgtttccaattttcatctcctatgtaagtaacgatacagagaatgcatacaatcgttggcttgtggacatccatgtccccagttgtgtgtatgttggaaatggttataagacatggggattttcttacctcctgttcataattgcttcagctacagatcagattcccttctaaacaaatggtaagagaccacctcagctgagccttgggtggtgttttaggagcaattgctactctacttgaaaaggaaaggtcctctgttttcttatgcatagcatccaatgtaaaatgaatgtagctctcttctttgaccttactcttatttgcatactttaatgggtgtaatcatagaaatgttgcatattcagcataactggattctaacttataatttattttaaaaataaaagtactgttaaaaggaatttgagattccaggatttcttacaagtataatgtacaatgtatgttttatgatcgaaattagctggacttgaagtcaaaagaactagttcaataacatgtgtcttaacttgaaatcttggtttcctaatctgtaaaatcaccaatatactagaatcttggtgttaaaagtaacctatggggcagtttgataccacctttaactcagaactcaaatttcttttataacatctttgatatgtggccgtccaatgatagggtgctcagtgtctcattctttaatcaggtgcttatagctttgaaactcttgagcatagaatactgatggtaatattaatatctgacttgtctctcatatgaagtaaggagaatgaaagcaaatattaaagtagcaagtagtagttatacagtgcttttttaactaatgacatgtgggaactagttaccatttgtattaataattttttaaaatgataaactaaattttaaatctctgacaatgaccattggaacccagcctgtttatcaggtggagtctgccagtgcttccagtatttttgatactacctagtccttgaaaattaaaaatcttgacccacaatttaaaagccactgggtatgactcttgggaagacatttcgattacctagtatactaaaagactttaatacaaattgaaattatatggaagttacttaaacatttctaaagtaacactaaaccacattctttaatgtattatgtgtcatgggtagcattgcctggaagaggtagcagcaagctgagtttatgaaggaaaaaaacttctgagtgagctaaggagctggtgggtagagtgtggaagatggagcagacagactgagatccatccaggcctgggaggggaatgggagagagaccagggacagaagccagacttgacacaatccctgaagaagataaaagaaagtgatttaatcaccttccagatcttacttgcaaaagggctacctgtattctttggatgaagtgttagtattattagaatgacccatttttacttgtgttagcttcagtggatctttgttccttgtaactgaaagagttctaatagagcactaaggttaaagacaagtatcaggggtaaatatttggctgaggcctgcttctgaatactattctagacatgacctctcctcttttcgttcttttttccacaacatcattataaaatatgaagtaatcctttttaatttcttgtctttctgaatttaaaattctatgttaggtattctcattgcttgatttgtgtttattatagaaatgaagagtttgttttaaactatgcattactcgaatttctgctgaggaagtccatatccatatgttaggttttttgcatcccaaagtcttggattaggttttgccatcattgttagtgtatcaatagaccactgcattattttcttagtggtatgtcagtctttgacttaatatttgcaagtatttaataataccccatacattataaattaaattgtatttggtacctgctagatcttatgagaaattattcacatttaataagaaaacagcaacttgttacttttgtggcagatatgagctcttaaaagatgcaacgtaggtaaataaaaatgagaatgtttaccagacccactaggatcatttggttctgtaattcttatttatgaacattttcttacagctttgttctaatttaattatccctattcccctttaggtaaaggatatcagaattgtgattatatgaagaagaattcttcttaaaaatcatgtattcttggcaaatatttcttattagaagcttttaaaacagtcttaatttttccttacagacaaatttttctgcagtgttgtcattgatataatcaaaatggtttcaggtagttcagaaattgttgacagacttaactaagaaaaacttttgatcaaatggtgtaacaacacctttcctggacaaagccatcattattctgttaaattttcagatcttatattcacatcccatttaccctaagtattatcactaaatggagtattcagtgtacacacatatcctcaacttgattttcctaaatggaaacaatttttttttctccactaagaatggctttttattcatatgtgataaaaagataagtcatttggtaacacctttgaacctgttttcaaaataatgaaaagtttctcttctaaaaatactttttttctttccctcgtttatttaacaagaagagttattatgtaatgtttttctgcagatttttagaaaaagaatgatctctctccactttgtagagaatgatcccattttttgtttaacaccagatagtatcatgacattgttaatacagtaggattcacccagtttgaaagtatgcagaatcagacttctgttgttggtcacatatttctcaatcaaaacatctgtctatgtcgaaaccaaagtcggcccagtataatgaacttttaagacccatgttaatatttaaaaatatttggtaaactgtaaagcagtatacaaaagtgaatatttttatccaaggtgtaaattggtcatatggcccaataccagtagcataaagggaagccactatactagtagtgggtgaccaagtttatttctgttaagccaaaatggagatttattgtagaaaattattagtggtactttctggatgaagccattccttcttaatgtaattatgcccaatttcctgggtggagtcacagtctttcttctaaagacagattacttcaagctttagtagggactcttagttctgtcttgaactaacaataccttaaaatattctgcttcttcatgtccccaaaatattgatcagaaggatacttgtggtcaaatggatgctgtagaaattcaaaccagtgattttactccacttgaaatttaaaggattcatatgagttctagttgagtatgtcagttttagaacatagtttatattgagtaaacacagaatattttacctaaaagggtcacacagatgtcattacagtgaatttacttctgattaaactaatcttgttccctatatattttgatatatattgtgccatgataaccagtgtactattagtgttattaaagtctttcttcaaatagtagatttttatagaattttgaagtagacaaaataagtcaatttatgtttagatttaaaaaaaatgtgaaagcttttctatattctcctccccgtgccagataggtgcttggcacagagtacttaataactatttaataaatgacagaatttcttttcctaaaatttttaggacatatgcaaggaaatttctcttgcatctaggtttactgatgtatatgaggaagagttacatctgcttcagtgaaatacaaaattaaaccaggtgatctttctgaaaaattattcttatggtgacatatcagaaatcttatcaacagctatagtttattctgttggaattttcaaaatacactgtgccttaacttagaaacactccaatgaacttgtattcattagtgttttgttgagttaaagaaaaaatatctgtacaaagtggacacattgtttaattttgttttgcattttactagattgcagtgcaaggccaataaattaaacctaggcagttctcttgctaattacacacaacttatcttgagtatcagatattcaaatccattttatgaatatggtagagagaataacaactgtaaaacaaagcagtgtgcatgtaagtgactgttagcgtgcatttcagaaaggataaatgctcaccatatggtacaattactgtgtccaagttttcaaattagcttctctcatcctccttattactgtctttaaaaagagaggaaaaaacccaacatgatttatctactctgcagcagaactcttgacgcaaaacagcagcccagttctgtccagtttttttttcccttagcataatagaggctgtcggacttttttatactaattactgtgtgagcctcagatgaacccccttcaattcacagggctttgttaagggaggagctgtcaatgtgtctgcccgtttgcagctgtgctgtggctttagcttgcttaacattatgctgctttttagacttgacagaagggattttttttttttttttttttttttttttattaaggcaaagcagccttgtagcgaaatggtttaagcagctgcattgtagggaagcacaaagaagttattattgtgtctgtttaggggggtaggatggagggggagatattcggctgctgttgatgccgattgttgacttgccatctgccagatagggagaagaaaaaaatgacagctccagcagggtgttcaagaggttgtttggagagacgcataaacatgtgcagatgtcgaactgaataatggctagaacttgagacggtttatgatgctgctgatgtttgtgcatatacagaatgaatgtatgtgtggatttggttaaccaagggtacatactaattatcattgttttcctgcatcccccctcccttatttcgttaattagtttaggggtttaatacttcctcttctctcccttattcatgtctagttttagaaagcaacttctttaaatggcaatacaaagtttcttatttctccgtgttgatggtagataacctgtttggctaatgttaggtgtgtactgctaactgccaagaggagcttttgatgaaggaatcagtcaggtgatttggtgtgatcttaatgcatacatgaacgttttaacactagtcggcacataaactattttaaactgaatcgatttgtttcatagcctaccactaggggtgaggtagagagtacccagtttattttgtaagtaattccataatactttgaacttaaatgtcgttagttgtgaaacaaagttatatagtaacctggcctttttgatcagtacatactctttttctcatggttgtcatggattctataaatgacaagcgtgcatttttatcaagcattaatgagttggttgtatatttccttctgatacattcttgacattaggtgttagagatttgatatatctggaatgttttcaaatgctgtgataacatttatatttagatggaagtgagcatgtttacttaaatgtctggtttattactttcaccttaaataattgagaagaaacagtgaccttaggtaaaaattttccatattacttattttctagaacaccaaaaatttttgtaacatttcagaaccaatcaatatgaatggaataactagaaaacaaaaaagagaagctctgacttttctccttttttcttttttccgcccaatgtggacttaacatttcaaaaaaaaatatgtgtggagaattaaaaagtgcttatgttgacttttggaactcatgccttcctaaaacatttaaggttttgttgcataattatcaagcagaaattgcccaaagcatggttgaaaggccaacgtactgacagagcttcgtgtccagagtaatgtctttctgaaagaattaaaggaaggttatctgttattttctgcttttcataaagaaatagaggtcaggtctatctagaaaaaactttctctctcaccgtcagtttttactcaagtgactctaatccgtgtttgctgaaaaggcatagaaaatcatcagccaccttgacttttcctttgtctcatgtatttatttcttttatataggtggccgtgaatatatccatatttgtgtgtaggattatgtccatgtatttacagtttcatagtcaatcctaatatccctaccaagtttggaggcgagcagtatgccattttttaagtagaaggtgtttgttattaaagtgagagggtatggtttgtcagtggtcaggatattaatgagtgactgggaaaagcaagcttataccaacttttatacacaagcaaacttgcaggtctatgctttattaatgatatgttacttctgattctttcagagccatttgctaaatcttagtagtacaggcaagtatacatattaaggtgattgaaatattaaaggcagaatgtctttgaagttacaaagaccagatttaaatatcacttaacttagatgagtgaatttactcatagtcacttaaactatttaaatgtgaatttcttcatcttttgaaagaaggaaacaatacttgctattcaaggatcttgtgaaaacaaaatgagataatatatttagaatgtcttgaatgaattcagtagtagctgttagtatttttattaggtgttatgtgcaagtctagagctctgtagctattacaattggagtatttatataatgctctgactatcatagaataagaataccaagctgtagaggctgtttgagagaatggtcacagatagaaggttgtttcttggaaccttatgtttatttagggatatatgattgttttataaatgtggagggaaataaattatttaaagaaaatataaagaaaacagttggataaaagtatttcggatgtatggtattagtggttatttagtgatgatgatttcaaattttgttcttttgtttgtttgtttttgagatggagtctcactccgtcacccaggctggagtgcaatggcatggtctgagctccctgcaacctccacctcctgggttcaagggtttcaagcgattctcctgcctcagcctcccgagtagctgggactacaggcacgtgccaccacacctggctaatttttgtatttttagtagagacggggtttcactttgttggccaggcttgtctgtaactcctgaccttgtgaaccacccgccttggcctcccaaagtgctgggattacaggcgtgagccactgtgcctggccagctgatttcacattttgttctacaaaattatttttcatacttaaaaaagtaacctcagtttattttggagctgaacttttctctgctacggccagtacttaagctgtatttgggttattatctttaaaatgagactttggaacacctagctaaaaataatatttcttctcctcatggaggtttaaagcattatttgattgtcacaactctttattttgcagatgaagaaactaattaagctcacatagggatgaaagtgctgagataagcagaagtgttttcttagagaagtaaagaggatatggctttggtcgacatgaggaagtcagtaaacctaaaagtatgattaattcccatacagatgtaggtggtggttctttacatttttcttttcaaattgttttcatccggcattccacgctagtaaatattactgaataattttggatgatgagtcaagggttgttgtacctgggagagccacctaatttagtatttaagagtctttcataggacggggtatagtgactaagaacttctattttggtttaaaagaataaattggttacactagaaaaataacgctcacttttgaatggagtgctagtagcttcatataaggatattttaatgtttaatggcacatggtgatggatgccagtatttctagacagatagttaagtgttacagtctaaatttataaacaaataatttttgttgttttttataaaaaacaacttacagtaccaaagaagtggaaatatccatagcctatgaaatatatcacaaatgaggatgaaactgtaaggacattttcacaaataaatgaaaccgtacttggtatattttcaggataattcagaaaacttcagaaacttctagctttaatgtatatttgaattgtgcctcatcaaaatactgcatgaatagcaatttttaaaaatattggccagtatgttgaaaacagagtatttcactgtctgacatattgtttaaggcatcttgctaaatgttttggcttaaattttttaatgtgttttagttcaaaaaaatctgattaaagatgtgggtaaacgtggtagcactttttagaacagaagatgattaagatacaaaggcaggaaaagcataaatcgtgaagtttgtctatttttttggccaagcaagtcacttatttgcttgagactggaacacagcatcaaagttcataattttatacttctaaggaagaacgcatagaacagcagttgttgtttcctggcatctttttgaagagatatttaaacgtaagtatatatatttattatagaaaagaattttataaaatgaccttcattcccttccctgaatttgtagtatgttcaactgttaagctagttccttttaccttttgatttagtaaagaaggattttaaatagaatttaaatttttatgatcttaaaatatccatgatattatatactttaaaaagaataagactgtttagtagttcaaattttaaaaatctaatttattcaaagttatgctaaataatggcatagttcctgagtggagaactactatactttgaattatagaagcaaggacttttttgaaaaagtaaatacaaaacctaaataaaacacatttttactaaatggcaatcagtgtcatccacgtgagatcttgctgtgtcaaagtaaatttgctgtttacctgcttgtaataatttttatcttccttcaatagaagctctttttttttttcttttaatgctaggttttgtttttttttttctatatgggagaagtggtgggacctggaaagttggatagttactaattaacttgtatgtaaaactctgacataaagattagcactttttatattcttaaagtaaaggtctatcataccactggattatatagggtaagttactcagtgttttgtatataaaaaaaaaactttgataagtgaatgctagaaaacttttcctttctgtgaaatagcaaaaggaataaaacacccagtgtacattgattgacttagattctagaatggataatccttatgctatgtaaagattcttagtgtaagaatcagttatgaaaactcagtgagtgcttcaactccacattgccaatttgtcatttgcattatatttcattaataaatgagtgatttgtaacaaacgagtgtattggtattggctgcttttaagaagacactttggaactgaattgttatcctcctcaaattactttgtctttactgaaagattgtatatttagatgtcctgcagtttttaaaaacaaattattctacagagagcaaaacaggaacttagattatttatgcaatgtaaaattcttatatacttttttattttattgtattttggatgacttcagtgatactgatgattccatgcattttccttcctgatgccttggttttaagaaaatctttcctttcaaagtcactggaaacatttgaaaacagcattattatgcttactgaggtacagataatgatgaggaaagaaatatgtacgtataatgagcaaatatgcccatttcattttaagaaatttgtttttattagtatgataggtaaagattgttttctgaaatttctatgtgttaggtaatactgccctcagagggccaaggtaagtaaattcatttttaacattgagaagcagcttttctatttatattatctataagctttctttggggagtactcaaaattatttatttgagtaattgaatagtgtttgatttgtggttgcatttctttgatttgttgtgttcttttaaaatgtttgtgcccttcaattcgacgatatcatttaaacatgttcagttctagtctaagaaaatgttaacatgactggccataaattgtcaaattagatgggttcatagagagtataagaaaattacctggaaaagttaagatgattttacttggcgggtgcgttttagtttttgtgtctttgatagcagatattctagtattcaaaattatttgaagccacactttttaatatagagcagtattcattaaaatggaagcatagattcccttcagttttaaaaacttaagcataatcacatctttcaaatataatatgaatcaagagtaatttactttgctgtatatgcagtggctatgtataaatatactagaagttgaaatacacttattcctgtgcacttataaaagcatacgtttttaaagtagaggtaaagacctgatattgatgtgtgacttaacacttctttgaattcagaatattggggattagatgatgattaatttttgtaataagaaaggaagagtggggaaggcctgatgtcaaaataatgaggtgttcagcatcatgctgtatatccatgtaacaaacctgcacatgtaccttctgaatctaaaattaaaaaaacccagaataatgagttgtgtccttttttctttttgtatggagtaactttcttataatttgaaagaaacattgcaatgtttagtagtaaattcagtggaaggcttttgatttttttgccctatagttagttgttattgaattaagaaagatgatttctgtgacagttggtattgtcagtctttcactagagatttcaatgagttaaacataagcgacactcagttcattattcttagtaatgagggatgaagacaggacataagcaaagtgaataacaaaaatagaaattttatccacaaaaaatcaatacctcctttgctcagctaatgtgcaatagtgatagtctagacaaattaaagaaattccattttattttaaacactctagttacttttgtgtagtctaacatattgtacatattaggtactcactaaatctcctttgattggtttccttagccttactctgagatgttttattcagttaacaaatgcttacataatgcttgcagtgagctagatgttgttctacatgctttacaaactttaatttatttctccattattattgtccccattttccagaagaggaagctgagacccagagagattaaacagcattcactgtctctcacacagctagtgagtgacagaactggcatttgaacccaggcagtccagcttgagagtgtgcgctcccaaccactctttgaatcttaactctgtcctttactagcttgtcccagtgtctcagagcctcagcatggctctctgtgaaaagtgagaatactgcagcaccagtctcagtgttgctgtgaagagggctctgtaagtgaagcctgagcacagtgcctggctgaggacattcatgtttccttttcttccttgctcttacctcttcttcctttcaccacttaacatgctgtggtacaagactcaatcagtacattgtctaaggagaacaaaggagggaagagaggagttatgaagggcatggattcatcctcagaatagtggagctctcggtttgatgcagtgccattttagggtccatactactagacttttcttagaggaaaaactccttggtaagagtctaagataaagtcctattagtttttattctgtagagcattgatgttagtataggagtgggatgggtgggttgaaccacctgagagttttttcagatggcacagaccacctcctgatgagcaagcactacagcctgccttctctgcaaactcccagttagtgctgtagtgaggcaccattattgttatttgtcatatccatcaggcatgttctaacagaaaagtggattgaaccatacgaggttgtgttatagagagacttctctgtttgagagagcttttctgacaggagtatagtctttatttcaaatggtggtaggtttatttagtcattgaattaatggttattgcccacctctgtggtagtttcttgcgttatggactcactgcttccatatttggtattcattaaggttatttactgcagtgtatatgccatgtatgatattatatttagataatataaggtggtaaaatgggaaatatttacaataaggaagttttaaagtttctgatgaaattatatttttaaattggtctatatttataatagtttaaaattctatgactactttttgaaaatggtgcaagaatgactttgtgttaaatccggtgtgtggaactggaaactctgctctaatgcagtaaacagatttttaaaaagaaagctctgctttcacagcctacaagggtgcagatgtaagcaaaataataacttagctcacacttaacccagcaggaggctgcgtacagattgagtaattctccacaacatacctactgctatgtaaactaaagtcaccgtttattcttcattaaattgccaggatgctttctgttggctagtccgtgtggatgctttgttctctgtgtctccacccaatgcccctgtgccttccttactcaccttgcttttctcttagagtaaaactgggtactgtaactctattaagatgttattgtgtttaagagaataatttaaaagcatcactttggttaaaaatgtaatgtttcctaaaaacaagtggaacaaggatttgattagtcaatttaccgaatatcatgaaacaaataccagaatacttaagggtagatgataattatgcagttttctggaaaacaaaagaaaattgtaaagcagataaaagtactaacaaaccaaccatactgagatcttagagaagttgccattctaacatcttgtggttggtattcaatgcataggtatttttctcatcatctcatcagcttcaaagcaaaacatggaccccagctttctttaggaagccgatatgaaaactatacttcataatattgcttctcggacttttggctaagatgaagtgaaaactgtacttaatgtaaaaatgacaagttcatgcattatgcattagaatgagagtttcttgactataatatacttttcaaaataatcatgagggaacatatgtggcaaagcagaggaatgtgggtacatctggaaagcctttaagacatctcggaagcacaacacaaaatcacgaaaattgtaaacaccttccgtgtggccagctgcagtggcaacattgaccagtccaagagcagacaaacatctcagtgacccagagtttaccgggtgaaataaccataaagagaaattcaggtgtttaaaaatctgaccttattaatcaatattatgcagaaatcagtgagaaagacaagaatgggcaataatcttaaaacctgaaacgtaaagatgtgttatttattattctagatgaaagggtagtaaagctattgccttgcttttgcttgtgttattgtgaggcttcaaggaggaatgcaggatgatgcagtgcctcatcttggaatcaacatagcagcaaatcgaagaatcctacgctgatattcttcccagtcccttccccacagttagacgtcaaaccaacaaatatcatcgactacctttttctgaatccacatgagatgctatttagaaatgccaaagaataggggctattgccatccccagtatgacattctggatcactaagaatggttaaagaaatgggagaaattttcacttaaaattttaattagtcaactcatccccttttcttctccacctctcacagctgcctactagacttaaagctccacgagggctgggactatgcttgtatcatttattaaagctccatgagggctgggactatgcttgtatcatttattgctgccttcttagtacttgtacatattttgacactcaccgagtatttttgattgaataactgttagcccgtttttcttaaatctaagtaaagatgtttaaagtggcttttttgatctaggtggtcttgagcagcagcaccttaaaatgagtgagctgggcaggagttcataatgcttagacattgctcaattttcacagactatcaacacacatccaaagctggttgatgacaagtggtcaaagacattgcatagacatcagaatagaatttaacacttttcagttgcctgagggcaaggaaagaacatgtttcaagactcaataaaagataaatgataacctaaaaattcaggtttttaggagttggaaaatctaatcaatatatgtatttaataagtacctataatatgcaaaatcactttaaaaagttacatttcatattgtccctgtgcagttgaaaacttacgctagtttattgcaatgtagataatatgaacaaaattcttcaggatatttttctttttcttttttttttttttttttgagatggagtcttgctgtgttgctgagattggagtgcagtggtgcaatctcggctcactgcaacctcccgcttcctgggttcaaacaattctcctgcctcagcctcccgagtagctgggattataagggccccgccaccacgcccggctaatttttatatttttagtagagacggtcttgccatgttggccaggctggtctctgactcctggcctcaagtgatccgcctgcctcagcctcccaaagtgctgggattacaggagtgagcaaccacgcctggcccaggattatttttaagacatcaataaaacatggttatgataagttgagtgagaagcacatttctttgattctctaagagacatgaataggcttccactcagaactaattgtactcctctgtataaaactgtaatcagtaattttaaatactgcaaatgtcttattatatttattgtcatgcatttcttcagcaactataattgattactgatatttaagatgtatcacataattatggactatacagtattttttgtgctaatatttatttatgaaatccattagtagaaaagattttgccatattcttttaggtagttcatatgtgaaaatttggtgtctgtcaacaggcaactaaatatttactacattgtgaatgatgaaattaaatagattttatgctgaaattaacattgtatctgtttttgtcttaggtaaaaattggctcatgaagacttttatttaaggagtattgccaaagatagtttcttgaagcatgtacatttatttttactgaaaactgcctttttctggtttaaagctgctctttgaaaattcataaaatgtttatatttttatggtactgtacatttgtgtgtatcatttataaaaattcagaagaatctgacttctgctcttttctttggaagactagtttacccctctgatatcctgatattcaaaagaactaaaagtattagtcaaattaatactgtgtttagatgttggataacctcttcatttccttacataaaatacatgttttatatacctgacactagccaaagagacttaaaaaattcatcgttgcctcatttatgtaaatacttctgaataagtgcagtactgattagtagaacatttaatgtgtggtttgtagttggattataaattatattatcataagtggtattagtattagtatcacttgctaacaaccaaatcaaatacttgaaatatgtcaggtaatgttctaagggctttttacattatgtccttacaaaaaccctttggtggataaaaactatgatttctgtttttcagatgaggaccctgagatgtaaagaggttaggttcatgcatctaataaatgatgtgattaggattcaaacccaagctgtgtgactccagagtccttgctcttaaccattacattgttctgcctggagcattttaatgatgaggttgagtgggaaagaaactgaaggctaatttgagaagtttgttgacctcgtattgatcacaacaatttgttgtaccttttgttacacaacatagcattggtttaaattaaaatttcttttattctgaaaatgtgaccacatgcttttcacattgacagtatggccagcttttttttttttttttttgcataaattctatggctctctccctctgtaaataataaagattgcgaaagaggttattttttcattaacgcatgcattaagtatagatgtaatctatacatttttttcttcagagatgtataaggacaaataatcatacatggtaaaaactttgtgactttgcttgtgattaaacatgaaaattaaatatttaaaatacagcattctgaggaaagctgagcttatacttgttttagctttatgataaaacagtaacatctattcctgacatacatgtgaggatgctcccaccgtcttccttatgcagtgattagctttgaagactatgttacaacaagtttgagtgagcattggtatcttaaaaagctagcacctgtatcggaaaattagaatttttgtttgttatgcaactcttgataattagggtcttttttttttttttttgcattttttcttaggtaagaagcatatttttaaaatggtgattgtgttgtttctaattaaattctaaatgaactaaatgaatttcaaatgaattttatgggatttgtgaaaaatagtgctatggttttatagatttcttttcaattggattgtatctatatttgtttagttacatctcagtgaatctacccgattgtgtttttagcatagtccatgacagttgaaggtagagatgagtatttctgcagtattctcaaccagtacccagctcacttcacatctttctacctttcatgaagttagaattagaactaggttctggaacacaatgtagccttaaaaaggtatcagatattcatcaacatgatctatttgtgaggtcacaaggctgaattatttctgaagatcttttccatttgcatgtctgaacaaatctagatattccttagttattctagatgaaagactatttgcacattttaatcaatcactgtttagtccagagatgtacacttctagcttctgccttggcgcttacgacttcagcttttacacttacgacttaagcttttaaaaaatcaaaatgtgattctcagtagagtgttgatgaataatgaaataaaatgtttatatatggactaatttaggttgaagattattaagtaaaaatacagtttgttgttatcaggtgaatggtaggaagtgaacactgtcaactttttggtgagctctggtttgagagtatataattcatgataaagatgatttatttgaatatcctatccagatcttttaggtggaaagtgagcatgagtctaaactcataccaggtcccatctcaggttgttattaaagactaagcctggccgggcgcagtggctcacgcctgtaatcccaccactttgggatgccaaggcaggtggatcatgaggtcaagggatcgagaccatcctggccaacatggtgaaaccctgtctctactaaaaatacaaaaaatgggtgggtgtggtggtgcgcacctgtaatcccagctactcgggaggctgaggcaggagaatcgcttgaacctgggaggcagaggttgcagtgagccaagattgcaccactacactccagcctggtgacagagcaagactgtgtctcaaaaaaaaaaaaaaaatagactaagcctgaggtccaaaataatgcagtatttttactcagctgtggaaattcaggatgttttctatggtcaaaatttactcaaaatcattgagatcgtttgttttaactacagggaataagttattaagtgaagtaagaaaggtggcaaaggtccagaatctgaagttattaggactaagtaaaaccatgaattctagcaaacagtttcttccaccctcataatttacaagtaggattctctaccatttacagtagtaatgtggattttcctctttgcattcagaaggtgctaactgaatctgtacatgtcctatgccaagaactcaatgagtaagtagtagtttttagctctgttagcaagccattggtcatagtgtttaggagctgtatttcctaggactgctgtcacaaattaataaaaagtgggtggcataaaacaacagaaatttattctgccacaattctggaggccagaagttagaaatcaaggtgtcagcaggttcacactcactgagaaggctccaggggagaacccacttgttgtctcttcttgcttctggtggctctaggtgctccttggcttttggcccatagttccaatctttgcttctgtggccacgttcccccttccttttctctgtgtgttcagtttactcttaaaaggacatttgtaattggatttagggcttacctagataattctccaggggaaaagtccatcttctcagaatccttaattgttaatcacatgtgttgccatataaagtaatagtcattcttttttaccataaggtaatattcacaggttcctgggattagggtgcgtacatcattcgagggtccaccactcacctcactaccagaagccagtataccagaatccttgctgggaaatgtatttgttttggtattgataacagcatacttcaacataggtatagcttccagcaaaagagtgtgagaaagaagtggaagcacccatgaagattatatatatatatatatatatatatatatatatatatatatatatatagtggaagaggttgggttggaagtcttaaccagttgtgactgcagtgcttgctgaaggtttatcttgacgatacatttactatttggatgtatattggtgggtgtccattgaacaatctctttgggatacttggtacatcataaatgcttcttttttgacaagactttccattttaaccaggttgtgttttaaattggttaaaacctatgggccataaacataaaagtatgatgcaatttgggtttgatgcatcatgtgtaaacttagatgcaaattctgtgtttaaaataaaagattgacttttagcagtccgtcttaaaaggattggtggcagggagtgtactttgttctgggtacttagcctcataaaagctaggactttctgtccatattttagaacaacctgacaacacgtgccttatctgaactcacactgcctcaacttctgagctagagatgaaagtgttcagttccttttcgaacagctaggcacctgaaatctggtataatactggaattaagctctattaagttgtctttttttttttttttggtccagcctctgtaacaaattaataatgaatgcattctaagcatcttctcagaaagttaattcatattataggtgaaaaatgacaagaaaatagatttagtagtctttattggaagtttgagatctacttctggcttagtatcacagtataattgttgattaaccaaatcaatttaaaattatttaaaaagtttgtgagaaataatacttttttaaggaagaagggaaattctttaaaatttttcttctatgtgagtgagtacatcactatcttggtatactgtattacgtttgaaggatgcataatacatttatttttaaatagctttttggcaaccagaagtcctgctatagatcatagaaaatattttaaaagtttaaaaatctgcttaataaaaaagatacaagatttatataatgatgtttttgtgtttttcatctgaggatgtacatagagggaaattatgcttagaaatgaaaatttgatttcttttaattttacatttcttgaataagtgtattcagtactattttaaaagaagaagaaatggtgttattccgtgttttcttttgtatttttcaaatggatctgattcattttatttttggtataattattaaactattgtgatttacctttacagagttacagcatattgtaccagtataaatctcttattgctgtacaacaacatttgaagtctaaatatgtcattaattggagaattaatacctaatgattttgaattttatataggaataaatgaaatggaaaaataaaataagagcaattaaggaattattttatttttcaacgtgggaattgtgtattaggcattctagttttataaattgccttattaagtcatgtgcttattaatattagggccgtcttttttcagtaaaataaagtgaagagcatcacttttttttcttttttctttaaatttcttttttgcccttacatacttatgtggaggatactgatctacgtatcctctatttattcatttgtttaataaatcatgattgagcattaagtggtgggcaccagcttgggcatgtagagtattatcacctcaaggaaaacaactgacagtatatgctgtcactgatggaaattgagcttttaagcaaagattaaatttgggaaaacagatctctcgttatgagcttgtcagctttccaatgtttacttttttcatgagactggtattgataacaaatgtgattgtataatgaaatgtgtcaacattaggaagatcagcatagcacgataagccagggttttctatgtgaccaatgcataatgttataaaattatagacagtgttaaagattcattcaaagtccagtatagatcaatggattttcacataatagtacagaaagttcattgttaaaagtttcaagttctacattgcaactaaccttttagaaactaacccttgttgaattctggtgtagtatcaaagaatgatatccataactatctgaatatttttccctttttcagcttcatatctctttgagccagattttttccccctaaatttaaaccaaaacaacatactgcagcaggatgttgaaggcaggaacagctaagaaaattaagctgtcttctattaagccagacattaaatagatttgtaaaaatggaaagcagtgctggtctttgcatttttctttctttaaagaaaatagttattttttataaaaatatgttatttgttatatgtaataaatttattttcaagtgaagtaaaacatttataaaatctattttcaatttcgaataaagtaaacatagataaaaatctacataatttgttggtgctctaagtaatatttaaggatataaagagattctaagaagtttaagaattgctgattcagaggaatgattccacatctgaaatacatgttggggtgagattgccctttatagtaaaagatttggattacattttatggtaagagactggactttacagtaagcagtaaggagtcacaggatattttgagcagaaaagtgataaagtggtacacacaagattaatctggaggtgatagatacattaggatggaagtggggaatgtgtagagtggggaaaaacagtattaacagaagagtagatataacgtattaagggttcagttgattgggctcaatcagagagacttgtgatggcagtattgacctaactgtgataaggaggggaaccttcagatgttgggtttgagtttgggtcacaagaagaagctgatttgtagggaaaattgaactgtttgcaatttttttgtacttctttgcctaagcatttgagatttaatcagcaggtagaaataaccagtagagaactgaatcaataccagatagccttctagctcttgtagcatcatggagcacctctgttgcttaaaattagaagttgtcctttagtaggtaagcaaattgtaatgtagttgctaaaaatgtgtattttggtggctaggtggtaccttatgttaagttctaataaagtatacatttattgactattatgttcttgacactgtaccatatattaatagttactatgtttgtgtatgtgtgagtttgcgtatcgttgaaagccctgttaacccatgttctttcgttttcttaagtacagcattgcaaaaaggttatttttctatgaagaacaataaaatgttgcttaaacaagttacagtcaagatttattaatgaaaatagacttttttctttcttttttgaaaaaaaaaagacacaattagtggaagagaaacatctatttcttgcctctcttatgataaatgtttttaatggaaattcattgatactgtgtggatgatttaccaaggctttttaaaacagctgaaaatatgctctaacaaccatctgataaaatgaaaaactgaacaaaatgtgtactcagatgattctctgaaggaataatggtgcaaatgaattatcaaagtgtgaaatcattaaaaacaaaacatgtttgggtttttattgaatcttaattgtaggcttatgtattttcttttgtaagctaagttaaaagaaaattgagtaactaaatttttggaggccagtgttgtaggacatatattgtaccataatttattttttgcataaaagctgctgttcatttttttcagcattaacatgcgtgctttcctcatgtaggagaatatataaaaaactggaggccaagatacttccttttgaagacagatggctcattcataggatataaagagaaacctcaagatgtggatttaccttatcccctcaacaacttttcagtggcaagtaagttaattataattgttgattcatcttgtatttatttatttttatgattttatgtgtcagatatcttaggctatatgagaaacctgtgaaaaagtttgggtttatatttaatagagaaattttcagctttgatagaatttcagtcccttagcatagaggttatcgataacatttggtcttatacaatgcaatagagtttaatatttttatgtagaacttgaatgtgataaatataattccccaaatacatacttcaagtttttgtttataacataaaaacaaggacctttgaacttggttgttagatttagcatgattataagatgttgtggtacttaatgcactttaatcagtttcctgtcataatcttagctcttttgattgtgtgatgagaaacaggtgatttatattagaaatcatcttctggggagattttatgttcgtagttaaatttttcttccttacaaatatctaacaaaaatgtttaaaacttacttagaaattttgtatttgcatgaacatagcacaaaataaactgaaagatgacaatgatgataatgacaatgattattattgttatgttattaccaggctcttccaactcttcaaatatattgattaatcaattagagaatctttgtgttaatttagaagtaaagtgttttaaattacgctaagttaaacttgcctaagatctagctcgtctgtattattaagctaaaatctttaacgagacaatatccttaattttgattttggttatatgttatctattagccatatttgggaaaaaaagatacaagggaaatttgaagctaaaaaatgcaataatataacaaaaaattcaagaaaataagtctttgaatgttacaaatttcattttaccattataaaagccgtgatctttttttactcctattgtttaattcaggttagcccttattagtgggttagaatggctactgtattttttttaagaaaaagataaaacaataaaccaaagggttaaaagatttgtgaagtcatttgaacgatatggatactaacttaaaaaaaaaagctttctctgtttatattagtggattcttaatatagatattttttaaatgagatcactatgaagtgtgtgtgttagttaaggaaaacatcttttttcccaccaaaatgctcattagataataatggttttctttcaatagaaaattattttttaaaccctattgtcaactgaaataatatattgtattttgtattgacttaagaacagattttcattttaaagactttttgagtgaacatttgctttaaagtgatagaaattagcttttagaacataagcagcatacattatctaaatgccctacctaaagccagtgtagctttttagtttatccattttaccagcaaatgttattggtttttctgaaataatttataaaagtacagaattcttgtatctgctgatcaaaatgcagcattttttgaccttatgaaatttcacaccccaacgagttttaaagacatactgtatgtcacagtctgccaacatctgctccaacacttccactggcagaggctgaaataaatgctgcactcttggggaaggatcctatttagtgactgacagtcagcttatttatccatgaaataaatactatctgacatctgtaatcttgtataatcaagtagctgtaggtagttgactcaaactaacaagtaagttgtaggttggctccttagttttaaaaagtattagtaacatggatcttactctaaataaatttttagaaattgattattactaaagcttgacttaccgcaatcttcaattctgtaataacagttatgtgaggaaagaatgagtctactgaaatggatactagctgaagaagtagttcaaattccaacctggccgcaagctgcaagtaataggaccttgggcagattattctctgaaactctgatctttatgtagtttcttcatcagcatgttagaaacatttggattcagtggatttgtaaggccctttttgtccctgacattctgtgattctgtggggtggactttgagcaggtccttgaagagtgagtaggagttaagcaaattaaaacagagaagaagaatattccaggcagagggcaatgaagaatgtctttatgaggaattaaggaaggaacaattggtgcaagagagggttacttcaccattgctttttcctttgccctagccccctttagtacatttttaaaaagataattttacaaggtatttctaaggtatgttgggaaatgttatatatatatatatatatatatatatatatatatatatatatatatatatcaaattgtagctaccaaagggatatatatatccctcatttttctgataattaaagatattacttcatatttaatcaatatgggttttaatgaaattttaccaaaataggctttttatttatatgaaaagaacagagtatgagaactgtaaaggggtttgagaacttccaatcttaattaaattttgaattgcttccctcctgatttaaatttttcaaaaagatagtgttatactcattgtttccacttcgtatcccactgcagtctagcttcctcccttactcacttgattgaaactacttataataaattattgagtgaccacttaattgctaatgtaggggaaaagaaatatcttttcttaccatttcaggttcatggctgaggctcctataacaaaaggaagattaacaagagaaaaacacacaaatttaagtaataaaacttttatgtgacaatgcagcctttggaattgaagacccaaaaaaacacataaatttttttttttttagacagtctcactctgtcccccgggctggagtgcaatggcatgatcttggctcactgcaacctccgccttccgggttcaagtgattctcctgcctcagcctcccaagtagctgggatcataggcgcacaccaccatgcctggctaatttttgtattttttttttagtagagatggggtttcaccatgttggccaggctggtctcaaactcgtgacctcaggtgatccacctgccttagcctcccaaagtgctggaattacaggcatgagccaccatgcctggccaaacttgtgtatttttatgtttagggatgatgaagaggtggatagtcataaggactaagggcttataatggtaataaactgaagggaacttagtaaggcttgtttgtcagattcttttctctgtccctgtgtcttcaggaataaggatattccttccctctgggtatagtatgggcatctctcatatggggatcttatgacctatttcaggggaaggtcaaaaaattcttgctaagttttatgacctgtctcacgtgagaaggatgagaggaaggtaagaatggccttcctgcttttgctgttttctcaaatgctaaggtgctatcttttgggagatcatgtcatgaaccctgtcagtaagtctagtagacatctttcagttcttatttttcctggatttatatctgggctgcattttatactgttgatcaccatctcctttttgaccactcccactgtgttctgggatatacctctttcctgttcccccctaccccttaggctaatgcacagttctggtatttaacagggttctggttgaagacccttcacactttgtactttctcttgggcggacacgttgacttttggggtttcagttgcaaccttgtgtgcagcttactcccacacttaaatctctaggctaggcctctctcctgagcattaggttactctgttcaattggctgctggacatctctacctagatattttttgaccaggtacgtcctaagataaactcaagataattttgtctatttcttcctttgtactcagtatctgagttctgtctctgcctgatcaaaaacatggatcctttccatgccttttttttctccttcacatctttaccccactcccaatccatttctagtcctgctgattctgcatatttcttgaacctatgatccttttctataatcaccccagaatgaggcctcatcatatctgctgtagattcttaactagcttctctgtttctagtttgtaccactcatactctttcttcacgcgggtatcaaagtggtctttctaaaattatatcataactatgccattcccctgtgaaagccctgccttggatcatcattgcctactggataaagttcagctttcttaatacatcatagatctcttcaatctggcctctactttcaactcttgcaggatctctcttctgctctacaattatgtatcagcaatactgaactgtttataattccctgtacaacctatgctgcttttccactctgaggctttgtttatgctgttcccttcgattggaatgtcctttggtcctctatttgcctggatacttttctaagacttaattcagattttaattcccatccctattccttgctaaattagtcctctctgcccttcttaaatctattatcttctgctgttaacacattgtttcttggttatcttgttcctgtgcatgtctcattcactgatcagtaagttattttaggggaaagagcttagtcttatttatcttatatctcctagtgcttgtattttatgacttaactttttaagtgaacatctgaaacatctagtcgagatttctctttttttaggtgagaaaaatgaagcctttagaaattcagtgatctttttaaggttgccttactaggtagtagtagttaagtatcaagaataaaactcaagtgtctcgactatcacataaatattactcccctcccccacccctatattataacatttcccctagatttatggtgatgagacctgatttggggccccatttccagcacttaaattactaggtatcctttgacatggagaatggaaactccacaaggcctgtagaatgtggatagcaatatttgacgttcacccttctttgggtggatcacataagaactattaatatataggtgccaatgtagtgctgtagaaatgtaagtaaaaataaggtttttcaagcatagtacatctctaatcacaattatggtttgatggatttctaaggattgtagattgagatatatacaagaaacatgcactttaaaaaataatataggatacatacattgtctcagggctgcattttattttactttgagtaaaacagtttgtctgtccaggagtcatggtcttgctaacattttgacaatttgtatgaacctctcttgagtttactagcttgctcagttccagagtgggagtagttcccacatggaggacgtgtgcatttgcccctatgtcttgggcttatcctacttctgatcaattccttcttattctctgtggtgggatgggagaagtgccagcctgtgtcctaagaagcctctcctagaattctaccttattctatgctgcaaatattgtcccaccctgacaatatgcttttcttctctgaaacctttcttcagtcccttcttaaaaaataggttatttctgcatttataagcacaattttaaaagatgaaatatttactcttttttttcttttttctttaagttttttgttttttaagacaagatctcactctgtcacccaggctggagtacagtggcacaattacagctctctgtagcctcaatctcccaagcttaagtgatcctcccacctcagcatcctgagtattggggactacagctgcatgccacctcatctggccagttttttgtagagacagggtttcaccattttgttcaggctggtcttgaactgggctcatcaagtgatccacaccttggcctcccaaagtgctagaattataggcatgagctactgtgcatgaccaaagtatttactctctaaccgacttttctctctctctttgcaagtaagggaattatgggacttaaacctactaacaaacatctttatctcatcccagatgcttgggtggctaaggtggaaggatcgtttgagaccggcctgggcaacatagaaggaccctgtctctttaaaaaaaaaaaaaaaaaaaaaatctttgaataaatattatatacagagattttaaatatgtagaaaaatcagttgattcctattaatacttctagtggacatacatggggatagagaaaaagcttatgacttgattcttagtcttgtgtaacagataatacaacctagaataataaccttgtaattctagaaaaactacagactatgtaaatatatactatataaatgtacatgaattatgagagatcataataattcaccttcgaagtgttgattgatcattatacccatacctgatagtgaaaggaatatataataaaatttttatatgtaagaatttgtcattgactatggaagacattcacatagaacatatagcagtgggaggaaaaataggattaattgccaaaatgaattctgtagaaagtagctgctgtagaagttgagagaagcaataggtaagtgttggcgaggttgactgagaatttactcaggagatggggttaacatgagccctgaagaagaggatttgattatgtttttgtaagacagaggacagtctcaggttaacaacataagcaaacaaatgaaggcaagtattaaggagtagcttgttttgtgaatggtataggcaatatcctagatggatggagaatttatgctggaggaaaaaaaaaagctcagattagagagttagtaatcagattatggaaagtcttaaatatcaatgtgatgaaatttttgaacatccggtttccaaatcagtattcaatttttttaaaaggatgtacctggttatagtgtgcagtggaggggatacatccttaaacaaacaggctgcgagtcagtcagcaagatacagtttagtcctcatccttttcagtcttactgctaccatcctagctcagtgcttcatcacttcctttctggattatgttaagtctcctgatcaagttcttaccttcaaatattatcttttctggaatatttggaaacaatgcataaaatagattcatctccaaaaaaagttcctttgcaaataccgttctccttgcttagaaaaatttcagatgttctccatttttgacaaggaaaagctgaattattttttaatatatatccacaattaaacacttgcccaaataataactgtgtttatagcctatatcttttcattcttttttttctgttactctttaatgttctatacattttctttttgacatacattgctatattctggtcaggtttaattacatacaaaattcctaaccctgtgtttgtttttaatgatttttagatcatttaatcattttatcacttgaagatttggtgctttcttttttttcttgatttactttatttaaaaaacatttttaattgatacatattagatgtacatattttcgggtacatgtgattatttgatacattcatataatgaaatcaaggtaattgataaatccatcaccttagatacttgtttttttctttatgctatcaaatttttagacaaatggaaagttatatctgttaacaggtgtatcccactgtaaggaatagctgccttatcttaagaagtgaattaccgtaaatttaatcaaattttgcttctcgcttctattttcataggtagtgttatgttcagatatttgcagaatttaaccttaaaccaagtttagaattgggaatggagaaaacctttgtaaaaattattttaaaatgagatcatttttaagaaaactataatgtaacaatgtcacatatttccttcttcaggctccaattcaaatcatactccaatttgaaaagaacaaaaattccacaaaacgttcattctttcctactttttccttacgttgtacaacaaatgtggaaagaaaaaaaaaacagaaaaagtgtatcccatcttaatgaaaatgactgcggcagtcaagagtttcaaatccagctgccaggggtgaaagcaaccctctgcatctctgaaagatttcatcagtgttatctcctttataatcataacttttcatgtgtatcatctgagtttcttattaaataatctcactattttaatagttccttcattataacactacaggtgatctgatcagatttctgttttagagcctgcttcctcttctttagtagcttccacgatctcccagccttttcctgatttgtattcccaagccaatcattttagttacagtctttactttctgagcctcttttatcagaatataaggaatgggggggcttatttagaatcaaagggaatggtaaacttgtagaagacagtgaccatgcatactcattttaaaaatgtcccacagcatttattacaatatctggtatactggaacatcattggacttgtagtcagaagacctgactttgggactaggttctactgctttactagctatgtgatcttgggcaaatcacataacttctctgattttcattttgctcatctttgaacaatggagctaatgataccttcttcacaggcttacagtgaggatcaagtgagatcatatagccgagtggtgtggctcacgcctgtaatcccagaactttgggaggctgaggtgggtggatcacttgaggtcaggaatttgagagcagcctggccaacatgatgaaacccccatctctactaaaaatacaaagattagctgggcttggtggggcacacctatagtcccagctactgggctgaagcaggagaattgcttgaacccgggaggtggaagttgcagtgagccaagaccatgccactgtactcaagccttggcgacagagcaagactttgtctcaaaaaaaaaaaaaaaaaaaaaaaaaaaaaaaaaatatatatatatatatatatatgaaaacaatttgtatgttgtaaaatgctatccaaatagtattaacgtaagatagaaggtacttagtaatgtttgctgaattaactggcaatcattcctcctttagctaaattacattggagtgaggaggaaaccactttactgagctttctttaaagagtcttaaaggttttagagaacttgcttacaacagtctgttgcagttgaggccaaatactattgtttggttggaggaaaatttctagtttcatttcatgcctaggactttgattagtcagggctattctttcttaatgactaaacagagtgaggtacattcccaaaccctgcttatggcctccttctggccaaaaaagaagacatcactatggctaaagaagtaacacctaattctgtgaagaaagtcaatggtagcttgatggggatagcattgaacctataaattactttgggcagtatggccattttcacgatattgatcctttctatccatgagcatggaatgtttttccatttgtttgtgtcctctcttatttccttgagcagtggtttgtagccttccgtgaagaggtccttcacatcccttgtaagttgtattcctaggtattttgttctctttgtagcaattgtgaataggagttcactcatgatttggctctctgtttgtctgttattgttgtataggaatgcttgtgatttttgcacattgattttgtatcctgagactttactgaagttgcttatcagcttaaggagattggggctgagaagaaggggttttctaaatatacaatcatggcatctgcaaacagagataatttgacttcctctcttcctatttgaatcccctttatttctttatcttgcctgatttccctagccagaacttccaatactatgttgaataggagtggtgagagagggcatccttgtcttgtgctggttttcaaagggaatgccaagaaagagcccatatagccaaaacaatcctaagccaaaagaacaaagctggaggcatcacgctacctgacttcatactatactacaaggctacagtaacaaaaacagcgtgctactggtaccaaaacagacatgtagaccaatggaacacaacagaggcctcagaaataacaccacacatctacagtcatctgatctttgacaaacctgacaaaaacaagcaatggggaaaggattctcttatttaataaatggtgttgggaaaactggctagccatatgcagaaaactgaaactggaccccttccttacactttatgcacaaattaactcaagatggattaaagacttaaatgtgagaccaaaaaccataaaaaccctaaaactgtaaaaccataaaaaccctggaagaaaacctaggcaataatattcaggacataggtatgggcaaagacttcatgtctaaaacaccaaaagcaatggcaacaaaagccaaaattgacaaacgggatttaattaaactaaagagattctgcacagcaaaagaaactatcattagagtgaacaggcagcctacagaatgggagaaaattttcgcaatctatccacctgtcaaagggctaatatccagaatctacaaggaacttaaacaaatctacaggaaaaaagtaccccatcaaaaagtgggcaaaggatatgaacaaacactatgcaaaagaagacatttatgtggccaaccaacatatgaaaaaaagctcatcatcactggtcattagagaaatgcaaatcaaaacacaatgagataccatcccacgccagttagaatggtgatcattaaaaagtcaggaaacaacagatgctgaagaggatgtggagaaataggaatgcttttacactattggtgggagtgtaaattagttcaaccgttgtggaagacagtgtggcgattcctcaaggatctagaactagaaataccatttgacccagcaattccattactgggtatacacccaaaggattataaatcattttgctataaagacacatgcacacgtatgtttattgcagccctattcacaatagcaaagacttggaaccaacccaaatgaccatcagtgatagactggatgaagaaaatgtggcacatacataccatggaatactatgcagccataagaaaggatgagttcatgtcctttgcagggacatggatgaatctggaaaccatcattctgagcaaactctcacaggaacagataaccaaacaccgcatgttctcattcataagtgggagttgaacagtgagaacacagggacacagggaggggaacatcacacaccggggcatgttgagagattgggggctaggggagggatagcattaggagaaatacctaatgtagatgacaggttgatgggtgcagcaaaccaccatggcacgtgtatacctatgtaacaaacctgcacgttctgcacatgtaccccagaacttaaaagtataataaaaaaaagtaaaaaacatttatacaaaaaaaagtattcaattaacatatattgattgctaaaaaaaaaataaataagatctaacaccattggatcagagacaagagtttgggtgagggcaaggggaacggggtatagaccaaattcttcaaaccctgggctttggaagacaaagctgctgcaggctgagaaagacctgtgtgactgttgttattccctttttagtcagaagttgttttttcttaaagtaataaaatccttcagtatttttctgactggttgaagaggatcctatccattggaggaaaaattaaaggtactttgcttcctagattactgctttattgagaggtggaggatgcaatggggattgtttttaaaggaaggcaggcaagtagttatcagcttcaatagtttatactgaggacatagaagagattccagcatgaccaccttcctttattcctttctttttccctctttcctttcctctgtatctgccttcccccctttctgtctcactcaactttttcgaaggtcagcaatcaactattacttgttgataggtgcttaagtaagggaataccctacatataattagtatcactcaattatttttaaatacttaggactccttccttgattttcttttctagccatctcaaataacaaccatttgcacctactgtgttttgaagttttctaccttgtgtgtatgtgtttgacttaaagtaacacaatttggaaacataggagtcatcaaaattaatatttaaatatattttttaggaagtctaaattgtaatgaatatttaggaagtttttattgagggttattatgttctcaacattgtaccaggtactgaggggaaaaaagaaggaaataaggaaaccaacctttctttgagcgttactatgtatcaagccctttcacatatgttttctcattttatcttcacaacaacactgtgaggtaagtattatgctccccattttaaaggaactcagagtggttatatgacttgcttaggccactgtttggcaaatggcagagcccacagcatgaacccatgtctaacagagtgaacctagagttttgtgttcattttcttattccacagatacaagatctagcccttggctttaaagaatttatagtctagtagcaaaaatatgccacagacccttgggattggtattttgagatgttttatggctaagttttgaagggagttttgcaattaatacatgcagttacaatttaggaaaaagaggtatcattaaagacagaatcatcaagaaaagcttctttggacattgagattgtttggagaaatagtaagatttcaaaagataaagttactttccaggtaacaagaatagcattaatttgaaaaattatttctgagaaactttggctgaatttcttttcatcttgtcaaagtaagtgggtatgaaatcttcagaaatgaatgaaagctccagatggtatgttatgtccttatccctgtatagagtgaaaaatatcaaatgaggaaaaagaataaatgataggaataaatatggcgtttgaaatacttagcagaatgccctaatcatgtcagacattgttttctcagggccacagttaggcactagctaccctgtttgttagcttacctcgtgttttatttgtagtttctgtagtaacattgctgttcatcttttctcctggtagaatataaaataattttactgacaaataaatactccattttaaaatcctacctacagagtttttaaaatttaagctaaaaaggttataaactgtagcttggaaggtggtacattatctctttatatatttattttttaaaaatttgccttcttgtatgtagggaagttggagtattgtggatgggaagtggagggtggggtaggaggatcaccacctgcagcctgcgtgtgataaggcaactgtagtgtatttactgtataatttttttatgaccttattaaacgtatagattattttggttaagttgaatgtagataactatttgatttacttgttgaattttttttttagtgtgtcattttaaacttaaatttatagtttctagaaagaggattgtgcgtaactagtttttgaaattgtaattagaaagatgattgtttgcccattatatttggtgttttaatctcattttataattaatacatcggaaattaggagggcaattaaggaagtaaaggaagaaaattaacatttttaaagagcctgctttttacaaggtgttttatttgtgtaattgcattttgtcatcacatgaaaaacatgaaataaatattattacttaaaggaaaaaaaactagataatgaatctgagacctagagagactgaaaaacttgcccagaacctcaaagcaagtacgtggcagaactgtgatttgaactctaacacctggtttgaatgcatttaatcatatatggtgttcagagatgacagctctcttcaagtaatacgtcgtcagcacccatagaactttcgtgctatgccacgtatcacccagtgggttaatagtggactctcattgttgtcaggagttgtattatatataatagcgagacttctttctgctagagcaaaggaacaaatatagatgtcgtagatgggtggctgataaatttgatagagttttattatgtaatgttgagccagtcgcttaaccatactgggactcagaattttgtcatctgtagagtgagggagttagagtgaaggatctctaaagtcctttcttctaattctaaattcagtggtttgcctatcagcagcagataattatttcttgaaatattgagtatattgtggagtagtatagtaataaattaccacttgttgagtaccttctgcctcgtattttacatacatatatatatgtacatacatacacatatatgtgtgtgttagtaagatatatttaatgttactaacatctttggaggacaaacagtctattttatagctggagaaactaggttcatggaatttcccagtggcaaggaattctttcagagatggagctgggagataaacctgcagctttcaagtttccagaccagtgctttttccatattcctacttaactaatggatctctgactaccttacagtagggccttgaggtgagaggttttccagtgtgggcaattcagaagatatgggttttccatgcctctagactagtctgtctgtctgtatcatggatcagatcttgtcattcttgactaatacatgaagatgtatttgagaacttttggataattccatttagggaaacagcagcttaatgtagatgattcactagtatgtgaagatttcagcattgcttttccaactaagtcatagaagccataggggagacactgattttttttagaggcagaatcatctgaatatttgcagtaagttatataatcattgcatttttaacaagttgaacttgagggacatgttttgttgcttcctctgagttgatacatgctaaattattggctttctgattttttcacccctatatctttattttaatttaaaagcgtttattatactttgagtaaagttaaatgaggcctaaggccacattgggaggaagaacctttaagccttggaatttaggaaagatacagaggcgttcttttgggttggaaataatacataatcaagcagatgctaatgaaaaaatgaaatgcaggggaagagaaaagagactagggtgcctgtttggaagttttatagaggagagtacattgcccctttattacaataatgtttctgaactataataaggtctttcattgcaagttcagcttttttcattcatttgttttgtgctctgcttcctctgttactaattgtcagcacaatagtcttccaactatgaagtctcagtgtccttttggaccaatttgtcattgtctttctccctcaccccccaacccatgcactcagaatctattactatggttgcatttttagacatttttaatgttttaaaatggcactgcttttgaaacctgccagaatagttcatgataactgaatcatccaaccagcaacagttattgcttccaaaagcacactgataaagtttctgtctctatagggtgttcttataagataattaaaaataaacatgtaataatctttacagcactatttcatatgcattgtttcctttgaacttcacgttagtcctgtgtaacattttgttaaaatatttttgttaaacagtattatttacagatttactgtttgcctcataaattgtttgatatttctatgcctctaggaagttccatctctcttctttacctattgatgggtctttatttttatagacagattattttattatgactaaggaatcagcaaagttggcttagactgacaagcctgaataaattctgatattagactccaggcaactttagttacatgttaattcatgttaggtttttaacattttggccaatgaacactttaaatgtgttctcagccttgttccaataatctgatactgacagaaagacattatttaaatataacttctataaagaagtcctgaagcagtgtaatattacttgacaacttatctgtcacttacagaactttgtcttatgtgatcagagcttgttggtgcttttacatataatgtcaatgaagatggcagttatttttaatgcatgaatactaaataaaagattggtcagttttctctgggagaaaacatatttcagttctctatcacctgtttgtatcaatttattcacataaaactagaaagtgaaatacagttgacccttgagcaatgcaaagtttaggggcttcaacccttgtgtagtcaaacatccttgttctaacttttgactcccccaaacttagctaccaatatcctactgttgcccagaagctttaccaataaacagttaattgatacatattttgtgtattacatgcactatatactgtattcttataatgtaagcaagagaaaatgttattaagaaaatcataaggaagagaaaatatatttgctattcattaagtggaagtggatcataaaggtcttcatcctcattgtcttcttgttgagtaggctgaggaggaggagaaagagaaggcgttagtctttctgtctcgggtggcagagatgaagagatgtggagcgggtggaaggagaaggcaggagagataggcacatttggtgtactattattgaaaaaaatccatgtataagtggaattgtgccgttcagacctgtattttccaagagttgactgtgtataaacgttattagaaagaaagaaaactttacttcctttcataaacaaccaacatccatcctaaaaacagtatgtgatacaaaaagagacatgaatttagagctagaaaacctggatttgagactcagttttaccacattaatggcttgatgattttgaataagtgatttagacattaaatagcttcctttttaaaaaatttgtgaactggaaatgaccatactttagaactcagctgagaggattaagtgaggaataatgtatgtgaaatcttaatgtagtgaatcaactgataatatgctaagataattacttagtagttactatttaaaaaataaattttggagaaagatataatagaaagcaaaattttcctactgatttaaattggcagagatttaagatgagattttccccccattcttctagagatcagtgaaggagctgattcttttactttacttcatatagcttgctatctatcaaaccagattttaaaatgaagtgtttttattgtttttgttgttgttgttgttgctgtagtaaatacccaagaggcctttttatgtctgtggttggaaccatctttcaaagccaggctaacttatttggagttagaattcctgaaggcaaagaaaacacatctataccttccccttaaagtttaaagaagttagagagtgctttccaaagaggtggtattctgataatgactgataggctatctctatatttgactttttttgtttgtttgagacaagagtcttgctctgttgcccaggctggagtggaatggcgcgatctcggctcactgcaacctccgcctcccagattcaagcaattctcctgcctcagcctcccaagcagatgggattacaggcacccgccaccacgcccagctaattttttgtatttttagtagagatggggtttctccatgttgtccaggctggtctcgaactcctgacctcaggtaatccacccgcctcagtctcccaaagtgctgggattacaggcatgagccaccgcacctaccctctatagttgattttaatggaattacttgatttgtttataatcctccacaattcattgtttatttggacagtgctttactctggataagtagacctacctttttatttttctccaagggggaaaaatcctttattctttacatctactcctttcaccttttcctgtggaaaaaaaaatatctcaagtattagagctgttgctccaaaatcaaaaatatgattaggattcaaaaatatctattttttgaaaagtatgttttttgaaaaatatattttttcatatatatgaaatatataaatatacattttatgagaaaaaaataagttgtgagaaattatattgtttctgaaatgtttcctgaagcttttcctagaattcagtctgtatgtgcttagattttgatgaatagaaaagaactatgagaagtattccaaattccctgaaacttaaggagttccactcaaaacagtcaaataaatcacagcatatgatgaagtaccaccatatgggatacaaataagtgtagtagatcttcagggatagagagtatgagttggaataagagaagatcttgagtgactagaatctaagtaaaaaggaagggagtatgtgtcaggtgagagaaacagcatgagttgttaaatcctgaagttaataataatcagataatttttaggggacagtgaagagacatgtttattagcagaaagtacttatagtttggcagtgaggaatacagtttgaaactttttgttttaattaatggggcttccttatgaatagctttgaaagtcaggctaagaaatgtatttgaacattgtcctgcagacaggaaaatatttttgaagagaatgacatacagtttaagaatttgggtaggactcatcttactagtagtatgtaggacaacttagggagaagggtagaaaagggagaccacctaagaggtcatttcagtgatgaggattttgatagtaagttcccgggttgggtgtcagcagtggacaaaaaaaggatgattccaagagtcataacgaacaaactgttaacatgaatgttggtggcttagccatgagggctgaaagagaaggacgagccagagatgactgaggaagtgtttcttgggtgattaggaagatgatatggaaataaaatagaaaaactgtactggtatagtaattttcaacttggaagctgaaacaaacaaaaacaaaacccttttggatatcttgaggatgaggcagtatagggcatcaaaggagatgctagttttgccatatggggatggagcttgatgagaagggccgtgactgaagaagcaggtttgagagtcatcagacatcaggtgtcagtcgatgcagagctactggggagcctatctataattaaatccaaagtccttaccaactcattgaagatctttctaacctcatctcctaccttttttcctaacttacttgactccaattacactgggcttcttgctgtttcacaaatccatctgtggaatccctccagctgtgagtctgcacttaatgttcattctgtgtaacttactcttcccgaaggtaatctgcattggcctctcatttcattagagacacccttttaaattaatctttcgaaaatagtatcacctcccgttcacttcaactcgttgacctgccttatttttcttcatattgtttataagcacctactatgttataaattaattgttttgcttgtttattgtttgactactcatcccctcagtaaaatataagctttatggaaaataggcaccttgttttgttcactgctattcagtgcctaggttactggctgatatactgtgggtacctaacaaatattgtgtaattaatgtctagatttactatgggaaaaaatgtcaaaaataaaagcataacagaaaggtctgagcctttggaaggtaaaggtctgagcctctactttggaagtagaggccctaagaaaaactaatgaatggtatgggatggtagtaaaaccaggcaagtcagtgtcatggaggtcaaggaaaagggactcaaaggatagggagccaagaacatcaaatgctgcaaagaaatgaaaatgagaacaaggaaaatatatctgataaaaaggagactgcagtagagtggtggaaaccagaatttagctaattggttaaggcatgggtaacaaaggccagccttgtagattattttgagtgatttaccagcaaaacgaaggagaggaatggggcagttagcgggaagaggagcagcatttaatacaagtgctttaaagagtgactttgaggctggatgtagtggctcacgcctgtaatcctagcactttgggaagtggaggcgggctgatcacctgaggtcaggagtttgagaccagcctggctaacatggtgaaaccccgtctctactaaaaatacaaaaaattagctgggcgtggtagtatgcgcctgtaatcccagttactcaggaggctgaggcaggagaatggcgtgagcccaggaggcagaggttgcagtgagccgagattgtgccactgcactccatcatggatgacaaagcaaggctccatctcaaaaaaaaagtgactttgaatctgcatcttggtctttgtatatgtttattgtttatttcactgtggtatgtatgcactgataagctactttgaagatacgtgagtagaaattgtctcattggtacagatggaaatctcgaggcatttaagttgtaagttacttctaagtgggacctatgcaattggtacatatggacataaagatggaaataatagacactgcggactccaaaaaggagaagggtgggacaaggaccagaaaactacctattgagtactatgttcattatttgggtgatgagttcactagaagcccatatctcagctttatacaatacacccatgtaacaaacctgcacatctacttcatgaattgaaaatttttttaaaagctgtatcacaatcacatctaataaaactaatctttagtattaccaagtacaaattcatattcagatttcccacttgttgcctaaaactggtttgtttagaccagaatgcattaaggaggaccacgcattgcatttggtttttataaatcttttaagtccctactagtccagcagagtattagactaccttcctcacccctcttttgggtacattcacttattaaagagactacttcatttgtcctgtgaaagttctgtcttatggaattctctgatcgtttctacgaggtgtcatttaacttttcctctacctctgtatttactgtaaaaggaagttagatctaaggattccatcagattcatattcagaatttttatcaagattgtttccttcgtgagtctgtgtacttcatattgcgttatgtcaagaggtacctagtatttggttgaccagctcttagtaatgctatcattgttcactgggttacggtggtgacagtgtcatctcttcattataaactaagtttctctcatgtggttaccagataatctgtggtttgacatgttggcactatgcaatatttagtcttaattagttatttaccaaatgattttaccattggtgatttttgcctgaattaattattttattaggggtagattatcttttaggtattttttaacatgatttcaattagccaaggcacagataaattggggcagtatgttagtcattctgtttatttatttgagaccagccctgtttaggcatagtaccagaaatcaaatagtatggaccttcccctaagggaattttcaatctaatgtacattcttgttgaattgtttaaaaattttgttatcaaatcccagtttcatcatgtttcaaatataaatagcttttcttaaaaatagaccgggcacagtggctcacgcctgtaatcccagcactttggtaggctgaggtgggtggatcacgaggtcaagagaccgagaccatcctgaccaacatgatgaaaccccatccctactaaaaatacaaaacttagctgggcctagtggcgcacgcctgtagtcctcgctactccggaggctgaggcaggagaattgcttgaaacccgggaggcggaggttgcagtgagccgagatcgcgccactgcactccagcctggtgaaagagcaagactctgtctaaaaaaaaaaaaaaaaaaaaaatctcataattatttttcagattttaccatgttatgtaatgaatggttaaatatcctgtgtacatctgagtaatttacttctgtttcatgcattatgactataaataaactgcttattctggtgtatgagtacaatggagttttatgccactattaaatataatgatgtagatctttatttactgaaatggaaaatatccaaaacatataatatcatcaataatggtctcatttttgtttctaaaaagtgcttagaataggtctaaaaatgtatgtattcaaacactaataatggttataactgaatggtaggattatgagtatttttattttgcctatacttatgtatgtatttttctgtattaagcatggatgatttatacagtgaaagtaaatcaagaaatatgtttgaaaaccatcttgcccacacaacaatttgaattcagtaatgtcaccaaactgtatacttaaaatggttaaaatggtacatttcatgttatgtatattttactacatttttaaaaagcccatggctattatactgcaaaaaccaaaatcaaagccaaaaaaccaacatgcctaattccttgagtccactagatgtttgcatgcctcttataattcttttagtaaatgccttatgtcatttttatattttaactattgtctcaaaatgaccacagtacgtttatttggaatttcaagtaggcagaaagtatgccaagaacagttgttccagaagactcttgaggtgtatgtttgtttaattagaggcaggattcggtgggcaaacaagacagagaaatgttgatggggaaaatattggctctgtaagtgtgcttttggtaaatggtagtatctgtagtgaccatattcaaagaagaaaaatgtgttaggagaagttcacattaacatatcgtgacttcaaattcaactcaagttcataaatagtatttcatgttaattccaaagtggtggtttatgataattaaaatgtcacaatttggaatgtggatgatgaagtgaaaaacatcttctagagggaaatgtaatgttagtaatccagtctgactcccattatttattgaaccccttgtattatggaatcaaatgtaagaactttgtcttctctcctatttgcttatgtggagagagatatgttgagtttgggtgataaaacgcaaatggttcagacaaaaataactagcaatgcggagctggattgatgtgagtctgcagatcacttttccattattagtaattgaactttttttaatcattaacttcattggtattggagaatgtgagagccagcagtgaaagaacccaaaggctctcttgccttcctttctgctatccttaccactttctttcccttcagcttctcattctaaaccgcctcccgttactcctacctggagaaacgagatgtcaaggatcagcatcctgctaggggataaccctcattcctgtccatccctatactgtggagagaaccagaggcaaacacattggagccctctcccgctcaaacactgttatcagttgaaacttatcctggatttgcttatatgagaaaaagtgtcatagatgggagaagggccaagcacggggaaggtgtagagaaggtatagaagagggaacagacattcctatggctttgacagatgattactgatttttaaggcatttttcctagcagtgtattctcttcagaagagcatgggattgggattgagatagacttggaataaatccttatataatgactcacagttgtgtgttttggggcaagttatttagcttgcctgagtcttgtaaatttgctcatttagaaaatggaagataataacaccttttaggtttttcctttggattaaatgaataacatttatgcaccactctttgtgcagtgcttggaacgtagtgatcactcaacagttatctgctgctggaatgctctctaccaggacacctgcctcacctaagtcaccttccgctcattggattaaatgaatctcttaaaggttgatgtattgagtcttaaataggtgttatgcttttttgcccctagtgaaaacattaaacaaaagatagaaatgctttttgtccccttcagagaacctccatggtgtatcatatttttaagacctgaaaaataaatttggtttatggtcatcataactcacagccagcattatttcattatgtgatttaataaaaaatggaatctggccggatgcagtggctcacgcctgtaatcccagcgctttgggaggccgaggtgggcggatcatgaggtcaggaaatcgagagaccatcctggctaacacagtgaaaccccgtctctactaaaaatacaaaaaaattagctggatgtggtggtggccacctgtagtcccagctactcaggaggctgaggcaggagaatggcatgaacccgggaggtggagcttgcatgagccgagattgcgccactgcactccagcctgggcaacagagcgagactccgtctcaaaaaaaaaaaaaaaaaaggaatctattattatgccttcgtttttcacattggatgttattttagaaagaataaaattagtgtttaaatggctaaagaggttggttgaaattaaacctttaaacattttaatctaaacagatgatctctaaaaattttttttttggtgtatgtatttcttggtctgacatgttgcagtctctctaattgggtttcaggtttgcagagtaattacagctttgtacagactttgtcatctgtggctcagaatggtgtaaagtaagcagaacatttaaaattcagcttgtggttcatgttgctcagtagagtttaactagtgtataactatctaatataagtaacagtgtaacaaataacactgagaagtagatgttataataagagttagctacctggcattttgtataagcacatttactttactgatgcatattaaatgattctaaaaatcgtagataatcatttggttaatagctttttagaatctctatccaaagtttctacttctgatttttaaaatttaaattgccctaccttgcgttgggaatctttacgtaaccaaaaggcaaatattcttctaaagaagtattggctaatccatttattaaccaccatttcctttaagaatcatgtgtttctgattccttattgcgaacatgcaagaactcaaaagtttttctatttactcgatcactggttttaacatggtaatttagagttttaacttttttgaatttggattcagctttttaaattacatttgttttgtacagcaacaaaccataagacattgtgatattctcttggtagtgatccaactaccacttgaacatcttggtgtagagatgaaatgtgtttgtagagtatttcatactgagacctaaaaaatataggtttatttctattatactgtttatttgtaattacacgtaacattatttttgttggactagagggttcacaggacctgattaaaccctttatagcataaatgaaatactactttataattacatgggtagaatgatcagtagtatggtgtgtaccatgagctcatagagtttcctactcatttttgtgtgcccagcattttgcatagtgcttggcccataactgacatttcatatatgtcatttggttcatgaatacttagcaagtttagtaagaacagtgaagttgtgcataactacttagtcattatgttactattttaatatttttccaaaccactctatacataaatacaggtattttattcttttctaagccattccttttcagtgatctgcttgagaatggtaattatagtaatatcttttattgtttttagcagccttataaattatagtaattgatatttggaatcttataacagcacttcgagtagcttctaaaagtctagtgttgagaagttctttaaattatagcatttaaacttcatttaggtatagtgttgaaaatatgcttttaattcatgatagtgcttttaaagatgataaacctgagggcttagatataaagtactttcaaaaggatcacacagctgattgtgttagagcctggatttgaatttctttctgattgcagagtccattatcttaattaccttatatcaccataatgggaacctgaagtaaaactgaaatagtgaacctcagaccgggcattctttctttgcttctgtgctgtatttctctgtaccccatagtatttctcttgggcacgcccctcatttaagtgtctgtcctccattctttacgtttaaagccagccaatcagttgcccaatcagggtatttattgtatactcctatgtcctgtcactgtcctaggtgctataagaagaactgtgcacacaattcctaacttttaagtaatatagctagtgaattactggctggaaatttaatagggcttttgaaaagaaggatatggggaggaacagttggcttcaaagagaatcagactgatgggcagagtcagtcataggaattggttggctctttattagtataaattagtataatgtctttggtattttaaaacttaagtctttcaaatgaacaatatttttgcttattttttgtggaatatatattttgtgttttttaactttcatatttcaaaaaatgtcatgctgctatacaaagttgaattgtgatataatagattttatgacctattgattctaccaccttttcattgtcttgcacatccccaggttctcactttcctccatacccattttaagtttcttagttgagtatcataatcactcccttgccttgcattctttattcttttctgtcttcttgctttgacaaacttacttggttaaagtacagccttgcttaaattcattactctatgttcctcacctgtacacatgcagctgaatatatctgggtatatctgggagaaaatacacaaccatgatctctgttattagtttaaattcttcattattaaattcaggttggtccttcatccttctcggcagtcatggttggtctccttagcctatttgtactttgattttcccagagtgctatttcatatctttttttcttcaaagcctgatggatccttttgcaacgttattcccgatgactttatatcctaattcactgaaaaaaacagaagcagtgagaaaataatttctaccagcttttacttgcttctgtactcctaattgcatttgggcccttatatcttctcttttattttattactaaactatttatactcctgattagagctacccctttacttgtccagtaaatttaatcccttcttgcttatataggtacattgctttagaaattatcttttggtagcatcaaaattaccttctttgttggattattactatcagaattcatttggaaaatgtttattgagtacctactatgtgtctggcatagttctaagtgctaagaatatatgaatggagcttacaatctagttgaaaagacaataagcaaaaaagatactaaaaaacttcatatcaaatgttagaaaatggtaacatgctatggaaaataaaaaatagagcaggtaagagaagatggagggagagtcctaggtaaggggtgcagattgcagtattaaataggatgtctaagagagcagctgtgcgggtgtgtgaggggggaaagaatgttaggcagagggcaaaaagctctaaagcagaaagagtgtagtgcattgttgaggaaatgcagggaagccagggtggctggcagagcagcctgaaagagagtactaaggaagtaggtcagaaacttcagtggggtcagtgggagggtcagatcacgtaggacacctgctgatcacttaaaggccttactcatctattcttagtgaactgaaacactgcagaacttttttgcagatcttcattttaagaagatttctggctgctgtgttgagaacagactgcagtgaggggcagggaaaagctattctaagttttttggaatcatcaggtgagagacaatgatggcttagtctgaggtagtggaggtggtgagaagttatcagaagctggttatgtttttaaagtagaaacaccaagatttgcaggaggagtgaatgtgatgtcagggaagagaggactccaagggaattcttgggttttcagcttgggcaattgaaaggatggaggtgtcatgtgagatagaggaagccacagtagaggttggcagaagaaggagcagggttgagagaggtcaagagttcacgttcggacatgttcagatgtctcccagagcacagtttctgtctttaacttacatagtcactcagcatctctaaataggaagaatcttgtcttagggcagccgggaggtttaggcattgggcacacagaatctgaagtagaattatagcagtggaaaaccagttacgaatggtctcccacttacagtagttcatggtaacgatgtcttactttaccgtgctcctgacagcagtacacactcaatggagattgtatttcaaattttggatttttgtcttttcctggggtagtgatttgctgtgtgatactccctagtgatgctgggcagcagcagcaaatcacagcttgcagtcagccacgtgatcacaacatgcacagtagatactctacagtgtactgtgttgccagcatttttctggatgctcttagtttttgtgttttctcatctcatcatgtcgacaaaacacccatctatgtgtaatattcaatactttactacaaaacaggctttgtgttggatgatttttgtccaactctaggctaatggaagtgttctgagcatgtttcaagtaggttaggctaatctatgatgttgggtagtctaggtgtattaaatgcatttttgccttataatatttctgacttacgatggttgtattggaatgtaacacagtcataagtcgaggagcacctgtaatgacaaatagtaccagtatcaaaaaggaagatcagtttatgtttcagcctgggtgatggaaaattatgaaagccaggaggaggaatgaattttagggggaaaatactgagtttggttttaggggtggtccagtaattcaaccaggtagaaatattcactatgtgtttagacacgtgtgtcttaaagtagaactgcaaggtgaaaaaagtttggattttgatattggtaaactgagagatgattgctgaaaacatgtaaactgttagaaaactaagcagagacccttgggtgaatgatttctctcagtgtaaagggccaataaagagctaatctggggctggatacggtggatcaagcccgtaatcccagcactttgggaggccgaggcgggcggatcacttgaggtcaggagttcgagatcagcttggccaacatggtgaaaccccatctctactaaaattagaaaaataagctgggcatggtggtgcacgcctgtaatcacagcaacttgggtggctgaggcatgacaatcacttgaacccagcaggcagaggttacggtgagccgagatcgcgccactgcactccagcctgggtgacagagcgagactgtctcaaacaaacaaacaaacaaaaacacagctaatctgagtaaagaattggaactataaagagatagaaatggcagttgatagttgctaatgatggagataggacacagcagataagcactgagaaaagacttgaagttttcaacggagataaattagtttcttccaaaagagcagagtcagcagacaaccctaccctattttttcttggtgtccaataccatttatcctttaaagcccagctcagatgtatgccaaataatagttaatgtttgttgaaagcttataggtctcatattatgctaatattagatgaacttattattaattcctacatcaattctatgatgtagatactgtttcccacttaactgttgaagactagcgagtttaattaatttgtccaagtttgtgtagttaatggtacgaaaaaataattgaatctacgcacaccagtgtcagagaatccatactttaggctcatgtttgttgacatcttcctagttattcagtaacagaatttaatcatgtttagagtgactggctcttggggcagtggatactaagagttacaggcagtttatattgtcaaaaagcttataatctaggtaaggataagtgatatttgtcattttcttaaaatgataagtaatactgtaagatagtctatggtaagtgacacatgagggatatggtaataagtaaagagaatagagaggatgaaatggtcagtctagggcgaggtgttatggaaggtttcatggaaggaataatatttgatctggaccttcaaggatcagtactattgtgactgcaggtgatgcatatggatagaggtaaaataagtgaggaaagtatttcagatagcaagaacagctggagcaaaggcataaataaatgaaagagttaagatgtgtgtttggggaaaattatatagtccagttgaggtggttaatgtggccagaatgggtgaaggattggaaaggaagactaaggtcaggctgtaaataatcttgagtggagaaccatagaaagctgtgagttcgcactgggttttgtttaaaatagaactctgtagttctcaattatttacttcttgttttaaatatatccatatttaaagaaacattttattttattcttagaatgccagttaatgaaaacagaacgaccaaagccaaacacatttataatcagatgtctccagtggactactgttatagagagaacatttcatgtagatactccagaggaaaggtaagaaattcacttgttttcattttgtgaaaaagcaacactcaatctaaagatgtatttgtatctgactttattatttgtaaatatatataaatatatttttttaaatgctatagtctctaaattcttgcttctggcataatacatgaataacagtggcttacaaaataatatttaatatatcagaacctctgggcatgctagaagatatactttcagagaaacagaacatttaaaggttaaaatataaatttaaaaagacatttttggcctggcgcggtggctcacgcctgtaatcccagcactctgggaggctgaggcaggtggatcacaaggtcaggagatcgagactatcctggctgacaaggtgaaaccctgtcgctactaaaaaaacacacacacaaaaaatcagccaggcgtggtggcgggcgcctgtagtcccagctactcaggaggctgaggcaggagaatggcatgaacccaggaggtggagcttgcagtgagccgagattgcgccactgcactccagcctgggcgacagagcgagactctgtctcaaaaaaaaaaaaaaaaaaaaaaaaaaaaagacatttttatagccaaactaccttttttaaaaaattgtataattgattgtattcatacttgaaattccaaggctagtgatagtaaaagatttcaagtaacatgccattctaaattagttgtaagtggctgtctggagcactaagttgctaaggattctgagattgggtctaaggagcgggagagaggattaattagcattgactgtcattattactaaagtgggtagtgacaacactgtagtaaccaactcatcaacttcatcaggtccacatttttatcctcctgatctatcagtttttacaaccacttcccaattctatatctgctcactctgatactgagttaggtccagtgaccacagtcacaaaaccaccatcctgcacatgttattatatttgatcctaatcagcaactttgtgaagttaaatcttattagccttattttccaaatgaatacacaaagttttaacagtcttgtctaaaattttaataaaagcaaaatggtaaagtattattttaataacacttttgatcagtagagtaaatggtaatgtatgattgattaagaaatatagaaaagagttaagcactgataatattttcttttgtgcacttccaatcttactatgtgcagacgtaattaggcctttcatatagatacagttctgggtatgggtccccgaactcttaccctgcctgcacaccctcccctccctgcactgcctccctccccgcacaccctcccctccccaccattgatcctgggccttttctcccttgataattaatactgagctttcaatttgttgatatgtccacccataatccataatcactaagttgggctaattcctatgtatcttttcagatctgagcttaaaatgttatttttcctacaaaacctctgactctaatagactaggcaggttcccctgctaggtacttagatatttttctttgtaccttttctatcaatcatattataactgtaatccttgtttgccattctcactaaacttgaagattcttgacagcaaagatgatggcttccttgctcatttaaaacatcttttgcacatagtccatggcccaacacagtatttattgactggctggatgaatggtacttttcccatgtcaatatatattctttgaaaatgttattcttagtggatttttaacatctgttgaagcacaattcattttgccatttgtgtttacaaagctggatttctgtcagatcttaagactctaaaatcctctgctgttcctgtaataatatactactcttctgaacaatcagttttcatttgcatttataactataagaaaaaacagtattaatacaaatgaaaaacagcatactcatatttgccattggtatgtgcatttctatatacctctagaatctggtgtttggacattctatatgacttgatttttttttctaaatttttattttattttatttattattattatactttaagtttcagggtacatgtgcacaatgtgcaggttagttacatatgtatacatgtgccatgctggtgcgctgcacccactaactcgtcatctagcattagatatatctcccaatgctatccctcccccctccccccaccccacaacagtccccagagtgtgatgttccccttcctgtgtccatgtgttctcattgttcagttcccacctatgagtgagaatatgtggtgtttggttttttgtccttgcgatagtttactgagaatgatgatttccaatttcatccatgtccctacaaaggacatgaactcatcattttttatggctgcatagtattccatggtgtatttatgccacattttcttcatccagtctatcattgttggacatttgggttggttccaagtctttgctattgtgaatagtgccacaataaacatacatgtgcatgtgtctttatagcagcatgatttatagtcctttgggtatatacccagttatgggatggctgggtcaaatggtatttctagttctaggtccctgaggaatggccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagctctttgtcagatgagtaggttgtgaaaattttctcccattttgtaggttgcctgttcactctgatggtagtttcttttgctgtgcagaagctctttagtttaattagatcccatttgtcaattttggcttttgttgccattgctttttgtgttttagacatgaagtccttgcccttgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcgtcatttctgagggccctgttctgttccattgatctatatctctgttttggtaccagtaccatgctgttttggttactgtagccttgtagtgtagtttgaagtcaggtagcatgatgcctccagctttgttcttttggcttaggattgacttggcaatgcaggctcttttttggttccatatgtactttaaagtagttttttccaattctgtgaagaaagtcattggtagcttgatggggatggcattgaatctgtaaattaccttgggcagtatggccgttttcacgatattgattcttcctacccatgagcatggaatgttcttccatttgtttgtatcctcttttatttctttgagcagtgttttgtagttctccttgaagaggtccttcacatcccttgtaagttggattcctaggtattttattctctttgaagcagttgtgaatgggagttcactcatgatttggctctctgtctgttgttggtgtataagaatgcttgtgatttctgtacattgattttgtatcctgagactttgctgaagttgcttatcagcttaaggagattttgggctgagacagtggggttttctagatatacaatcatgtcatctgcaaacagggacaatttgacttcctcttttcctgattgaataccctttatttccttcttctgcctaattgccctggccacaacttccaacactatgttgaacaggagtggtgagagagggcatccctgtcttgtgccagttttcaaagagaatgcttccagtttttgcccattcagtatgatattggctgtgggtttgttatagatagctcttattattttgagatacatcccatcaatacctaatttattgagagttgttagcatgaagggttgttgaattttgtcaaaggccttttctgcatctattgagataatcatgtggtttttttctttggttctgtttatatgctggattacgtttattgatttgcgtatattgaaccagccttgcatcccagggatgaagcccacttgatcatggtggataagctttttgatgtgctgctggattcgatatcaccacagatcccacagaaatacaaactaccctcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatacaaaaatcctcaataaaatagtggcaaactgaatctatatgactttagtgtaatatcattgaagacttagagagggttagtgtgagttagaaaaactctctatttttaatattctgcccagtctaaaatttttacctgtcataaactaaatctgtatatctctcacctgtcttatatttatttcagtacatgatataagggtggactctatttttttctcaatggcgagcccatcatctcatctccatttattagataatccatttttttctcactgattgtggataacacatatacatatttgcgcttttaggatttagtctttttttcccctttgacctttctgtactctagcattaacaccacatggccttaattagagaaactataaaatttttaactgttaatatagcaacatatcccttattttttttaacaaaaatgttcttagctacattagtgcattcttttaaaaaattatggtaaaaattacataatgtgaaatcctctttcatttttaagggtataatagagtattgttaactatgtgcatattattgtacagcagatctctagaacgttttcatctggcatgactgaacctctgttcccattgaacagtagctctccattcccatacccccagcccctggaaaccaccgttctactttctgcttctgtgaattcgactactttagacacatcacataagtggaatcatacagtgtttgtcctgttactgtcttacttcccttagtataatgtcttcaaagttaatccatgttacagcatattagaggattttcttcttttttaaggctgaataatattccattgtatgtatataacacaattgccttctttcttttttttttgagacaaggtcttgctctgtcagccaggctgtagtgcagtggtgtgatcatggcttactgcagcctggaactcaggcccaagggatcctcccagcttagcctccccagtagctgggactacagccacacacgcaactaagttaatttttttttttttttttttttgtagagacaaggtttctctgtgttgccagggcttgtctggaactcctggcctcaagcaatactcctccctcggctggaattacaggcatgagccacactgccggccaatacattttctttattcattcatctgctgatggatatttagattgtttccacctcttggctattgcgaatagtgcaacaatgagcatgagagggcagatatttgtttaagttcctcatttcactttgtttgaataaatatccagaaatgtgattgctggttcatttggtagttctacttttaagtttttgaagaatcttcatactgttttctgtagcagctacgttattttacattcccaacaatagtgtacaaggttttaatttctccacatccttgctgacacttacttatttattttttatgttgttgtttttttaaaaacaacagccatactagcaggtgtaaggtgatatttcatcgtggttttgatttgtacttccctgataatttgtaatgctaagcatttttcaaatacctgtgtatcatttgtatgtctactttgaagaaatgtctattcaagtcttttgccaagtttttacttgtgtttctgttttttgttttcgctactgagttataggagttccctatacattttgaatattaagcccttatcagacatatggtttggaaatatattctctcattctgtagttttctgttttgttctgttgtttgctgtgcagaagctttttattttgatatacttctactcatctattactgcttttgtcagcatcaagaaatcatttctaaagaccaaattatgaagcttttctcctgtggttttttcctaggagtttgtagtttcatgtcttatatttattctttgatccattttgagttggttttgtgtgtggtgtaaaataaggctccacttttgttcttttgcatgttgatacccagttttctcagcagcattatatttccacattgtgttagttgtgacgcccttgtcaaagatcatttgactgtatatatatatggttttattacctgggctctctgttctgttccattagtctatatgtctttatgccagtaccaatctgttttaattactgaagctttagaatgcattttgaagtcaggaggtatgaagccctcagctttttgctttctcaagattgtttcagctgtttgggattctttatggtttccatacgaattttaggattttttttttctgtttccgcaaaaatgctgtaggattttgaaaaggattgcattgaatctgtagcttactttgtggtgttgacatcttaacaatattaaacctttcagtgcatgaacatgggatgtctttccatttatttgtgtctcctttcatttctttcagcaatgttttgtagttttcagtgtacaaatctttcaccttcttggttaagtttattcctaaagtactttattcttttttatgcttttgtaaatgggatttgccttagtccctttgggctgctacaacaaactatcataaactgagtagcttataaacaatagaaatttatttcttacagttctggaggccaggtgtttaagttcaaggtgctggcaaattcagtgtctagagagggccctcttcacggttcatagaaggtgtctttcccctgtattgtcacctagtaaaagtgccaaaggaactctctgaggacttttctataaatgcactaatttaatctatgagttctatcatgacctcatgaaggcccacttcctaataccatcacctttggggttaagtaacccaaaacatttattctttgtagacctagtatctgcagacaataacaattttatctcttcatttctgatagttttatgtattatttctgtgtgttttaaagcaatgtttaataattttgatcatagcacatataccttttttcttaatttattggatacaccactaatttactgttaaatatgatttgtatatgtactttattatgctgcacatgaccatccacaatatagacaaaggtcatttttctttcttaacagctaactactttcactgtcacaaccatggccacgacactcacactcacatacagagacacatgtgcatgcgcacacgtatgcctcgcccccaacatgttccagatacattgaactccttgttgtttcccaagtactaatgctatactgtgctcttacattacctgtagctctttccttcttgcccttttgtccctactgctaggaacacctcgtatcctttgcttgtctcttgctcatcctggtaagtaccaattcatttttcacatctacattcaagaattacctttctttttgggtccccatcacaaacttttattattgttagaacaccactgtacttagcgtatacttgtatcattttacccataacattttattatacttccccacaataccaaggctcccccatcagactgtaagttcttcctaagccattccttttttaaactttagtagcacacatgtattagacatttaattaaatatttattagtaagtaactaatcagttggtgaaaattgatttttgtatgaagtagtatatgtacttttaaaagattaatgtacttgtttcataggggtctccattctgtttttcaaattaattacatttttaaacattatttaggaataaaaagattggatgccctctttcaattagtcaggtactttggcctgatacttttttgcaggaattacccccccacacccccccgccacaccctcaccaaatggtgtagggttatagtttaagtatcatgaattatggtgaattatgtaatttgggtcagtagtccagctaactaccactagtgaagctggaaaagacttttgtttgtttttgttttttaaaaagacaccagagagctgataaggctaagatttattgggccaaaactgtattgaagaaagaaacccagacagtgaacctacttttccttttgggttacctgctagttcttgaagtggtattggagatggagagattttgagtagctcccagagctgggagtgatattttggaatctaggatctgccaaagaggagacatggtaaaccactacattttggtattggtagcttaaaggactgtaccctgtaagaaagagtaaactggaaatagatttgctttgagaggattgacatataactataaattatttcagtcctgaaattgagtgaaggtgattcaactttgctagttttctaggagcttgctaaaagcaaatgtaaactcactctaacagaagattatatcttcctagacctcacattacctcagttttcatgtgttgtgtccaggacttgttaaaaaatgagtacacaaaaattcaacactatgtggccaaaataatagaggaaaaaaaaacagacaatagaatcatattcataggaactctagataaaagaactatacattaattagtatgttcaagtatgttaaaattgtttgattctacagagggaaagtataaaaaagaaacaaatggataatagctttcatttgtaatcaaggtaaaattaaaaagaaagagccccatagaaattctaaaattgaaaacaaaacatttggaattatgagttctagcagatggctttaatagcaaactagacctcacattagagaaaattagcgaactcaaaaatacgtcagaacagaacgtttatagtgaaacatgcaaagataagaggatagaaaataaaaataattaagaatagaatgtaagataaaaacaatgcggtgagcatgtcttacatatatataactggagccttagaaggagaggagagaatagagcaaaaagtatttgaaaatataatgattgaaattttttaaaaaatagttaaagataccaaaccatagtttcaaaagtcctataaatctcaagtaggaaaaatatgaagaaaatccctaatctcattagactattaaaaaacaaagatagtgggaaaatccccaatgtagacagagaaaaaaatgtttgctttcagagcagcagcatgtagaccaaaagataatgtcaatatgtgggatggaataataatgaaatataattgaataatgttcccaaataatggaatatttccaaagatgatgaaatgatatccccaaagttctgaaagaaaatgagtgctaagaaacaactattttccatgaataaaagtaaaatgaaaatattttcagtaaaaaattgaaagaggctgggcattgtgtcttatgcctataatcccagcaccttggaaggctgaggcaggaggatcacttgagcccaggagctcaagaccagcctgggcaacatagtgagatcctgtctctactcccttcaccctccaataatttgataagatttgtcactagcacacctataataactaacctagtattctttggacacaataagaataatctcaggaggataagtacagaatggaatgaaaaacaaaatgcttaaataaaccaataaataaaagtaagcattgatttttaaataatttatgttgtgttttaattatataagtgaaaaatatctgaagtaatataaattgagatcctgacaaaaatggagttaattttttgtgaggttgctgtattttctggtaagagttaaaagtatggacattttagactttgcaaagtcaaagttaaatattataatttaagttacaattactaaaaagacagtgagagtatgatggctaccaggctaattggaggagaaatggaattagaaattattctggcatatattacataagtggaccatgtaaagctaaggatatatataaaaataattgcaaaaaaagacgactgaaaagccaacaggaaaattaaaatggaattctgaaaaagtgcaaaataatttaaaaaacaggcaggaaaggagaaaaagataaagatacaggttgaaaataaatagattgaaaaagattgatcatggaaacagtaagcataagaagaatggattgccgtattatatcatttcaaattaaatgtattaccatagattactaggatactttataatgagaaaagtttctgttgaacaggatgatatagcagtcatcaacacatgtaacagaattaaagggataaaaatgggcaatttcacaaccatatttggagatttaaaaattctcagcacttggtagaggagctacacaaaaaactagctaaggcatagaataacattgtcaaccaccttgatatacctagtatttatagaacactacactcaaaagtggcagaagagacgttattttcaagtaagcatggtacattgatcaggatggaacatattcttatcaggataatgcagtcctcataaaatgagttagggaggattccctctttttctattgtttggaatagtttcagaaggaatgggaccagctcctctttgtacctctggtagaattcagctgtgaatccatctggtcctggactttttgtggttggtaggctgttaattgctgcctgaatttcagaacttgttgttggtctattcagggattcaacttctccttggtttagtcttgggaggttgtatgtgtccaggaatttatccatttcttctagattttctagtttatttgcatagagatgtttatagtattctctgatggtagtttgtatttctgtgggattgacggtgatatcccctttatcattttttattgtgtctatttgatttttctctcttctttattagtctggctagaggtctatctattttgttgatcttttcaaaaaaccagctcctggattcattgattttttttttgaagggttttttcatgtctctttctcccactattattgtgtgggagtctaagtctctttgtaggtctctaagaacttgctttatgaatctgggtgctcctgtgttggatgcgtctatatttaggatagttagctctttttgttgcatcgatccctttaccattatgtaatgcctttctttgtctcttatgatctttgttggtttaaagtctgttttatcagagattaggattgcaactcctgcttttttttttttttttttttttgctttctatttgcttggtaaatattccttcttccctttattttgagcctgtgtgtgtctttgcatgagagatggatctcctgaatacagcacattgatggatcttgactctttatccaatttgccagtctgtgtcttgtcattggggcatttagcccatttacatttaaggttagtattgtcacatgtgaatttgatgctttatgatgctagctggttagtttgaccattagttgatgcagtttcttcatagtgttgatggtcttttcaatttagcatgtttttgcagtggctggtatcagttgttcctttgcgtgtttagtgccctgtagtggtgacaaaacctctcagcatttgcttgtctgtaaagcattctatttctccttcacttacgaagcttagtttggctggatatgaaattctgggttgaaaattcttttcttgcctgtaattccagcactatgggaggccaaggcgggtggatcacctgaggtcaggagttcgagatcagcctggccaacatggcaaaaccccaactctaccagaaatacaaaaaaattagccaagcatgggggcagacacctgtactcctagctacttgggattctgaggcagacaatctcttgaacccaggaggcagaggttgcagtgagccaagattgcactactgcactgcagcctgggtgacagagtgagactccgtctcagaaaaaaaaaaaaaaaaagaattcttttctctaaggatgttgagtattggcccccactctcttctggcttgtagggtttctgcagagagatccgctgttagtctgatgagcttccctttgtgggaaaccctacctttctctctggctgccctcaacattttttcctacattttgactttggtgaaacctggcagagacgcaacaaaaaaggaaaatgtcaggccagtatccctgatgaacatctatgcaaaaatcctcagtaaaatactggcaaactgaatccagcagcacatcagaaagcttatccaccacgatcaagtcagcttcatccctgggatgcaaggctggtgcaacatacacaaatcaataaacgtaatccatcacataaacagaaccaatgacaaaaaccacatgattatctcaatagatgcagaaaaggctttcaacaaaactcaactccccttcatgctaaaaactctcaataaactaagtatcgatggaatgtatctcaaaataataacagctatttaagacaaacttacagcaaatatcatactgaatgggcaaaaactggaagcattccctttgaaaactggcacaatacaaggatgccccctctcaccactcctattcaacatagtattgaaagttctggccagggaaatcaggtaagagaaagaaataaaggatattcaaataggaagagaggaagtcaaattgtctctgtttgcagatgacatgatcgtatgtttagaaaaccccgttgtctcagccccaaatctccttaagctgatatgcaacttcggcaaagtctcaggatacaaaatcaaggtgcaaaaatcacaagcattcctatacaccaataataaacagccaaaccatgagtgaactcccattcacaattgctgcaaagagcttaaagtacctaggaatccaaattacaaggtatgtgaaggacctcttcaaggagaactacaaaccactgctcaaggaaataagaggacacaaacaaatggaaaaacaacccgtgctcatggataggaagaatcaatatcaagaaaatggtcatactgcccaaagtaatttataggttcagtgctatccccatcaagctaccattgacttttttcacagaactggaaaaaactactttaaacttcatatggaaccaaaaaatagcccgcatagccaagacaatcctgagcaaaaagaacaaagctggaggcatcatgctgcctgacttcaaactatactacaaggctacagtaacaaaaacagcatgctactagtaccaaaacagagatacagaccaatggaacagaacagaggcctcagaaataataccacacatctacaaccatctgatctttgataaacctgacaaaaagcaatggggaaaggatcccctatttaataaatggtgttgggaaaactggctagccatatgcagaaaactgaaactgaccccttactgacaccttatacaaaaatcaacccaagatggattaaagacttaaatgtaagacctaaaaccataaaaaccctagaagaaaacctaggcagtaccattcaggacataggcatgggcaaagacttcatgtctaaaacaccaaaagcaatggcaacaaaagcgaaaattgacaaatgggatttaattaaactaaagagcttctgcacagcaaaagaaactatcatcagagagaacaggcagcctacagaatgggagaaaatttttgcaatctattcgtctgacaaagggctaatatccagaatctacaaagaacttaaacaaatttataagaagaaaacaaccccatcaaaaagtgggcaaaggatatgaacagacacttctcaaaagacatttatgcagccaacaaatgtatgaaaaaatgctcatcatcactggtcattagagaaatgcaaatcaaaacacaatgagataccatctcacaccagttagaatggcaatcattaaaaagtcaggaaacaacagatgctggagaggatatggagaaataggaatgctattacactattggtgggagtgtaaattagttcaaccattgtggaagacagtgtggccattcctcaaggatctagaactagaaataccatttgacctagcaatcccattagtgggtatatacccaaaggattataaatcattctaccataaagacacatgcacacgtatgtttattgcggcactattcacaatagcaaagacttggaaccaacccaaatgtccatcagtgatagacgggataaaaaaagtgtggtacatatacaccatggaatactatgcagccataaaaaaggatgagttcatgtcctttgcaggcacatggatgaagctggaaaccatcattctcaaccaactatcacaagaatagaaaaccaaacatcccatgttctcattcataagtgggagttgaacaatgagaacacatggacacagggaggggaacatcacatactggggcctgtcagggagttgggggctaggggagggatagcattagcagaaataacctaatataggtgacggattgatgggcacagcaaaccgccatgacacatgtatacccatgtaagaaaactgcacattctgcacatgtaccccagaacttaaagtgtgtatgtatgtgtgtatgtgtatatatatatacacataacatatatatatacacacacacacacccaacatacacacacacacacacacacacacacacacacacacacacacacatatacacataacatattcttggtcataaaataattctgagtacattttggaagatgaaagttatatggtgtatgttctgtaatccacagaattaattagaaatcaataacagtaagacaatagatgtcaattactggaaattaacataattttttataatcattgggtcaaaaaactcacaagagccattagaaaataattttaaatgaacaataatgaaaataatacatatcaaaatttgtggggtgtagctaaatgaatgcttagaaggaaatttgtagccttaaatacctgtatttgaaaagaagaaatttctcacatcgttaacttaagcttgtatcttaagaaaccagaaaaataaaccaaaagaaaacagaaacaacagcaatcagaaattagtgaaatagaaaacagaaaaatagtagagaataattaataaaaccaaaagtactctttgaaaaaaattaatagaattgaaaaacgttttggggtattgttaaaggaaaaagagggaagacacaaattactgacatccaagaaaacattagaaaacccaatatcaatgaatggaagtgaattagtaattaagaacctttcctcaaaggttccaagcccagacagccttattggtgcgttctgtcaaacatttaagttagaaatttgaccaatcctctacaagctgtttgagaaaataatgagaagggagtacttctcaacttattttataaggccactgtcaccctcatttcagaaatcagacagaactattttaagaaaagacaactatagcccaatacacttgtgaacatatgcagaatttcttaacaaagtatcaacaaattaaacaataggtaaaaagcataaaagcttaagttatgtggccaaatggagcttctcccaagaattcaaagttgtgttaacatctggaaactattaagctaatttcaccatattaatatgataaagttaaaaatctgtgtgatcattttatagagatacagaaaaagaatttgacagttttattttctttttcttttcttttcttttttttttttttagacggagtcttgctctgtcaccctcactggagtgccatggtgtgatttcagctcactgcaacctccatttcctgggttcaagtgattctcatgtctcagtctcccgagtagctgggattacaggctcctgccagcacatccagctaatttttgtattttttgtagagacgaggtttcaccatgttggccaggctggtcttgaactcctgacctcaggtaatccgcccacctcagtctcccaaagtgctgggatcacaggcatgagccactgcacctggcctacatttgacaaaaattcaacaaactttcattaaaaatatgcagatggctagaaatagaatagaacttagttgattaagtaaatgttatatagaagatctacaacttacataatattcaagggggatgaaaacaatgttattcctaacttgtgaaacaaagcatgtatgctgctgtttactttcatttaactttgtactgcaggtctgatctagggcaataaagcaagaaaaagatgtaaaaagcatacggattggaaacaagtaaagctgctcttgtttgcataccacatggttgcatgtgtagaaaatgcagaaaaataagagtgactggaactaataaatgaatttaataaagttgcagtatacaaagtcaatatacaaaaatcaattgtatttttaaatactaataagtacaattagaaagtgaaataaaaccctccacaatagcataaaagaacagtcttgtgtcacttaatgacagtgatacgttttgagaaacatgtcattaggaacattgtgtaaacatactacttggacaaacctagatggtatagcccaccccatacctaggctatttggtgtagcctgttgctcacagtttacaaacctgtacagcatgttagtgtactgaatactatagacaattgtaatgcaatggtaagtatttatgtatctaaacatataagcataggaagggtacagtaaaaatacagtgtaataatcttaggggactgccatcgtatatgcagtccatcattgactgaaacattgttatgtggtgcatgattgtatgtaggaataaattcagttaaagatgtgaaagatctttacacagaaaattacaaacattgcattgggaaattaaagacctgtataaatgtagagctataccatgttcatggattggaagatttaaatgattacgatggtagttttcccaaaattcatctatagatttaatgtaattccagtcaaaatccaaatagactttaagaagtagacaagctgattttaaaattcacatggaaaaataatgatccttggtctgataaccaaatgtcaaaaaataaatgcttgatataaatgctcctgagactgattgttcaaactacaagctgtatccttttttttaattttttctaagaaatttactatgatctggaaacaatgaaaggttttggctttgaaaacctttccttggaatgtctgttggacctcatagaaatcttcaggatgtcaatgatggacttaaaatagctaagcaaaacacttctaaaaactgcagcaaacttttagggggtcaacttaatagttaggattggccaagtgcggtggttcatggctgtaatcccagcactttgggaggccatggcggatggatcacttgaggtcaggagttcgagaccagcctggccaacatggtgaaaccccgtctctactaaaaatacaaaaattagtcaggcattgtgtcacacgcctgtaatcccggctactcaggaggctgagacaggagaatcacttgaacccacgaggtggaggttgcagtgagctgagatcatgctattgaactccagcttgggcaacagagtgagaccgtttccaaaaaaaaaaaagtaggatatatatatgtacagacaaataaaatttaacttttcatgtaaatgattttaactcgagttttcaacaatttttttcttctctttttttctttaacatacttccaaaaaatgctactacagactttaggcatgtggtgaatgaaatgctcttaggattattttcactttggggtgatggtgagagtgtatgcttatctgtgttgagtgtgtttgatctctgaatagattttatttgtattgatttcatagtttataaaaggaaaatatttaaatcatttaccatcttctattaatgggaaattttactcatttttatagggaagaatggacagaagctatccaggctgtagcagacagactgcagaggcaagaagaggagagaatgaattgtagtccaacttcacaaattgataatataggagaggaagagatggatgcctctacaacccatcataaaagaaaggtagaaaataataacttattcccagcacagcattcatttgtctggaagaaacatattaaaagctaccatttgcagaaagatgtcagccagttttcttacgatatgtaaatatattggtgggtcttattcacatgaatctgaaatacctgttgttgtttaaaaccaaataggtgaacattgtttcagtgatccagcactttagcactgaatgctgatagggctcatgtgtgactgatgtgccatcacactactttataatttgcattttttccttattatttttaatacaattttagaaactttgtaataaaatgttttccctgatgatttgttcttttccatttcgcatttcgtattctcccgaaaagcacgagcagtaatggctcggatgtacttcctgattggtgccctcagtcatagtaaagtcagcaggaaagtgaacaatcttggaaacaataactcttatttaatggctgcttctgagtcagtagggaaatagacttttccttctctcagtgttccagcataataagtacgaatttatatttttatgagcaatataaattttttcattgcaatagaaaattgaaaagcaatttccttattacaaaaatgatattttcatgattaaagatagaggtgttgagataagcttgccatttatcactttagaatatgtttgatttaataggttgtaaattaatcttcagggaggaaaacacaaattttcaaggtattatccatgaaatttggtattagcacagtgattaagaactctttggagatagactgcctgagttcatatcctcccttttccacgttaaacttgtggacttggtgaagttacacactcacaacataaagttaattatcctttccttatgtgaataagaataatattctatacttgatctgggccaaatgtctgagatccctttctgtcttcattgtagatttctactctgtttgtttgttgaactgaatccctcttttcttttacgtcaatttaatctgccttgttcctccatcattgcaaaaagaaaaacaaagtctagctacacccacctacctactcagagataagaaagcttcttttgtacatgtgtaaattatttcatttaaaatgaaatgaagaatagtgtaaatctgatatggttaagtatttgaaccccaaattcaaaatacctctatggatttttctttttggagactcagttggagtaaaaaattctaagagaagatgttttagagtgatgtttatgtttaattatctttatgtggacaaagaatagtagctaactttaatagctaatatttattgagcacgtattacataaacactttaaacattttttttttcattttgaacttcaactataagttaagtaccattattattcctgttttatagttaagggaaataaaggatggaaggattaagaaattttccccttaattacacacagggtgggagccagtacttaaccccaggcagtaagatctgaactcctccctttctagcactaggttgtgatagtaaagttctactggttttttcaagaatttacaagctttattatcaattgaaattaactaatatccaaatgtcatataaggacaacagtttttcataatattttgagaaacagagtatagtcataagagaatatctgcataattttgtttctaatataacttcattataagcataaaaattatagagattagagaggctcaagatatatgaaccaagaaaaagaaataagctgtatattgacgtgttacagtatacaattaaaagatcttatatgtttgaagttctgttaacttttttgaaataatttaaaatagttctaaattactgcagaagttagtgcagaaaaagaacatttgtaccactactaactccataacggtcctaatgacttagcctcaagtggtaaaatattactgtcattttcataagataaatgattctagaactatacccttatgtatatcaattatcatgcaaagaattgcagaagtttggattatttttaagactataaccacacattgtgaaataagaatattattctaataatttataggatacatttccttctttaatttttgccaaatggcaataggattaaaagaataggtactgattatgatggctatggtgacagttgtcagactgctatttcttgcatgaaatagggttcgttacctcccttagtggtggattatcgccacagtgtctgctctgccagttaaaaactcaattggaaaggaaggatgttgggtgtaaagaggcaagggcctcacagacagatttaagtgctcttctttgtttgaattaaaagaaaatgtggttctatgttttaattaaaagatagcgtttcagaggaatttgcttagagaacccagaagtgcctaatcttggtcagccaagctaccattcttgtatgccttgtcaagtatgtgaaggggcatagcataaaaggataaaaagccaagtgagagtcaaaattctgcttaatttttaacagactagcataagcttctctgggatcaactggctataatctcatgatttacgtttaaagtataagcagtgcctcctgctttcccactaagtttgactccagttcttgggattgtatcacctaattcctggctgtagtaactcataccagtggccagtatccagagaaaaagagaaggaaaaaaagaacaatggccagacctgctgaaatctcatgatctcacactgcatgaatctgcttatttaaaagggagaagcgacgtaaccaatgtagaagttgactaataacattagctccacctcttcccgtgagaaagagcaccaggagaagtgggcagagatggaggcaaaggagtgaacttcgtcagagctcttttcctctttctacttacttggttttgctgttacattgtaaatgtatctggaatttatctttttttgaccaaatatgctaatactgtggtattcttggaagttctttatgttcctcattgattatatgtttatttttaatctaatttgtgggctagacagtgtcttatattctggtgtgcctgatttgaacacatttattaagcatttgttatatatgcccatgtatctctttacctaaaacagccacgtaaacatgtaaagggaagagtgtaactgtaaagtatttccccaataaattcttaagatcaggctttggaggaggattatttttctggagagtattcatactcctatatttttattaaagacttactgtggctgggcgtggtggctcacgcctgtaatcccagcactttgggaggccaaggtgggcggatcacaaggtcaggagatcgagaccatcctggctaacacggtgaaaccccgtctctactaaaaatacaaaaaattaaccaggcgtggtggcgggcgcctgtagtcccagctactcgggaggctgaggcaggagaatgtcgtgatctcaggaggcagagcttgcagtgagccgagatcgtgccactgcactctagcctgggcgacagagcgagactccgtctcaaaacaaacaaacaaacaaaaaaaaggacttactgtatctttttccataacatcatccagaagaccaaaacattttgtaatagtgtacatttcatttgtaaagactacacaattactgtgtataccattctgaccatgagcatttgatagcaaaaatacctttttaatttcctgaagttctgtcaaaatagatgggaaatctgtttctgattttatcacatacagtgctttttaactaatagtaatttccatgtaaattcccttttttttaaagattgagagtcaaactgacaagctgtgaagttcagtgaaggctgtcatactttttttttagcctcattgttcctaagaattgcaattttactatttacttatttatttattttcatttgagacaaggtctcactcctatcacttaggctggagtgcagtggcacaatcgtgactcactgcagccttaacttcacaggctcaggtaattctcccaactcagcctcccaggtagctgggactacagacacctgccactgcacttggctaatttttgtatttttttgtagagacagggttttgccatgttgcccaggctggtctcaaactcatgcactcaagtgatccacctgccttggtctttcaaattgtgggattacaggtgtgagccaccacgcccagccaagaataaggattgcaattcttaaggaatatagtaatattttataattaaatattgttttcaactgaaaatgtcataaagcattttacagattgttttctaatttttaccccccaataattcaatttcattttctatgatatttaataataaggcacagcaagtattattttctagtgcttttaaataaaaaaatgaggaacatactgtccaaatgaaactttgagcaataaattgacactctggcctggttatgaaaataatgtttctgagttacttgccatgtgtattagggttctctagagggacagaattaataatatatatatatatatgtgtgtatatatgtatgtgtgtgtgtgtgcgtgtgtgtgtgtgtgtatatatatatatatacacacacacatatatatggagtttattaaggagtattaaacacacgatcacaaggttccacaataggccatctgcaaactgaggagcaaggaagccagtttgagtcccagtgctgaagaacttggagttgatgttcgagggcaggaagcctccagcacagcagaaagacgtaggctgggaggctaagccagtctagccttttcatgtttttctgcctgctttatattctagccacactggcagctgattagatggtgcccacccggcttaagggtgggtatgcctttcccagcccactgactcaaatattaatctcctttggcaacaccctcacagatacacccaggatcaatattttgcatctttcaatacaatcaaattgacactcagtattaaccctcacgctgtggaacaaactacctcaaatttaatgtcttaaaacaatagccatgtaaatatctcatgattttgtagtttgggccactctgttggtcttgcatgcatggctctcaatcagctgcctacagcttatacatgggtgggctggaaaatccaacaaaaccttccttatgtgtctggggccttggtgctgactgttggctatggtgtcttggttctcctccacttggtctctctctcggagtggtaatttatcttccagggtctctccacatggcctctctctccagcaggataatatggactaactgacagcattagagctggctttctagagctttccaagagagagaacgcataaactgccaggcttaaaggctttgtctgttactggcatagtatcagtttgatcatattctgtgttcaaagcaagatacagggttagcccggggagagagaaagttgactccaccccttcatgggaagagtggaatgtgcatacagggagaaatgggaatttgtggcagccatctttgcagactacctagcacaaatagcttgttatgtagtattccctgattttttctgctctattaatgcaattaaatctaatattacctgttatttgttcaaatgacactagctgatttactatatttgatatttagagctacatgtttgatttttagttgaattaatatatcttattattttccctgctatctctttgctactttatctttgaactagagatattattgaatgtaagacactttaatttgacatttggggaaaattataaaaaatatgagcagcaaaaaatgttgaaagtgaacgtaggcatttctaaaattttaagaatttttatgtaatatacatgagagatattgggatgtagttttcttgcattgttttcctctcattttggtattgtcaaaaaattggggttcagcctgggagaccacatgggttcttggcttcacacaagaaggaattcaagagcaaacaacagaataaagtgaaagcaagtttattaagaaagtaaaagaatgaaagggtggctactccataggcagagcagccctgatggctactggttggctatttttgtggttattttttaatcatatgctaaacaaggggtggattactcctgagttttctggtgaaggggcagggaattcccagaactgacagtttcccccgttttcagaccatacagggtaacttcccgatatgtcatggcatttgtaaactgtcatggcactgatgggaggttcctttggcatgataatatattataatgaatgtataatgagcagtggggacaaccggaggtcactttcatcaccatcttggttttggtgggttttgactggcttctttactgtatcctgttttaccagcagggtctttgtgacctgcatcttgtgaaaggagacctgccaaactcctatctcagtatcaggatgatgcttgtctcagaatgaatgagaagtattcctcattttaattttcagaaagaatttgtataaaattggtgtcatttcttgtttaaatgtctgtagaattcaccagtgaaaccatctgggcctggagttttctttgatgaaaggtatttaaccacagactcaatttttcttaataaatatggggttatcaagttatctgtttctttcaaagaaagagctttcaaagcttgagactttcaagcaatttgttcatttcatcaaaggtgtcaattttattgtcaaaatgccatttataatagtctcttacgtttcttttaatatctgtagaatctgtagtgatgccacctctgtcattcctgatattggtaatttgtgtcttctctatttttctgaccaacctggccagaggcttatcaatttttattgatcttttagaactagcttttggtttcactgattttttctctactctttttctttcttttaaaaatttaattgatttctgctctgatctgtatcattttcttctaactcttttgggttaacttgctttttttttaagtttgttaaggtggaaactgaaacaattgatttgaaatatttctcacgtttactttagataaatgataaacagaaaaaaaaagttataaaaggcactaaaattttcagtgacttgtaatttcaagataaaacccaaatacttatttgatatttataaacctctaaactgagtttaaatttatgtaaactgatcatatacaattaccttctcttctcttcaaaaacctattaatatgaaagtaaaggaatttcaaaaggaggcaagtccacaaaaatgaaaagctgggtcggggaggggcattagggcacaaatgccttcaaaagtttggaagtttctggaagaatgttgatagagcagagcaggaaaagagtacatagaggggactgtagagaacaagtggcacgtgtgactggcaaaatcctcaggattacctgacttaagaaagagaagtgaaactgaaaacaggcacattaattaaagatattcttcttagagctcccttccttgctgttctgaattgcataaagtactctctcaggaataacaactgctttctttgatttattttaactgaagtatacgaggttctcgacatttcttataaatatatcctatatctctctctttcttggattttatctttattttgctagagtaaattctcagatagctccttccaaagcactgcttttttaggcatatttggaaatgtttgtgtggaacatttttgattatcacattttctgggggtagcagcactactaaatccttgaaaacttgagtccttaaaaatgagtgaaaataatttttttcctcctttgcccttttacacaactgataatttcgctgaggaattctaggttcaaaatcattttctccaacatctgagaactgcttaaattattttcagcatccatggttgctaatgagacagccaatgccagtctgattctttttcatttaaatgtgcttataaattggtaaaatttggttttgagtggatattgcaaacacatatatatatgctaacaaataaattgcatcaaatacttcatattatattttttaatttgtatttttcagacaatgaatgattttgactatttgaaactactaggtaaaggcacttttgggaaagttattttggttcgagagaaggcaagtggaaaatactatgctatgaagattctgaagaaagaagtcattattgcaaaggtaactgatttattaaagttgattactaaatttttgtttgcagtgtgcatgtgtttgtgggctcatgaatttacatgctaatgtatgcaaattccattaaacaaccaaaatatggttgtagactactgctacagtaatttttgtgtattaatatttgtaatttttaaagttttcagacattcataatatttgtatattatatactaaagctattctcttaaggaaatagaaatgtttatgtttgcatgtttgggagaatgttttgtgatctatatcataattatactaggattgctttttaataatttctcctatcgttctgaatttcttattaagattgactagtgtagatgatttttactcataaattctaaagcttatataacattgaatggaaaaacatcctaaatagatttgaaaatactagaatggtgaaattaaaataaattattttaggaagacttacttcccacccccatacctttattcagcttagacctttttaaataaataacatgttaatgatgtcagttctcactcagagttctgaacaaaatcccaattccctcaggagatacactttacaaattggtccatgctttaagtcttacttaattcaacaaatgacataaattactgttatactttatggactacttcaacttccagttatttgctactatagtttcctcatctggagtgtattgccccttacactttgtgaaactttgtttccctgtctttgtacatttgttttgacctcaactcctttacaagtcaatgcccctattggaaagaacattggctttggaatcatacacacctaggttcactactcacctaatagtctttaacaaccagtactttttaaagcagtactttggggaagtactggtctcttaggggcatttggaaatgtttatggggggcacatatttgcttatcacagtaactgaggaggaggggtacttctgacagttaccaggtagaagccgaatgtgctcaatatcttgcagtgtgttgggcaaccaatcagagccttagtttttttcatttaaattggtataataaaacctctggacaggaatattttgaggattgggatatgtaaggtatttagcatcctagctggcacttattattaattaagctgatattttctgggaggtagtataatgtcaggtaggttttgctgcttagtaagtgatccaactttttatgcctttattttcttatctacagagtggggctaatagtagtacctgcctcatatggttattttcagggttaaatgaatagataaatataatagtacatgccatcagtattaaataaacttaacaaattaaattacaaatcaaatgaaattaaaatatgctattgttataaatatttgctataattattattactattattactacctactgtgtattattactacctactgtgtatcaagcatcagtaaatatctattccattctgttttttcttttatatattagcctcacttgtatcccattatttaatttctgttcatcagactggggaatatcctattagacactgtcttatctcactacttacacttttctgagtaactgtacagaactacgtatatttcacaaatgatagactattctgattgaagtagtgccttgctgctttctcccaacaaatctatttatcgtttcttgaaagaaaatatgctcatttatagcaagatgattaacactatgaagatttggagtgtgacaagacctggggtttggttcctgctgtgcccttctcagagcaacatatcagggaagaaatgattttgatatctttttactggtgatgttaattttgattgcttgactacagtggtgtctactgtgtttcttcactttaaagttgctattttttccattcataagtaatcagtatcttagaggaaatactctgggactatataaataacctattttttcttaaacttttaggtactaattttaacacccatatcagtggattttgcccataataattattactgttgtgttctaatggtgattttctatttccctcattccttatacatttattcttagttaagctaagggtttatcaattttgttaatcttttcaaagaaccaacttttggctttgttgacttttctttgttttatctgtctttgctttaatctttatttttttttcctactgcttgctttgggttaatttatttttttcctagttccttaagttataaagttagattgttgatttgcaatctctcttatttagtataagcatttatggctttaaatttctcccttagcactgtttttgtggcatcccataaattttagtctgtcgtatttttgttttcattcatctcaaagtatttctaatttcctttgtcattgattgtgtctgttgtttaatttctacaaatttgggaattttcttgttttctttatattctaacttcatgttgtagttggagaagatactttgtatttgtcttttaaagtttattgagactttatttgtaatccaacatatgatctatcctggagaacgtcccctatgcacttgaaaagactgtagattctgttgttaggtagagtattttgtgtatatttaatagagcattttgtgtatatgtcttagatttagttgctttattgagttgtcgaagtcttccgttgccttacttctttctttctggttgttgtattcatcattgagagtgtagggtattgaaatctccaactattattgtaaaatggtcattgctttctgcagttctttcaatttttgcctcatatattttgatggtcttgttattaggtatgtaagtgtttattattgttatatcttgctgtattaacttttattaataatatctttttttggtgttttctggccttttcatttaaagtctattttgtctgatattaatatagccaccccttttctcttttggttactatggcagtaccccctttagctgcagttttgcttttcatggtttgagttacccccaatcaaccacagcctaaatatagatgagtatagtaaaataagatattttgagagagagaccatatgcatcacaataacttgtatcacaatatattgttataagttttctattttattattgttgttaatttacttttaatagtagctgttaatctacttttaatatccatttataaaggatgtgcctaatttacaaattaaactttatcttaggtagtatgtgtaggaaaaaaacacagtatatgcagttggctctctgtattccatatccatggattcaaccaatgtggatttaaaatactcaaaaataataatacaagaataaaaatattaaaaattaaaaaaccaatgtattgtaacagctatttacataacatttacattatatctgatatgataactaatctagagatgatttaaagtatatgggaagatgtgcatagattatatgcaaatactatgctatttgatactagggaagtgagcatttgtggattttgttatctgcagggggattttgaaaccaatcccccatggatatcaaggaatgactttatagagtttggtactatccatggttttaggcaaataccagggtctcaaaacatatcctccactaataaggggaactgctatattttcatgtaataattttttctctttcacttttacccagtttgtggcttttggagacagcatggaattggatcattcttattgtttgtttaatcgactttcccaatctctttcttttgattggagagtttagtccatttatgtttaaagtgagtcgtgataaggactgacttcggtccttttgctatttattttctatatgcctcattgctttttgtccctccttttctacataaatgccttcttttgtgtttaattgattttttagtgaaacattttaattctcttgtcatttcctgttgtgtatattctatagctattttctttgtataggttatatttaatatcctgaagttatagtactgtaatttaaatttataccaccttaactttaataaccctcaaaaactccacttctttacaattctgtccttactcctttcaattgttggtgtctttaaattgcatctttatgcattgtgtgtccaaaaacaagactactaattttttaatgtatgagtctctttaatcatgtagaaagcaaaaagtggtattacaacacaaacttacagtaatactagcttttatatttttttgtgtatttagctttaccagatctttaattcttcatctgactttaagtgactgtctaatgtccttatatttaaacctgaagggtttaatataactcactatagcttttcttgtatgacaggtccagtgctaatgaactccctcagtttctgtttacctagaaatgtcttgatacctccctcattttttgaaagatagttttgctggattcttgctttagtttttttccttcagcactttgaatgtatcaaccaattgccttctggccttcaatgtttctgatgagaaatcttcgataatcttattagggtgcccttgtatttgatgataagcaagcaaaacagactcattgctaatatggaaaaagttcgagtggtcttgatagaagttcaaaccagctgcaacattcccttaagccaaagcctaatccagagcaaggccttaattctcccaattctgtgaagggtgagagaagtaaggaagctgcagaagaacagttggaagctaggaaaggttggcgtgtgaggtttaaggaaagacaccatctctatagcctaaaagtgcaatgtgaaaccacaagtgctgacacagaagctgcagcaagttatccagatatctagctaaataattggtgaagatgactacacgaaaccacagattttccatgtagttgaacttaggacttccttagaaaggagaagtcattgcctggctctaaagcttccaagggcagattgactctctcagtagtggctatgcagttggtgactttaagttgaagccattgctcctttaccatttcaaaaatcctagggcccttaagaattatggtaactctacactgcctgttctcttatcagtaaagcaacaaagcttggatgacaagcacatctgcttacagtatgttttactgaatattttaggcccgctgtggagacctcctcagaaaaaaagattactttttaaatattactgctcattgacaatgcaccagatatacaaaagctctgatggagatatacaaggagatgaatgttgttttcatgcctgctaacccagcgtcagttctgcagctcattatcaacgtccattctgcagcccattatttcaactttcaagtcttattatttaagaaatacattttgtaatagacagtaattactgccatagatagtaattcctctgctgatagatccaaggaaacttaattgaaaaccttttgggaaagattcaccattctagatgccttgaaaaacattcagtcttcatgaatgttcatggaaggaggtcagaatatcaacattaataggagtgtgtaagaagttgattccaatcttcatggatgagtttgaggggttcaagactccagtggaggaaataactgcagaggtggtagaaatagcaagagaactagaattagcagtggagcctgaagataggactaaattttatcaggcccatgatgaaacatgaacaaatgaggatttgcttcttatggatgagcaaagaaactggtttcttgagataggatctactctttgagaagatgccatgaacattgctgaaataacagcaaaggatttagaaaattacataaacttagttgataaagcagtggcaggttgtgaaaggattgactccgattgtgaagaaagttgtgctgtggataagcagcatggcatgcgaaagagaaagcctttcttggaagagaaagtcaatatgggaaacttcattgttttctcattttaagaaattgccacgctgggcatggtggctcatgtctgtaatcccagcactttgggaggccaaagcaggcagatcgcttgaggtcaggggttcaagaccagcctggccaatatggtgaaaccttgtctctactaaaaatacaaaaattagttgggtgtgatggcaggtgcctgtaatcccagctacttgggaggctgaggcatgagaattgcttgaataccaagatcgtgccactgcactccagcctgggtgccagagcaagacttcgtctcaaaaaaaagaaagaaattgccacacccactctcacctttggcaactgccaccctgatcactcagcagccatcaacgtcaagagaagaccttctgccagcaaaaagataacaacttgctgagggctcagatgacccttagccttttttggcagtcaagtatttttaaattaaggtatatacatttctttagacatagtgctgttacacacttaatagactacagtatagtgcagtgtaaacataacttatatgcactgggacaccacaaagttagtgtgactcgttttattgcaatacttttgttgtggtggtctggaacaaaacctgacgtatgcctgtatggaaaaaaaaaaaagaggctatttggttgagacatgaaacattggttcttgagaagcccaggtctattgatgtagagtaacctttccttcattacaggtctgaccatactatttgattgtcccatgaataatattcatttacttacaccattggaaacaccaaattggcgttcagtttttaggatttatcaatagacaaagcaccgaagacttaagtatagttacagaacagactgaaaatgttataaaccctgtcagtgtaaaagaaatggtatagttgatggatgtcagctgaaagcatgttataattttttttttaaaaaaaagcaagaatgaattggaggccagagacagggtgatggagccaccagggttgcaaaggcagaggttgatggagccaccatgggcctagaggacagaaatacaaattactgaggattagttacagaccttgaaatcgaatttcccttgctgggtttagaacttgcttggaatcagtgatgtttttatttcttccaatttctccctttctgagtgggaatatctgtcctaggccttttctaccattgtattttggaagcagataacttgttttctagtgtgagaggtccacagatttagaggaattttgccccagggtggattatgcatagagtctcacccattcctgatttgggttataacacttgggacttttgagctgatgatatttaaatgagattttggactttgacttgatactgcactggttgagacttctggggatattggctgtaaagtatggcgtatgggctataaagtacattctttggtctgaagacatgtaacttggtgggggtgcagtaccttctgttccagtcatcttacggtattttgagcttttgtatctaccattgggtatgcaaagcccaatccactgtaaacgtctatttccaagaattaccatttatagcttcctggggatagtggcagtagctcagtgtagtgtatttgccaactatatatgggagtggggggacttttttctggggaatatatgccatagtcatctgcagtctctttctccctttctggcagacaggatggctctttctggaattttgtgcatcagagggtacaagaggaatatatcaatggccagcccatctctgtctgcattgctgcatatctcccatatcttttttatttttatttttggagacaaagtctcactcagtcgcccaggctggagtgcagtggcgcgatctcggctcactgcaagccccgcctcctgggttcacgccattctcctgcctcagcctcctgagtagctgggactacaggtgcccaccaccacgcctggctaattttttgtacttttagtagagacggggtttcaccatgttagccaggatggtctcggtctcctgacctcatgatccacccgccttggcctcccaaagtgctgggattacaggcatgagccactgtgcccggccaatatctcccatatctacttattttggggacccagatagccacctcaaacaagcatgctgggacatccacttgctggttccagtcatctcctgatcctgaaagaagttcttttgatgaccatcaacatgtcctactttaattcaccccttaaattcccataatgattctcatagagccatgcctcattaatcacccatccatttattatttattttgtttacttatttatttttgagatggagttttgctcttgttgcccaggctggaatgcaatggtgcaaactcagctcactgcaacctctgcctcccaggtgcaagagattctcctgcctcagcctcccaagtagctgagattacaggcattcaccaccacacctggctaactttttgtatttagtagaggcggggtttcaccatgttggtcaggctggtctcaaactcctgacctcaggtgatccacctgcctcggcctcccaaagtgctgggattacaggcgtgagccaccatgcctggcacatccatttaatagtctagtttttcactgcctgtcagcctgaccatatggccaggcaaatggccacagcccattcatgggtgtacatccacacatgaaggttatgtttgtttagttcatccatcattgcaaggagaacaatgtacaattgagccctttgagctgatttgttgttctttcatcagtttcacatcagtcagttatagtgtgacagccttccaaacaggatgctggctgattacctttgaactgctatcatctgtaaaacaagccactttttggtggtcagtgagagctctttgtaagacactagcatttgaacagtaggatgtggcaataggatctggtagctttacagatggttccaaagttgatctggaagaaaagaggaggccaagcgtgatgactcatggctgcagtctcaacactttgggaggccaaggcaggagaatcgcatgagtccaggagttcagactcagactcagcctgggcaacatagtgagactcccatctctacaaaaaataaaaattagccaggtgtggtggcatgcctctggtgataccagctactcatttggctgagatgcgggattgcttgagcctgggaggtcaaggctgcagtgagttgtgattgcccccactgtattcagcctggttgacacaaagtgagaccctgtctcaaaaaaaaaaaggttttcttctattgaatatggtaagtgtcttcttgcattcctcagcacattcccgttaagccattttcattttgttattggtactcgttagagtgtttctctgacattacccaagacatggatattttaggttttaggattatgttatgtccttcagtcataaagacagttgcagttaatgcccgggagcaaaccaataatcgtctctctaatgatgtgttctatactttcttgtctggcccatggtcccagtggttactgctggacagcattcatgggctttttgccataagctccagtctgagttgcagatacttctaaaatcatatctgagtgtatatcgtaaggacccaaaggcattaattgagccactgcaacttagataatagcctgctgttgtttaggtttccattcatatgtgtcctttcaggtagttttacggattggatttagcactagtccccagatacagaatttttcttcgcaaaactcaagcaaaccagctgcagtgaatgctgcttgtttactttcatggttatgtaataagagcaatttaattttagttgcctgtagaatgttatgggtggttcctgcccaggttattcgtaagaatttcacagtttggttagaccctggggtatttgctggatttatcctccagcctgtggtattcctgtgagccaccactattttcaagttagccctagcttgttcttaggtttctgataccgtcataatgtcatcagtgtagtatattattgtattctggacctgtatcaagtcagaatcccttcgaaacaaattataatggtaagctgataaatgcagataaacctgcagcactgcagtaagtataaattgggatcattcccactagaaggcaaagtgcagttgtttttttcctgagattgggaccaagaaaaaagtattttcaagatcaatcagtatgtctctctctctttttttttttttaattgaaacagggtctcactatgttgtccaggctagtcttacactcctggactcaagtgatcctcctgccttggcctcccaaagtgctgggattacaggtgtgagccactatgtctggctgagtatgtctcttttagattgttttattttgagaacttctgaaaccatgtcagagactgctgatgctgtagatgatactatattattcaagtcttgattatctgctgtgagttttcatgaataattcacctttttcatgcacgacacagaacttgttggtaacagcactccagtgtcgaacatgtcattaattcatgtgctaaatctcttttggtccaccatgatactgtttcaaattaacaacctatgtgagctggggaagttgcacagattctcatttagcctgttctgactgaagggaaaactaacaagctttctgcagtatagtagctgaagttttccctggtcaaacatcatatccttccccaaaacatattcaggtaatgtggatgcaagtacttccaagattcattcaaacatactaattttcatccaaattttaatttaatcctatcagccatttcatcctcatatcctgtctttctagttattgcctctgctaggattttaccaataggttttggaatcagaggcactgaattctatgtcaggaacccctggaaggtttcttttttaccttctattgtacctacaggtgtgcatatggccttcagtccctactaggagattagttaaaagaaagccctggttctgtgtcagtcctcatcctgattaatttggtagcccatcacctctgatgatttgaactgaggttcttcattgtcatttttgcttcccagcttggtgcattctttgaaattagggtgcatagagtgtttgtttagggcccttcagtgttgggggactaagaggcgctcccattggtaaacctaacttctgatagtgcagcattaagacctttgtgttaacatcagtgtccattttattcatcccatctcttagtaaccgtttaaaacttcatcctgcttgggacttcgttgactatctgttttgtgttacccattcacttgtgattcagtcttattttcttagcatctgtaagacccatattaagaagctgagacaacaaatctgacacatttcttggaccattgatagattttgcagcagttatatcagatgcctgcctagcggggccccttcagtcacagtatttaccatgatttaaagggcatattaaggatgaacaaacatcctgatgaccatgaagttaatccagcatggtttgcatatgcagcttaccagctatgtcatctatggaggagtgccacttggcatttaaaggaggggaaggaccatttcccttttcagggtaaacaaattttacagtggcttttacccagtccaccagactagctgtccctttaggaacaatctattgtgtgtttggatcatgtacaacaatccatgattgttcagtaataaggttcctgcatcaaccccaagcagacttcttcattctgcaacattcagaatcaaagatactgctcccaagttagtcactctcacaatctattttcttaaatgtttttcaggaacccgatgaataccagttcacaaggcaagataactccttcacacataacccctgcttccagtactgtcttggttttgtcacccaccatttggacaatgttcctggtggtcaaaggccatagatatactgtctgtttttttcagcataattttccattgggtttatcctggaggctaacagccatagctcaagctaaccaaaatccaagctttttgagcatcaggatttccttaacactctctcttactttcattttagctgttttaaaatacagcagactgggccaggcgcagtggctcacattggtaatcccagtacgttgggaggccaagtcgggcagatcacttgaggccaggagtttgagaccagcctgaccaacatggtgaaaccctgtctccactaaaaatacagaaaattagcttggcttggtggcatgcgtctgtaatcccagctacttgaggggctgaggcaggagaatcactggaacccaggaggcagaggttgcagtgatctgagatcatgccactgtactccagcctgggagacacagcgagactccctctcaaaaaaaaaaaaaaaaaaaaaaaaacacaaactgcagtggcaataagaccagcagctcctcacttctgtctctaaagtggggaaagggcaagggtggaggaggctttctgtaatacctggaagctgaccgacagaactttgatgagtacatgaaggctctagggatgggctttgtcactaggcaggtgggaaatgtggacaaaccaagagtgattatcagtcaagaagaagacaaaaggtggtgatcaggattcaaagtatgttcaagaacacagaggttagtttccatctgggagaagagtttgatgaaaccactacagatgacagaaactgcaagtttgttgttagtctggacagagacaaactcattcacatacagaaatgggatgacaaagaaacatattttataagagaaattaagtatggtgaaatggttatgacttacttttggtgatgatgtggttgccgttcaccactataagaaggcataaaaatgttcatgatttggagctggaagagctctttagttttcctctttactcaagtctcagtgctatcctgctgttacagtatggttgattaaatggttattcttggtgtggaggtggaaaatggtgatttaagagtttgttattccaagcagttagcctaattttaacctggaagtttatcatgttttataattaaatttttgtcttaaaaaaagtggatacattttataatttcctttgaaatgcaaatcaaattggaataaaaatcttacatgtggggaaaaaagtacacgttaccagtggattgtgtatttagcttgtttctcatcattttgcatttctttatgtatccagtgatctaagtccttgagattttggtctgtcatttctaaattccattgacaacttctatatgtagtaacagcacagtacagctgccgtctcatgccattggtgactgtatacccatttaggcatcagagtttgtcattgtctgccctgtcattcttccttttttgaaacaatgtttttgccatgctttaatgagtcctacttatgatggcaactgtgtcagctgtccctaagaccactctcaggctcagtgagtcatgactcacaagactcagaaaagactcatggttattgtttatgatagtgaaaagtacagattaaaatcagcaaagggaaaaccacatagagcaaaatcctggagaaaccaagtgcaagctttaaggtatcttcttccagtggagtcacatggatgatgtggtgaaatcaaggatctccagagagacagacacaatcggatacatatacatatatgagagagaattcactgggaaattggctcatgtgattatggaggttgaaaattcccaagacaggccatctggaagctggagaccttgggatgctggtaacgtatctccgtccaagttccctgggaagctgatggtgtaattcttagtctgaggctaagggccaggaacctgggttttggtgggaaactagggagttgctggtataaagcctggagtccaaatgtcagagagcctagagttctgatgtccaaggacaggagaagaggagtgtccccattccaggagagtgccttttctttgcttttttgggtcctatttgggctcttagttgattggatggtgtctgctcacattgtgggtgaatatttctcactcagtccatcaattcacattccagtctcctctggaaacacagaaacagctattagtaatgctttaccagttctctaggtattccttaatccagtcaagttgacacataagtgcatctgtgatggttaattttaattctcccagtagtgaagtgttgtcaactaaagaagcttacctgagccttggtgtccagggtttttattggaagtcagtcacataggcaagcagtaccttcatgactgccctgagatgctcagattccaacctctcagagcaaaatcaggcacgaagtattaatcatgcatcctgttgtttgcataaactatctagtcaaactggtaccatgtggcccaagatctccagcatacaaaaatactctgaccaggcagaatatttcagaggctcagaattcatttcccaggagttggccaacggcgccagttctgaagactgacttttttgggaatgtgtagagtttgggcaacccaggcctgatgtgttaccctttttctgcacgtaagtccattaaaataacccaatgcgtttgcttgattactggcatctctttttccttggactcttaagttcttactggtggatcttaactgaaatctcttaacgtgatcagccagttactttgttctcttctttcatattcttttgaacctctgtattaaacattgcatcaacgattgtggtttattgtaggaagcagataatggtttgatctgctataccttcatcaactgtcattgttctattgggagtatgatttcagtgatttatgttctagagttatttcatgtagttcgtgtagcttctattcttcagcagcatgcaccaaggttattcgttatttactagttcattcactcattatttcaataaatatatgtcgaacacctaattatttgctaggtactgctctaggcactgggaccatttgaacgaataaaactgacaaactcctctcctttgggaaattttattcaagtcagcaattagagaataaataatacacataataaataaaccatagagtatgtaataaactaatccatacttacagagaaaagtggagtagggaaataaggaataatgatggtagcgattttggggacttaatgcagttttaaatagcatgactatggaaggcctcactgaaaggtgaaatttcagcaagcatttgaaggagatcaggaagcaagtcctttagatattttgaaggaagaatgttccagcaaggggaaatagcaattgagaaggccctgaggagggagcttacttagcacattctaacacattctttgaatagctaggagtctagcatggtgtggaacaagaatggtgtaggatgtttgtaaggatattggcttttactgtgaatgaagtgggaagcctttggaaatttttatgccgtgtagttacacagtctagttttcagtatcactttggctgcagtgttgacaatagactgtggattggaagcagatagtttgctaattgcagcagtaatctagataattgatgatagtggcttgtactagggtagtagcaatggaggtagtgatgataatgagaccttgggtgtattttgatgaagaaccaacaggattgcttgacagattgaatgtagagtatgagtgggaaaaaaaaggagttggagatcattgttaagatgtttggtctaagcaactgaaagcatggtattgccattcactacattgaagttgactgcaggagaaacttttcaaggggagatttggaattaggttttagatatgtcaaatttgctatttttgttagatactccagtttatgtcactgattatacatccatgccaaataggcattttttaagtttaggaaagaagtctagatttgaggtataaatttggaagtctgtcagcatatatcctgtattagagccatagtctgaatgagtttaccaaaggaagagtgtacccagtgaagagaattctgaggactgagtcctggagatgcttacagaataagggtttcagagcaaaggaagcagcaaatgagactgcggaaagacaaccactgaagaggaggaagatgaagagattaggatgtcctgggacccaaaagaagaacacgttttcaggaggaaggagtgatcaaatgtgttaaatgttacgtttatggcttctcttctgagtaggaagtaagatcgcattttgaaagtgtgaacgagtgaggctgagataaagagagacaaataaatgaaaagctcctgtgcttggaagtcagcacagacctgggttctagtcttagcttagtagcttgactaggtaagggttagtgtgtacatttaagtatacctaccaggcaaggaagaaggcctgggaaagatttgaaacaaccatcctgagaaattgaagagtgacctaagtagcgatggatgaaagaggcctcagaagattcagctgagtttttagggagattccaatggtgttagtcaatatgtttgtgtaaatttatctttagatgtgaaatatagagttaagagggtagagatgaacttgtcccaataccgcgtatgagagaggcagaagaaagactggagtccaaagtgattatatcatgatggaagtcaaaggagttcatttggccttcatctaaggaatatttggaactggagcatcaagaacaaagtatcaaacacaatactcgagaaaggcgcaataatgtttgtagttaacagagaacaacggtgctttcatctccatcaaggtgagaaatcttcaaaaaaaggaatagaaatcaaggaacagaagacagtctgacagctggagaatggaagaagtattagaagtcattatctgggccagtgctcaagttttcaagaaacaaaagttagaacccaaaatttagagcttgataagtgtgacatgtctcctctggcaggaaaaaaaaaagtatacattgctaacatatggcttgttgagacagtggaaaagtaaataataatcactggtaatcattgtttaatttgtaaaagtgtgtcatatcactactcatcagggaaatgcaaatcaaaaccacaatgtgatatcatctgtattagttcattctcacactggtataaagaactgcccaagattgggtaatttataaagaaaagaggtttaattgactcacagttctgcatggctggggaggcttcaggaaacttacagtcatgatggaagggggaagaggcatgtcttgtgtggtatcaggcgaagaaagggcgagtgtgtgaagaggaactgtcagacacttataaaaccatcagagctcctaagaattcactcactatcacaagaacagcgtgggggacactgccccctgatcccagtcacctcccagcaggtctctccctcgacatgtagggattatggggattacaattcaagatgagacttgggtggatacctaaccatatcatcatctcaccccagttacaatgacttttatcaaaaaaacaaaaaaatcacagatgctaaagggaactctcctatgctgttggtgggaatgtaaatcagtataaccactatagaaaaccatatgaaagttcctcaaaaactaaaaatagaactaccatatatatatccaaaacaaaggaaatcatcatatcggggagacatctacacccttaggtttattgcagcactattcacaacagccaaaatatgtaatcaacctaagtgcccatcaatgaatgaaaggataaatgcgatatatgtacagagtggaatattacttagccataaaaagaatgaaatcacgttatctgcagcaacattgatggaaatggaacccattatgttaagtgaaataagccaggcacagaaagacaaatattgcacatttttgttcttatgtgggagctaaaaaacgggattgcatcaagatagacagtagattggttgttcctagaggctgggaatggtagggggatggggagatggagttgattaataggtacagaagtacagttgtaataagacctagtgttagatagttcagtagggcgactatagttaacaaccacctactgtgtattttaaaatagctggaagagaagaatttgaatgtctccagcataaagaaaagttaaaggttggaggtgatgaatatccccattaccctaatttggtcattacacatatggaatgtgtcaaaacaacacatgtaccccgaaaatgtatacaactattatgtatcgaaaaaacatgtgccaaagtaacatttctctaccctcttcccgtttctcccacctgattcgtgtcttcctctaggtctcatttatagctctgggtggatggaggaaatggtttagacggaatgtgtcttgatttcaactagacttgtggtcaatttggagaaaataatgtgagcagagtacctagtgaagtagatagtaggttgtttgaagatgggaggcagttttgtgaagtagaaatgacctttactattgaacttagatgtgggatcagttggtgcagggattaaaggagatgacactcatggtgttcttgatcattaagggtagaaattttctttttctcctcttgtttgccctctcctacacctcattccctcaaataacctaattaccacaaaacatcgagagggtcaaatgaaaggagaactttagatcgtgtgtaatagagggtgaatgataaattggagaggattgggaaaataaaatattaaaaagactattcttctgcctgaagaaataaaatcccattccccctaattcttctatgaaagaaattagatttaaaagttcattatttactattttaccatggataaatatatgtaaatttgtatttcaaaagcttttccatgaaaaaaatacattgtatccccaagcatttctagaactcttcataattatgatcaacagatggattttttaaaaggcatcacattgttttagtcactgttttactactgttatttttaactttttgttttgacatgttgcttttaactgtaattaaaaattattagcatctgtgtttactttttagcttgcgcataccttatcttcatagcagaaactaattagtatgtgaaatacagtaccattaaatatgcattaatgggaagaaattctaatctgatcagctgtaaaatatgttagaaaatacattttggtatgtacatggtgttcattccagttccattctcataacaaatactgtttttgcttttgcctccatacgtctttacttggttccttggatgtggtcagattacaaatttagggggtagaaaagtcttccctcatgaaagttactaagtgatttagaaaaataactattatgcgtgataagcctgttttaacaaaatagaatgtaataccccactgaaaatattcaaagcactagaatatcttttctatttctaaataaatttcatacatacttttctctagtcttttcctaatttcttgacccagatcacttaacatcttaaaccacaacaggtagatgttatcttctgtgaatttctttctgaactgcctattaaaatgtctgtgattcactctcatgttggaggcatgtaacttttatattagcactgttaactttatatctcagaactatcccctttttctttttccgctgccaccatagtagtccaagccatcctcacttctctcttggggttatgtaatgctttcctaattgatccttcttagaagaacgtgagtagactttcacaaacatgtcacccccaccccatcactttctctatgtcccacaccatcacaatacccaacttacactctaccaatagcattggttctcccttacagccccgttgacaatagtggataacctccactttttccttaatatcacttatcagaaagagtaattatttaagttggataatttacttgtttgtgttttccactagcctatgaactctgtgagcaatgggatcttattttttttattaagttaccttataccagcactgttcttaccaattagtgagtgcacatcagcagttttttttttaagtgaatggacttggttcagtatatcacaaaatagccacttgtataatgcttaattatgtatttcatattccctctgtgatgctcattaactgtagtatccccttctctggtttttcccattaacactgatcaccatgtaagtagaactaaagctccatgagagcagagaattttgtctatttgttcagtgtcctgtctctgatgtgcagacgaatacccagaagatacttgttgcatatgtgttgaagaagtcggtgggtgggtgggtgggtggatggatgaatgaactcttgcacacttgacatcttggaattctttcctatgatacacaattcagttcaatagacatttattaggtatctgctgtatgcttaccattatgttaggcacagtgtatatggaaatcagtaagttctggtgtcatttctgcttctgatttattttgttttacaatgtttgctattctaattaacttaggaactatagtacgatatgacattggctttcaaattgagcacttaaaactgactcctataaaacaaataagactgagatgatttcatgtttatgctttccttcactcgttgttaattatactttctgttcagacacaattgatcttaccttctttgaatggttgtgggatcttagcttctttgattaatctagttatcattatctttcgagtttaaggtcaaatatttttataaagataacaaatataatgcagtgtcctgatgttttgcttttcatgtctttcttccatctaattttgattttctgacagtgttaagaaattgattcagcaagggctttatttaagatcttgccagaagtgaagaacagagatgctgtgttcgtttcagcagttgtcttcctttcgtttcttctttaagatagtgttacttttgaaatatgaaacattatctccagttctccatatgttgaagaaaacactagtttgcttttgatatcaatatgagatttatgcccaaagttggggaaaacattcttagtttatttttggtttgaaatatacttacattttaaaatgatcacctacagtaggagggttgtgagctttttttttttttttttttttttttaagaaaagcacattaaacctgtagtctctggagctaagctatgaggacaaaaaagcaaaagaaggatacagtggactttggggagttgggggaaaggatggaagcagggtgaggcataaaagactacacattgggtacagcatatgcttctcaggtgatgggtgcaccaaaatctcagaaatcaccactaaagaacttattcatgtaacaccacctgctccccaaaaacctattgaaataaaaaaaaatgtgtaacacccacgcccccaaccaaaggaaaaaaaacaacctgtagtctctgctacttgggagtctgaagcgggaggattccttgatcctcaggagtttgagctcagcctgggcaacatagcaagaccctatctctaaaaaaataaataaggaagcatataaggctgggcatggtgcctcacatctgtaatcccagctactcaggaggctgaggcaggagtaatgcttgagtccaggagttcaaggttacagtgagctgtgattgtaccactgtactctatcctgggcaacagagcaagaacttggctttaaaaattaagacgcaaattaaaaagccacaagcagaaaggtatatatttttatactctgttcctttctatttctaaaatgtgtaatttagaactaaatattgcatgtgtattctgtgttctaataactaatttatttaaagtaggagacttttaaattctttgatatttattgggaaatatatcctttcatccccctgaataaaatgtattacaaacatggagatattaaattacctcatgcagaaatattagttgataaattgttcccttcaaggaggaaagctcaatatttaattttctgtgtccctgataattttctgactgatttttgtatcattattgatatactttgattaagtatgagtgaatttatatgaacttatacaatcatctgaattaaatcattaatttgagtttttttgtattttggtggagagaatgctgagtggtaaaggaagcatgccactgtgttttaaaatccttttcaatctctgggcttaacctcttccaattttagagaaatagtgaaattattattatcagtgctcaaaacatatattgaaggtttgctttttttcttttgtaggatgaagtggcacacactctaactgaaagcagagtattaaagaacactagacatccctttttaacagtaagtgactagaggacagatgttataatcgtaacatttgaaatttaaggaattttatgttagaaattaaattgtgaaaaatactattcatttagatatctcattttctttgtggaaagaacgtaagtcaaatttcttataacttattagaatgtatggatttttacagtgtgtatgcattgataattcctcccattatgcatttattacttttttgagaattttttttctcccatgaatctcttgccattaaaaacaaaaacaaaccatagagttaatacattacctctggcattttaaggagactattgaggaaatggctgatttttaaaaatttcttaaatgtaaagattttatgtttgttttattggcttctgataaatatcttaatgatcagaagcatttcttcaaatatggaaggcagaaatgtttatcgaatatattttatagaaatgagacttctttgagggatagagtactttaagaaatatgggaatgctaaatacattagaggtgggataagccatgctacgtttttttcactagacaaagtataaactgattatatggtatgcctacaacttagttgtcttgaaagaaactggattttttagttctgttcttagattccttgtaatatagggataattggtaaagtttctgtattttcttggttccaatgaactatattgagatgaaaaataatagctagactttccaaagtggaaccctttacactgtttggaatatctgaaatagacattttcagagctgtcagtagatacctagacttactttgctaccttttttggtgtgtttattgtctagtgtaataagatagcatttgggtattttttaataacctatatataacctacaaaattatataaaccaactctgttaggttgggttctgttgtgcactcaatatgcaaaaagtgatgttgtcattgtattagaaacctgagtgtaacaaccgtagctacattcctaaggaacttcaactagtgtaatttgttggccacgctgtgaggttgcatggatgagaaccttgagtactaatgcagcttcaaatcaatggcaaattagattgagaagtgcttgttgcaattaagtttacttttacttgaaattttaattttagtttttcttgtaataatacctattgtgaactaaacatttgttttatgtttctcataaactcttaagcacttttaagtagtaaataaactcttaaacaataacaattcttttcatctttcatgcttactatttctatgtgttctatttttagtactattataattataagaatacaggattataatgtaacattttttcttttttttatttcaagtccttgaaatattccttccagacaaaagaccgtttgtgttttgtgatggaatatgttaatgggggcgaggtgagtcaagaagtaaatccagtatttgcatggtagtattttcattattttaaaaacattacttaaaatacaagttacaatatagcagttctccatttcttgataggaatttatgtagctcttaatactattgaacaaatgggagcgaaattatttctgatgagatgtaatgattgtttttatataactacatttatatgttggaaagcataatcatattcttctttttcctgtgtttttaaatgtaaaaagttttaacagaagtatgatttttgaaatcatgttattaaattttgaaaaccagaaatacaagatttattgtttcacaaagtttcttttcaagtaggctgtgaacatggtcaaaagttattttacccattctaaactcagtggaacaatagtccatgggcacattatggctgagttttctcttctttatagtagagtactatgactatatatatatatatgtgtgtgtgtgtatgtatatatgagggtgtatatatatgtgtatatgtgtatatatatgtatgtatatatgtatatgtatatatatgggtgggtatatatgtgtgtgtgtgtgtgtgtgtgtgtatatatatatatatatataatttttttttttttttttttgagatggagtttcgctctgtcgtcaggctggagtgcagcagcacaatctaagcttactaccacctctgcctcccgggttcaagcgattctcctgcctcagccccccgagtagttgagactacaggcgcgcaccgccacacccagctaatttttgtatttttagtagagatggggtttcaccatgttggccaggatggtctcgatctcctgaccttgtgatccatctgcctcagcctcccaaagtgctgggattacaggcgtgagccaccacgccgggcctaccatgactatatttaagagactgacaatattttggagataaatttaatatttttattagcacatttcactcattcctttattccttctcctttctcttccttggttttgatcacagtcaatgtgagggaaaagtaaatttactggaaaagctaactggaaatatttttattgtgggctttctgaaataaatttaattattaaatagggtcttgtttgtgtctcatgaacttaaaatattcttattttccaaaataaataattaaatatcctttatggaatttttttcctgtagaattatctgatttgcaggaattcgtttgttgcaaaacttcattcattcagggcttgcatggtggctcagacttgtaatcccagcagttggggaggctgaggcgggtggatcacttgagctcaggagtttgagaccggcctgggcaacatagtggaagcttgtctctacaaaaaataaaaaaattacctggacatggtggcacacacccagctcctgtactcccagctactgaggagctgaggcgggaggatcacttgagcctgggaggtcaaggctgcagtgagccatggtcatgccactgcacttcagcctgggtgacagagcattacctggtctcaaataaaaaaaaaaaaatcaaaacccaaaacttaattcattaatttggtaaacacattttgagtgcctaggcagtatgggtttatgaaaatgtgttaagatattatccttgctgtgaaggagtatataacttcccttagtgtattacaaattagaatgcatagtgaaagacctaacttctaataaagtcataaaagaaaatgctttatggatgatctagcacttagagtaggcttaatgagatttcacccagggaattgatgtaagaagttgtttcaggcagagaggatgggatgggcagaatcactggtggatgataggacaagataattaaataataataacccaggaatacagaactgggcccttgcagtaagatgtctgagaaaatacgaagaaaatggatgttgtggaactgtaggattggtacatctttttttttttgagatggggtctggctctgtcattcaggctggattgtagtggtgccatctctgctcactgcaacttccacctcctaagcttaagctatcctcccatcacagcctcctgtgtaactgggactacaggcatgcatcaccatgcctggctaatttctgtatttttttgtagagatagggttttgccatgttgcctaggctggtcttgaactgttggcctcaagtgatgcacccacgtcagcctttcacagggctgggattacagacgtgagccatcacacctggccatattgttacatcttaatgaccaattaattagatcttggtagaaacaaaaaggtacaatgaaaagtgatttttggttggaatttgggagccttagcagatacagtgcaattatgaagaacatgttaaccttataaatttggttttgaaacagtttttcgtaagcttttaaagtaatgtatgtgtggaactatgatggagagtggataaagagtcaaaactgtggatgcagttttggcagccattcccataaagattataatttaagttatgggggtggaaatgaaattgatgaaacctcttacatcagtatctatcaaaatttaaaatgcgcttatacttggactcagcaatttcatttctaagaatttatcctacagacgtacagatgcaccacagaatgatatatagataagtatactcattgcagcattgtagcattttaaatgagcattcgtaaggagtctgcttaaataaagttacattcatgcagtggaatctctatatccatctgaaagaatgagacagcccaatatgggcattaatagaagttaaaaaaactaggtgcagacgagtataaagcatacttctgttgtgttaaaataaaattagaccgtaaacatgtgtatatatgtttgtctattgatcgagtatctctgaaattatgcactgggtattagtgcttgtctttgggaaaataaactgagtggccagggataagataggaggaagacttttcatttatgtatttttcagtatcttttgtgttttgtgccacatacatgtattatctaatagttgaaagtagacagacaaataaatggttggatgaatggatgaccaagggaaacagtaagacagataaaacagtccgcagacaaaaacttggaaaaacactattaaatgtctctcttttttaaacggtattgtgtgttcatgtctatagtaacaattttcacattgttttacaattacctatttacttgtctgtctttcccatcaaagtgttagctttctaagaggcttgttcacggtataaccctagcatcttattcactgcttgtacatagttggtgcttcacaaatattcattggattatttgaatgaataagtgaacaaatggatgaacattccctcagggattagggataagagaagttagctaaaaggggtaaaataggaactactgaggagtaggaagaaaaatagaaattgatgtagtatacagtttattttgttaaaaaagctgaaagtgtaaatttaggagaggatatctttttatttcaaaaatacatatgtattaagtctttgtggaaggcactctggtagatatctagggcatagaaatctgaattaaacatagatcttgccctcaaagagtttatagtctactggagaaagggtacaaaaataatactaagtgtgaaataattatcacttctatcataacagatagatagatggtgggactttggtgggatgagggaaagcttcctagagggcgctacctggcatctgcacttcttttctaaacccggagtacttaaagattaattaattgatgattattgaaaaaaattttacactaaaagcagattttcagattagccagatgattttctttagcattaatactcctacattatttttcttgttcagcatatctttgtttttcttcagaatttctgttttggattgggctatagataagtattatttaatattttgaagcaagtgaactgattctctagggtctcactccatcaccctgtctggagtacagtggtacaatctcggctcactgcaacttctgcctcctgggctcaagcagtcctcatgcctcagtctcccgagtagctaggattataggtgtgcaccaccacacttggctaatttttgtatttttagtagaaacggggtttggccatgttggccaggctagtcttgaactcctgacctcaagtgatctgcccacctcggcctccctgtatgtggtgtataattttaacatgcgtaggtaattacagtgttggtacacacacacacacacacacacacacacacacagaaaatgaaaagttatttatatttaataactttagtaggaaatagaattttatatatttaacctcacaatttttttttttttagattatcagatgtattttaaaatagttatttagttcttggagtatagtaggattatttcaattcttgatttatcatgactggggaggaaatctatgcttgatgtgtttatccttgtggcaacttgtttaattttggttttgctttgggttcaccttgccatttatgctgcccagggatgccttataaaaatgcagaaaacgaccaggcgtcgtggctcacacctgtaatcccagcactttgggaggctgaggcgggcagatcacgaggtcaggagttcgagaccagcctggccaacgtgatgaaaccccatctctactaaaaatacaaaaaattagccgggcatggtggtggatgcttgtaatcccagctccttgggaggctaaggcaggagaattgcttgaacccaggaggcggagggtgcagtgagccaagatcacgccactgaactccagcctgggtgacagagcaagactccgtctcaaaaaaaaaaaaaaaaaaaaaaaaaaagcaaaaaacttaattactgtagaaaaagtattaaacatagtagttatatttttgaaataggtttaaagtaagggaaacaataaacacacgtaaacaattcacactagcacaatccacacatataccaagactcagccagtggggtaggatctgtatggcatctaaggacttgagcgtgagaatactggccttttgtaagcaagctctggtaagttcataataccaaaatggcagcacactcaaatctttttatatcaagtttttgccctaagatgagctcctttagtggcctcgctgaaataactagcccaatttttactcaatttatgcttattgttcactgatttttaattaacaatagcatcttcttcttagtctatgctctagaaagtttaccttgaattataatttgagttaggggtttagcatgctcttgattatgcttgtgatttttatgtgtttgtcaatataagtcacatgccatgtagcaatgttgaagtcaatgatggatagcacaatggtagtccgataagacaaacatgcacaggtttgtagcctaggagcaataagctataccatatagcccaggtgtgtagtaggctatgttgtctaggtttgtgtaagtcactctgtgatgttcacacaatgatgaaattgcctgtattagttctcacactgctgaaaagaactgccccagacggggtaatttataaaggaaagaggtttaattgactcacagttccgcagggctggggagtcctcaggaaacttacaatcatggtggaaggggaagcaaacatgtccttcttcacatggtgacaggaagaagtgctgagcaaagggggaaaagcttcttataaaaccgtcttgtgagaactcgctgacaatcacaagaatcacatagtggtaaccacccccataattaaattacgcaccagggccctcccatgacatggggattttgggagctacaattcaagatgagatttgggtggggacacaaactatatcattctgctcctggcccctcccaaatctcatatcctcacatttcaaaacacaatcatgcctttccaacagtcccttaaagtcttaattcatttcagcaatatcccaaaagtccaagttcaaagtctcatctgagacaaggcaagtctcttctgactatgagcctgtaaagtcaaaagcaagttagttacttcctagatacaatgggggtacaggcattgggtaaatacacccattccaaatgggagaaattggccaaaacaaaggagctgtaggccccatgcaagtctaaagtccaatagtgcagtcattaaaccttaaagttccaaaatgatctcctttaactccgtgtctgacatccagatcatgctgatgcaagaggtgggctcctatggccttgagcagcaccacccctgtggctttgtagggtacatccctcctcccagctactttcatgggctggtgttgagtgtctgtggcttttccaggtgcactgtgcaagctgtcagtagattaccgttctggggtctggaggacagtgaccctcttctcacagctccactaggcagtgccccagtggggactctgtgtgggggctacaacaccacatttcccttctgcagtgccctagcagaggttctccatgaggactctgcccctgcagcagactggtcatccaagtgtttccacacatcctctgaaatctaggtggaggttcccaaaccttaattcttgtcttctgcacaccagcaggaccaacaccacatggaagctgccaatgcttggggcttgcaccctctgaagcaatggcctgagctgtacattggtcccttttagccacagctgggactgaagcagttgggatgcagggcaccatgtcccaaggctgcacagagccgggttggggggccctgcttttgggccctggccctggcccacaaaactgtttttccctcctaggcctctgggcctatgatgggaggggctgctgcaaaggtctctgaaatgccctgaagacattttctcctttgtcttggtgattaacatctggctccttgttacttatgccaacttttgcagtgggcttgaatttctccccacaaaatgggtttttcttttctattgtattgtcaggctgcaaattttgcaaacttttcttctccgcgttctcttcaatgctttgccacttagaaatttcctccaccagatacccccaaatcatctccttcaagttcaaagttccttagatctctagggcaggggcaaaatgccaccattctctttggtaaagcatagcaagagtcacctttactccacttaccagtaagttcctcgtcttcatctgaggccacctcagcctggactttattgtccatatcactgtcagcattttggtcaaagctattcaacaagtctctaggaagttccaaactttctcacgtttttctgtcttcttttgagccctccatactgttccagccttgcctgttacctggttggaaagctgtttttacatttttgggtatctttacagcagcaccacactctctgtggtaccaatgtactgtattagtccattctctgttctcatgctgctgtgaactgcccgagactgggtaatttataaaggaaagaggtttaattgactcagttctgcagggctggggagaccttaggaaacctacaatcgtggtgaaaggggaagcaaacatgtccttcttcacataggagcaggagagagaagtgctaagcaaaggaggaaaagccccttataaaaccatcagatttcatcagaactcactcactatcagcagaacagcatggagataaccagccctgtgattcaattaccttccagtggatccctcccacaacacattgggattatgggaactacagttcaagatgagatttgggtgggaacacagccaaaccatatctgcctaccagcaagtttctcaggccatatcccagttgttaagtaatgcatgactgtatttggagcactaaaaatttttgatgaaagtgaattgtgaaagaaatgttggctgtgaaaaatcagccctaacttcttacggtcgtattggtacaatggaatttcatcatagttgcatgtaatttatatgaattcaaagaagtgggctcaataagatatagctgagatagacaagttgatttaaatgatgtgattattctgctctttttctcaatttctcaatgagtgtatttacagagtgaccttaggatgagagatataaatttgctattctttactccttgttacttcctactttccatgcatagagcttcatggaatataaactctggtgttttaaaatacaaaacttacataaaatgtcattgagtgcattgtaactgcaggtgttcatttaaagaaactattttctggccaggcctggtggctcatgcctgtaattctggtgctttgggcagctgagataggaggattgcttgaggccaggagtttgagaccagcctggcgaacatggtgagatcccgtgtcaaaaaaaaaaaaaagttagccatgtatggtgatgtgtacctgtagtcctagtaaattaatcaggaaagctgaggtgggaagttcacttgagccgaggaactcagggttatagtgagccatggttgtgctactgcactccagcgtgggcaacagagtgagaccctgtctctaaagaaaataaaagaaaaaagactatattattgtaccaaagatagaaaactgtcctgggtttaactatgtcgagagatgacagtatgttggtctccagtgtaataccgttctaaggaatgtttgggagtgatttgattatttttgataccttatggattaactttataatctagtacattatcattcatctattaaataatgagcaacttctgtgggctagacctcagaagattcataaataaggaaaacatactatttttcctttgatgagtgacttactggggagatagatgagaaaatacttgtatacactgcagtgacatggttgctctgataatactggttactgtgcatggagagaatgagcactttaatgaacctgaggagcagaggaaaggaaagcaaagggtgccagagtaggaaactcttcttaaaaagtggttgctaggctaagacgtaagaataactatacattatatcactaaggttgggaaggagagcattcctacacaggtaaaatggcatgtgtagagtacacaggagcagacaggttcccccacccaccgaatatagcacagtgtggataatgcatagagttctgcagaggaaagccagagagtctgcacaggtagtcagaatcacattaagacagatcttcactctcaagtcatttagatgaaggcagtggagcatcatggaagaatttctttgggggaaatgtttagaaagaatacttggcagtatagaggttgaagtagagaggacaaaagtggaagcaaggaaaatacttgggaggttgctgcagttagaaggttttcagtaattcacttataaaaatgataaggttgtcggatgtggtggctcatgcttggaatctcagcactatgggaggctgaggtgggtggatcacctgaggccaggagtttgagaccagcctgaccaacatggagaaaccccgtctgtactaaaaatacaaaattagccaggcctggtggcgcatgcctgtaatcccagctacttgggaggctgaggcaggagaattgcttgaacctgggaggtggagattgcagtgagcctagattgcaccattgtgctccagcctgggcaacaagagcaaaactccatctcaaaaaaaaaaaaaaaaaagattattaattgaagcagtgttagaaggaagcaaattctagtaatatttagttattagaatcaccaggatttaatgaataaatatgcagagaagtatcatatgatttcctgtttgctgcttggggaattgtggatactggagtatttataaaaatagaaaacacagggagaagaatgagttcttaagcagatcatgctatatttgaggcacctagtgtggcagccaaggagtggggagagttaaatcagagatacaaataggcatcatgagcagtgttaaaacccaggaagtgaggaaatatccaatgtgaggaaagtatgtacagttagaacatcagtggccaaggatggtgcctggaaatgccagagtaaggcatgctgtagacacagctgtagatgcagtgagactagtgcacaggtgtagaggcagagagaagcctaaggaggatcctgggcaggaggagccagacaagagaagccttagaagttaaggagagattaggtacaacagagtatattaaatactgtacaatgataactgagaattgtccattggatttgccatctaatagttcctatggagactaccagggattcttccttttctggtttggtacaaggtatgcaccttggctgtagtacagaatgtaaaagggttggtttggagcccagtagaacaaggttgtaagagtgagttcagtgcaatttcagtggggcatttgtagaactgattgtaaaatctctctaataatatgaccaatcacactgctaatatatccaggcagctctctttttattccttaaatgttactaaatttacatgagaagcagaaaaatatcctgggagaataaagtagacaaaattgactaaggaggtgtttttgttttctttggtttaggaagtctctacttaggacttgtttccaaaatcttactcatagcttcatttatttcaggcttatttgttggacctctgcaaatctctctcaagtctgaagtttcctgaagttaaagattcattaggggagtaaaggaaaatcattgtgtagaaatgctattcatctgataaattcttcacattcctctattttctttatgtaggttgtaatgaagctaacagtttcagttatgtactactatttttgtccatacttagttcattgtaaactctatattaatttctttgataacatgtatttgatttttttgcaatacggctttcaggttcttgccattcttgagattctcatgcttattcagatttctcatttggctggcattttgttatcagtgaaccaaaattatctcattttaaattcacataagacaaaagcaccagtagtcagtattctagttctccttactaatttacggaggtgtgatctgggtgatttttaaattaatttaattatcatttcatattcatagtgatgatttttaaaattttacaaagttttcaggtatataaacatctttattgtcaggtgtctgacaagctaatttctttgctaactattttagttattaatatattatgtaggttgtatcagaattttgtttttcacccaatgctttttcaaaattcccaagtcaagaaggatgcattacaatgtttacattagcatctaaaggcaatgtaaagtcgggaagcatttttagtatataatttcataattcaaagacatttttaaaaaatgaatggttaaaccagtatctcactgcattaaatgtaattgaatgcattgaatttagttattaggagatgttattacaagcctcaacatgtaacatgcttgcttacaaatctaaaatctcagatcaagtggctggaactgcaggggcctgccaggcatctgggtatttacatgattcctttccatgtggttatggcagagcatggccatttcaaggtagtcaaacttcttacacaaaggctggcttaccacagagtgggtatttcaagggagggaaaacagaagaagcaacatatgtataattggaaaccctgaggaggaaaaagagggcagtgacacaaaacagtatttaaatatcaaaaactataatctgaaaacatacttacaggcttttgtgttctccatttttcacttagcataatacttttaaaatttatagatactgttccatatatcagtagtttgtttctttttatggctttgctccgttgtgtgatgtacagtcatatgtttatatagttgcccctggatagacgtttgggttctttacattttgggcctattagaataaaagctcgtgaatattccagtacaaatctgtgtgtgaatatatatttttaatcttcttgggtaaatacatagaaatgcaatttctgtgtcatttgttatgatcaacttcattaaaaactgcagactcttttcaaaatcagccataccattttgcattcccaggatgttacttgacaacatcaccacacttggcatggtagtctttttaaattttactcattctggtggatgtatagtggtattttttagcttcaatttgaatttctcaaataactaatgatattgaacttcttttcttattctgatttgccatttatacatcatcttttttgaagtatcttaaaatcttttgtctgttttaaaaattaggttgttgtcttaatattgagttgtcagatttatttatttcatgtaagggctttatcatatatatattttataaatattttctcccattttatagtttgtcttttcatttcataatgggaaattgttccaaaatacacttttgttgtaatctattgtaatcagcattttaatgcatagttagcattcagtaaaattaatcaattttgactgtacaatttagtgagttttgacagctgtataaagcagtttcccatcaccacaatcatgatctagaatgtttctttcacaacagagcctcgcatgtctctttaaagtcaattctctcccctcactctcaccctgaaaaccactgataggctttccaaccagtatgaagggcagacttctaaattagaggaaacacaattcattgattattttctcttatgatttgtacattttgtttttaaaacatctttttctaactgaagtttgttaagatttttttctaaagtcaaagctagacctgttgggtggtggcaggtcggggagattttcttttatgctttcttctagaagtgttaatagttttagctcttgcatttaggtctatgagccatttcaagttaattttaatgtatactgctacataagggtcatgtttcatttgtttcttgcaaagtgatatctaactgttccagcatatttgttgaaaagactgtctttctcccattgaatgatttggtacccttgtcaaaaatcagtcatatatgtgtgggtcgatttctggactctgcattctgttgtattggtctatatctatcctgaaacctataccacactgtcttcactatgccacacacttactttagaataagtgttaaaatcaggcagcttgaatctttcaattttgatattctttttaaatttggttttgctatccaatttcctttgcatttccacataaattatagagtaagcttgttgaattctacataaaagcctcctggattttaattgtgattgtgttaaatctgttgatcaatttggggagaattgacagtttcacagtgttgtcttctgattcataaatatggtatatgttttcccattatttaagtctttaatttctttcaacaatattatgtagtttttagtgtacaggtcttgaaagttttaaaaatttatccttagggatactttataattattttatgtttttaagttataaatggtttatcagtcattattaaaaatttcaatttgtagttgattcttgctaatatatagacatacagttgatgtttacttattagccatactaatattagttttagtagtcttttattgtaaatatattggatttctctatgtagatgatcatgtcaggtgagaacaaagacagttttactgctattttctaatatgtgtacatttccttgccttattaaactatccaggatgtttagaacagtgttaaagagcaggataagagcaaatatccttgctttatacctaattttagggcagaagcattcatactgtcaccattaaccatgttgttagctgtagatttttcgtagatgctctttattaaaagttgaagaatttctattagtaatttgatgagtttaaataatcttagtttgattagctctgcttctttgttcttatggtggtagctttagggtttagaatatgtatcttttctcatcacggtagactttcaaacaatatgctgtgtcactttacctgtactgtaagaaccttataacagcatacgtctattttcttaccttctatctgaaccttaaaaggcatacatctgtttccctgccttctgtcttttgtgcagttgttctcagacattttacttccatgtattttttaacctttacaatacactgtttttgccttaagcaattatctttaaaataatttttaatagaaaaaatgttttatattcataaagtagtcattttaagtgttctcttttcctttgtgttggtatacattttcatctattacattttccttttgcataaaaacttcctttagcatttgtttttgtagtgcaggtctgatagccgtaacttttgttagcttttatttgtgtgagaaaatctgcattttgtcttaagatgtttccctttctttaaaacagttttgctgagttaataacaaattataaataatttgtacatatttaaagtgtacaatctgataacttttgacccatgaaatcatcaccacgataaaaataacatccccacaaatgttctcctatacaggagattttaggaggaaaggtgcatttgaactaaatcttcaagaacaggtatgttccccaaataagattagctcattcaatcaaaagtatgtattaaatgcttactgcgttcgctaggatgaataaaacagtcatgatttctagaaggagatgcatattataaaataataaaacaaaataaacccaataaatataatggcaacagagtgctgtagtatgagagagaatgatggagaacctactataaatttagttatctctttgaggaagtagtgttaggttgacatttgaagggtatgtgggaaggaacttcctgtgctctgatgagagaagcctgttgagcatgagactttagggcacggctgtagatgcagtcatctttttgcaaggatgggctgaatacctgttcacttactaaaccgtgggagtacagctacactctagtgcagttcctgttaggctattatgagagagagttatggagaaaatttcttcctaatagaatgatgaaatatgcttgtatatttagtagtttgagttaatgcattttacattactgtattcctatagcatggctaagcttaacaataaaaaaaaactatgtagtctttgcctttataaaggaacttaacttgataaagataagctccctattttagcagcaaataattcactttcctttttgaacaaagataagattattcaactattatatatgatttttaatacttccaatgaaaatattttacctcaaaaaccttaaggatgatttttcttataattttttgagaggtatttctgaatttaattttattttttgcaatacatatttatgaagaatataatatgtgtcatatactaggcatggtgctgaagatgcaaagatatggtgtactgtcataattttctcattttcctatgcctttgccaagaaaaaaatagagcattaaatttataataagcataaatcagtacattaattattagtacatttatttgaaacctttgaataatttttttctattgcaaaagtgataatgtacattcattacagagaacttcaaaaagccaaaaaaattattttaattctgtcaaaaaagttcttattgaatgctgctttcttcaaggcaggcactgtactatgtgcttagtatactacatgagcaagacagatggtctctgcatttaagaagggcataggccaggcccagtggctcatgcccagcactttgggaggccaaggcaggaggatcacttgaacccaagagttcaagaccagcctgagcaacatagggagaccctgtatctaccaaaatagttaaaaattagccaggtgtggtagccagtgcctgtgctcccagctactcgagagactgaagtgggaagattgagtgagcccaagaggttgaggctgcagtgagccatcatgcgactgcacttcagccttggcaacagagtgagaccctgtcaccaaaacaaaacaaaacaaaacaaaaatgcatagtattctggggaatggatattaaataattacaagtattttttgaggtatgaaacagaagataaaaaccactctaaatcttaccatctagaaataattgctaataccgtgttaatatattttccactgtttatactgtacacatattttcaattttatcattttaaaatatgttacttgttgcctactaattatgtagatacactttaacttattaaaaccttcccaaatcattgaacgtttaggttgttttcattttttagtcaacttaagtataatttacatataatgaaatgaactcattttaagtatatgattagatgacttctgacaaacatatatatgcatgtagcccccatcacaataaaaatataaaacattctcattgcctcaaaaagttctgccatgcctctttgcagtcagtcttccctgtacccatagtacatccacacgtggccctaggtagccattggtctgctttcagacactaaagatttgattcatctttttaaaaatgtcacagaaatgaactcatacaatatatactgtcttgtatctacttctttcattctgcgtaatgttttttgagattgttaactttgttgcatttctcagtcatttatttcttttattgtgaagtcattatcctttgcacagctataccaccatttgttaatctctcccactggtgacgtacatgcggattaataccagtcattgcctaatatgaataaagctgataggcctgtttcttttctctttaattaatactgaagagtatgattgttggatttatggtaagcatatgcttacattttacaaaaatttaaaactgttgtgtcattttacagtctcagcattaatgtaatgagaattttaggtgttctgcaccctcaccagtgcttgctgtggtcagtggttttcattttagtcattctaacgagtgtgtgggagtatgttactgtggttttaagttgcgtttctcttatgactaatgataggaaatgtcttcactcagactttttgccattgcatatacttttgtgacctgtctattcaaatatttcacctattattcggttgttcatcttcttactgaattataggagttctttggatgttctggttacaaatagtttgccaaatatttgtattacaaatggtttcttccagactgtagcttgccttttcattttctcagtgatgtcttttgaggaacagacgtttttaattttgatgtcttatttatcaattcttgccttttatggttttcactttttttgtgtactgtccaagaaatgtttgtgtaccccaggtcacacatctttctcctatttgttatgtgtcacgtgctatataataagtttctgtcaacagtgggccatgtatatgacaataccataagattataatgtagctgaaaaattcatattgcctagtgatgtaaatgttgtaagtcatactgcagtgcattactcacatgttttggtgatgctggtgtaagcaaacctgtgctgccggttgtgtagaaacatagcacatgcagttagatacataatacttgattgtgatagtacatgactgtgttacttctttattttatatattgtacttttcattgtttcttaaagtgtattactttcacttatttaaaaaaaaataggtaactgtaaaacagcatcaggtgggtccttcaggtgatattccaaaagaaggcattgttagcgtaggagatgactactcgatgcctgctccgaaagaccttacagtgggacaggatgtggaggtggaagacagtgatactgatgatcctgactgtgtaggtttaggctaacgtatatgctgtgttttcatttttaaccaaaagttaaagacgttaaaaaaaatagaaaaatatttataaagatgtaaagaaacaatatttttgtatagctgtacaatgtgttcatattttaaactgttataaaagagtcaaggcgtttttaaaaattttaaagtgtataaagtgaaaaagttatagaaagcaaaggttaactcattactgaagaaaaaaataattttaattattttatacattatacagtgttcatagtctacagtaatcacctaggccttcatattcactcgccactcactcactcaaagcagcttccagtcctacaagtttcattcatggtattataaatgcaatagacaggtatatcgtttttaaatcttctatatcatatttttactgtacttttctagatgtgtttagatgtgcaaatatcattgtgttacacctgcctagagtattcagtagggtaacatgctgtacaggtctgtacctagaagtagtaggctatgccatttaggtttatgtaagtaaaccctaggatgttgtcacaatgatgaaattgtctaattgcacatttctcagaatgtatccccatcattaagcagtgcatgactgtattttcttctaaaactttttaagttgtacctattacatgtataggtctgtgatccattttaatttttatgtatgctgtgagctaagagttgaggttcatttttttccccctacagacatcttgttctttcactatctttcattgaaagggctgtcctttagtcagacatgggggcttatacctgtaatcccagcactttgggaggctgaggcaggaagaccacttatgtccaggagttcgagaccagcctgggcaacacagcaggaccctgtctctacaaaataaaaaatttaaaaaattagcctggactggtggtgcaaggcagaattgggagcattgcttgagcccaagaggttgatgctgcagtgatccatgttcataccactgcattgcagactggacaacacagcaagaccctgtctctgattgtgtgacttgggtacctctgttgaaaatcagtttgtcacacatatgggtctgtttctgcactgtcttattctgtttaattgatctttgagtttctctttacatcagtaccacgctaacttgataattgttgctttgggagtatattttgaaatagagaaaaactttgttcttttttcagaattgttttgactcttctgtgtcctctgcattttcatataaatttattatcatgtcaatttttacaaaaaagtctgctgtaactttgattatgattgcatttaatccataaatctatttaagaatattgagtcttctaatccatggacacacactctgtttgcttatggatttctctaatgtctattgaaacactgtagttttagtgtataggtttgtataatttttcaatttttctttacctattccaattttttcccatttacaattgtttgctgttagcatataagaatatagttggtttttatatattaaccttgtattccatggccttcctaagctcacttattagttctagaaaccctttttctaaatttctttgaaatgtctatgtagatagtcttgctctttgtaaataatagcagttttacttccattcttgtttgtatggcatgtatatatttgtctgtttaattgtctatctgtctatgcatctttcactgcctgtgactgctagtgcagtgttgaacaaaagtagcgaacattgtgtttttgttccctgtctcggaaaagattaagtcttttattattaagtgtgatgttagtcataagtttttcatatataccttttattaggttaagttctctcctattcctagaatattttaccatcagtggacattgacttttctttaaaggtttttgtgcctccattgaggtgatcatatggttgtttatttagacacggagtctcactctgtcgcctaggcagaagtgcagtggcgtgatctcagctcactgcagcttccaggtttattcccaggtttaagtgattctcctgcctcagcctcccaagcagctgggactacaggtgcccaccactgcacccagctaatttttgtatttttattagagttggggtttcactatgttagctagattgctctcgaactcttaccctcaagtgatccacgcacctaggcctcccaaagtgctgggattacagacactgtgcccggctttctttttagtttgtacatttgataaattacattgacattcaaatgttaagccagtcttcattcttgagattaaccatcttttagtcataatgtattatcatccttatatgttgttggaattgaattagagaagttttgttaagtttttacatctatgattttgagggatattgatctgtactcatcttttcatgtaatagttctgtctggttttgtattgtggcaatgctggcctcatgcaacgtgttaacaactgttctcgtattttctgggagtgtttctataaaattgtaattatttcttctttaaaggggtggtggaattcatcagtaacttttgggagctccagtttttattgtgggatgacggttaactataaactcgtatttaactttttttcccattttgtgttccgcttagattataccatttcacatacatcctaagatcctttcactggtatacttttatttcctccttcaagcctttgtactgttgttacaatacattttacatttgtatgtgttataaatgccactatgcattattatttttgttttaaaccagtgattatcttttaaggaaatttaaaacagaagaaaaattaatttctgttccctgacacagttactatttccaatattttctgtcctgtgggtagatcctgttttccatgtggtgtcattttccttcattctgaaacattttcttgaacaatttctagttcagtgtctctggtggtgagttctctaacctacatgtctgataatggctttattttcctctcatttttggaaagatatttagctatgtatgaaattctaatttgccatttttacatttcattactataaaaatgtcactgtactttcttctggcttatacagtttctgtcaagaagtctgctttgttcctctgtgcttcatgtgtctttttttctgtggtcgctgttaagcttttctgtttattacttcctttcagctattgattatgatgtgccttggtatggtttccttcacagttctttggcttagggttttttgtttgtttgtttgttttttgtcttttttttttttgagacggagtctcgctctgtcgcccaggctggagtgcagtgacgtgatctgggctcactgcaagctccgcctcctgggttcacgccattctcctgcctcagcctccagagtagctgggactacaggctcctgccaccaagcccagctaattttttgtatttttagtagcgacggggtttcaccatgttagccaggatggtctcgatctcctgacctcgtgatccgcccagcttggcctcccaaagtgctgggattacacgtgtgagctaccgtgcctggccaggcttagggtgttttaagccttgtggatctataagcatatagttttcattcaatttggaaaatttttgaatattgttctgtaagtattttgttactcatttctcttgttccatcctgagaatctacttatttacatgttagacatcttgatgttatcccactgtttactaatgttctcttctttttttcagtcttttctctgtctttaattttgggtttttccccctgtgtctttaagtttactaatactttcttctccagtgtctagtaacatctagtatattttttatttcagacattttcatctcttgaagtttgatttgggactttttttttcatcttcatcttatgtgcttccctctaccttttgaacttttatattttcaacagctattttttatattttcaacggctaatttattatggtattcgtgtaattatatcttatgtgtcattttctcagtctgtttctattcattgattagtctcctgattataggttattattttcctgtttctttttatgtccgttaattttttattggatgccagacattgaattttacattgtcagatgctggaagtttggggattaaaaaatatatttaggcattattcttatgtataaacagtatgatcctatcagtgcttgcttttaagcttagtaagactggtctggaatatcctttgctctagcactaacacggctgcactattgaggcagtatttttttaaaactctgttagatgccatagtttttaggagatctttctattttgccatgtgagaacatgaaatatttttgcctttctgttagcctggtgattgtttcatctggtccttttcagtggctctttccgtagcttttccccacatacaggtgctgctcaatgagactccgaggcaatccattgtagatctctcgagctctgtctttggtactgtcttctgtctagttacctgtctcatgaattctagataccttggtctccccagtctctgaactcagtatcattaaatcaaggatcctcgtaggctctttttgttttgttttgttttcctctccctgtgttacagcctggacattgtttctaggtatccagctggagtaatcataactatcaccttattcatttcccttttctcctgggcaactgtagatctgtgcatttagttatttatccaattttagaaaatttcagccattctttttcaaatgtctttctcctttcagtaatttatattacacatgtgttagattcattgatactgtccaacaggtcactgaggcttttttttcccagttgtaatttatatcgattctttagctatgatttcacattcagaagtcctttctctttcagtgtcgaatctgttaattccatctagtgaattttttattttagatgttgtttgttttatctctacagtctcatttgtttctatttccctttatctcttctttatgttcatgtactattttgaagtcagtatctattaattccatcatctctgatttttaggtatgtttctaatgactgatttttctcttggttataggtcatattttcttgcatcttgtcatgtttagtaaacgttgattggatgctaaatcatttgttcttgggggtttctttttttaatttatttcttcttggctttattgaggtataatgaacaaataaaattgtataaattttaggtatacagtgtagtgatttgatacgtgtatgtattgtgaaaggattgccacaattgaattagtgaatacgtctgtcacctatcagttacctttgtctgtgtgtgatgagaatacctaagacctactctcttagcaaattttaaatatacagtacagtatcattaactatagtcatgatgctgtacattaaatccccagaacttacccgtaactggaagtttgtaccatttgacaagtatctccccattttacttacctccctaccccagctcctggcaaccatcattctactttctgtttctgtgagtttgattcttttagattccccatataagtggatcatacagtatttgtcatccctgacttattttacttaacataatgcccttgaggttcatccatgttgtcacaaatggtaggacttccttctttttatggctgaataatattccattgtataaatataccacattttcattatccatttatctgctgatagatgttgcttcttcatatccaagaaatctatatatatagagtgtttccattcttggaatagagatacctgcagtcctgccttaattacagtgaataatgctacagtgtatgtgggagtacagatatctatttgaaatattgatgtcatttccttcagatagatatatatacctagaagtgagattgcaggattatgtgatagttctatttttcgtttcttatggagcctccatactgttttccataatggctataccaatttacattcccaccaacagtgcacaagggttcccttttctccacatcctcaccagcacttgctatctcatcttttttataatagccatcctaacaggtgtgtggtaatatctcattgtggttttgatttgcatttctctgttgactagtgatctatcttgagcaccttttcatgtatctgctggccacgtgtatattttctttgaaaagtatattcaggtcctttccctattttttgatcagattttttttcttttttctttttttttcttttttttttttttttttgagatggagttttgctcgtgttgcctaggttggagtgcagtggcacaatctcggctcactgcaacctctgcctcccgggttcaagcgattctcctgcctcagctttccgagtagctgggattacaggtgcctgccaccacgcctggctgatttttgtatttttagtagagacggggtttcaccatgttggtcaggctggtctcaaattcctgacctcatgatccatcctcctcagcctctcaaagtgctgggattgcaggcgtgagccactgtgcccagccgagttttgtatatatttgggatattgacctcttatcagatatattatttgcaagtattttctcccattccataggtttttgactctgttgattgttttctttgcttcacataagcaaagagataaatagtagtcccacctatttatctctgcctttgttgcttgtgcttttggtgtcatatccaagaaatacttgccaagaccaatatcaaggaggtttttttggtatgttttcttctaggagttttatagtttcaggtcttacgtttaagtttttaatccattttgagttggttttttgatatgatgaaagataagactccattacattcttttgcatgtgtatatccagttttcctagcactatttattgaagagattgttctttctcccttatgtattttcagtacccttgtcaaatgtttgttgaccatataggcatggatttatttttggcttttgattctcttccattgattagataatttgagttttacgtgagttactggattttgttttcttctgtcagagtgttagtttttattctggaaggcagtatttacaaatatgattgatatttcagtattgatgttagctttgttcgtgtaagttcaggtttcactctgactcttgagatatctactgaatgcctgagagttcagtaatgactcttctctgactgcctaaaaattgaatgtctctcagctctgcgtgagctctaagagctactacatatttacagctttcctttccttctctgcttgtcctcataaagttaaaccctacacatgcattgcttagtattcaactgcagactcaactgtgcagattctgtatagcttcctcctcattagtgttctgtcctgcaaatgccatctacctcatcatcctcaaaatctgatgtttatcttttcagcagtgaaacccttgaattaggtttgtgatttttcttcctcaataatgtgtcagaaagtgcccccagacaaaaggtggataatcatatggctcacctcatttgtttctgttgtaacaggtaccatcgtcatgcacttcctcttgtccagtatctaatgagagttcttttatatatttgctcagttttcatcttctgttttagatatgcccatcaaatgtttagggcagttgggtaagttcagtcctgttgacttttcactcatatattctggttcttaactagtagttaactaaaaaatataaaaaatttgaaatttaaaatactaaaaaatctgaaatttatcgtattatattgtgaggtaaaaatctaatttttcttcaacctggttggaaggccgttttcacatttttctcaatgtatatacttctgaaaatatccttgtgtagaagatggcttctatatttttatgtatgtatgtatgtatttatgtatgtatttttgagacggagtcttgccctgtcacctgggctggagtgcagtggtgcagtctcggcttactgcaagctccacctcccgggttcaaccaattcttgtgcctcagcctcctgagtagctgggattacagcgcccgccaccatgcccagctatttttgtgtgcttttggtagggacggggtttcgctgtgttgccagggctggtttcgaattcttgagctcaggcaatctgccagtctcggcctcccaaagtgctaggattacaggcgtgagccactgtacccagcgtatatttttattttttaaggaaatttctaggagagcaactaccgaactttaaaaattatcttgctatctattgccagattgttttgcaaagactgtctgtttacatactagccaccagtgtataaagatgcttatctcacctcactttcactgacaatactaatttttcataaatttaaaattgcccttttttaagttttgtctctgttacattgattattacaaggtggcctatgttcatatacattaataatttgtagccctctcaggttaattgtacctttacccaattttttgtgttttagtcttttaatttttttttatattaagaatatgagctttgtcacatgttataaatactccattttatttctatctttgctactttatatggctaaatctactggattttcccttcattattccatttcttttttatttttttcaacttttattttaaattcaagaaggtacttgtgcaggtttgttacctgggtatatggccatgatgctgaggtttggcatacaaatgatcccatgatcaggtactgagcatggtacccaacagttaatttttccaccctttttaacccctcccctcctctagtagtttccagtttctatagttaccatatttatgtccatgagtaccaattgattagctcctacttataagcaagagcaagcagtatttggttttctgttcctgtgttaattcactccggataatggcctccagctgcatccatgttgctgcaaaggaccggattttgttctttttacgactgcatagtattccatggcatatatatatatacaccacattttcttaatccggtctatccatgtctttgctgttgtgaatagttctgcaatgaacatgcaagtgcctgtgtctactttatagaacaatttgttttcttttgggtacacactcagtaatgtgattgctgggtcaaatggtagctttattttaagttctttgaaaaatctcagaattggtttccatagtggctgaattaatgtacattcccaccaacagtgttacaagcatccccttttctctgcagccttgtcaacatgttattgtactattagaccgattattgtttgacattttaatggcagccattctgactggtatgagatgatatctcattgtggttttgatttacatttccctgaagattagtgatgtgcagcatttttcatatttggtggctgcttgtatgtcttcttttgagaaatgtctgttcatgtcatttgctcattttttattgggttacttgtgtttagcttgttcaattgtttaactttcttatacactttggatattagacctttgtcagatagtttatgaatattttatcccattctgtaggtttaccctgttgatagtttcttttgctgtacagattctctttagtgtaattaggtctcacttgtcgatttttggttttgttcaattgctatcgaggacttagtcatataattttttccagtgccaatgtcaagaatggtgtttcttagattttcttctaggattcttatagtttgaggttttacgtttaaatctttaaccaatattgagttaatttttgtatatggtaaaagataggggtccagtttcattcctctgcgtatggctcaccagctgtcgaagcaccatatattgaataaggagtcctttccccattgcttatttttgtcagccttgccaaagattagattattgtaggtggctggctttatttctgggctctctattatgttccattggcctttgtgtctgtttttttacagtaccatgctgttttggttgctgtagctttatagtatggttcgaaggcaggtaatttgatacctctagctttcttctttttgattaggattgctttggctattctggctcttttttggtttcttgttaattttgtagttttttttttccagttctgtgaaaaatgatgttggtagtttggtaggtatagccttgaatctgtagattgctttgggcagggaaatatggctattttactgatattgattcttccagtccctgagcatggaacgttttttcatttgtttgtgtcatgtatgatttcttttaacggtgtcttgtagttctccttgtaatgatcttttaccttcttggttagatgtattcctggatttttttgtgtgtgtggctattgtaaatgatttggctctcagcttggatgttatcagtatatagaaatgctactgatttttgtacattgattttctctcctgaaaccttgcaaaaatcatttatcagttctaatagccttttggtggagcccttagggtttcctgagtatcgaatcattatcagtaaagagagatagttatactttttctttgcctattaggatgcctttttatttctttcttttacctgattttctctggctagcactctccactaatatattgactaggagtggtgagagggggcatccatatcttgttccagttctcaaggggaatgcttccagtttttgcctgttcagtatgatgttggctgtgggtttgtcatagatggtgcttattattttcaggtatgttcctttgatgcctagtttgttgagggtttttatcataaagtgatgttggatttcattgaaagctaatttggtttatgtggtgaatcacatttattgatttgtatatgttgaaccacccttgcatcccaggaatgatgcctacttgatcatggtgaattaactttttgatgtgtttttcaattcagtttgctagtattttgttgaggatttttgcacctgtgttcatcagggatatagtcctgtgattttctttcttcattgtgtctttgccaggttttggtatcaggatgttactggctttgtaaaatcatttttttggaatagtttcagtagaatttataccacctcttccttgtaccttacatagaattcaactgtgaatccgtcttgtttgggacttttttggttggtaggttttttttattactgactcagttttggaactcgatattagtctgtacagtgtgtcaatttgttcctcattcagtcttggtaaattgtgtgtttccaggaatttatccatttcctctagattttcttgtttgtatgtatagacacatagcctctgaggacctttcgtattcctgtgggataagttgtaatgtaatctttgtcatttctaattgtggttatttatatcttctctcttttcctttgttaatctcactagcagtctagcaatcttctttatcctttcaaagaaccaacttttggcttcatcatttcattatgtggatttttaggtcttaatttcgttccattctgctctgattttagttatttttttttcttctgctagcttatgggttagtttgttcttgttttcctggttcctctagatgtgatgttagagtattaatttgagatctttctaatgttttgaggtaggcatttagtgctttcaactttcctcttaacactgcttttgctgcgtccctggaattttggtgtgttgtgtacctattttcatttatttcaaatactatttttatttctgccttgattttgttgtttacccagaagacattcaggagcaagttgtttaattttcatgtaactgtatggttttgagataccttcttggtattgatttctgtttttattccactgtggtccaagattatggttagtatgatttcagggtttttttgtttgtttttctttttctttttcttttttttttcttttttttttttttttgagacttactttaaggacgagcatgtggtcagtcttggagtattgttccatgtgcacctgagaagaatgtatgttctgtggctgatgggtagagtattctgtagatgtttttcaggttcagttggtcaagtgttgagtttaagtccagaatgtgtgacttttctgcctgaatgatctcactcatgctagtagggtgttgaagtcccccactattattgtgttgctgtctatgtctttttgtagatctagtagtacttgttttatgactctgggttctccaatattgggtgcatacatatatgtgagatatatatatggaagatatatgtgtgtgtgtgtgtgtgtatatatatatatatatatatatatacacacacatatacatggaagagagagatatatatatggaatatatatacatactggaagagagagagagatatatatatatatggaagatatatatgtgatagttaagtcttcttgttgaattgagccctttatcattatgtaatactcttctttgtcttttttttttttaactgctgttagtttgaagtctgttttatcagatgaaagaatagtgattcctgctcttttttgttttccattagtgtggtagctctttctccaaacctttactttgagcctataggtgtcattatatataagatgggtctcttgaagacaagccagatggatgagtcttgtttttttatccaacatgccactctgtgccttttaagtgaggtgtttagaccatttacattcaaagctaatactgttatgtgatgttttgatcctatcatgaagttattagctggttgccttacactttctagtgtgtgtttttgctttatagggtctgtgggctatgtacttacatgcatttttgtggtagcatttatttttctttcatttccatatttagaattcccttaaggatctctcataaggctggtctagttgtaacaaattcctttgtgcttgtttgtctggaaaagattttacttcttattcacttatgaagcttggtttggcaggttatgaaattcttggttggaatttcttttttttttttttttttttttttgagaaagctaaaaataggtccccagtctctcctggctggtaaggtttctgctgagaagttgacggttggcctgatgacattccctctgatctgccctttttctctagctgcctttaagatttttttttctttagtgttgaccttggacagtctggtgataatatccttagtgatgtttattttgcatagtatctcacagttgtactctggatttcttgtatctggatatctgtctccctaacaagattaccaaagttttcttgagttatttcctcaaatatattttccacattgttaactttttcttcttctctctcaggaataccagtaatttgtaggttttatcactttctgtaattccatatttcttgaagactttattcattttttaaaattattttttctttatttttgtctgactggattagtttaaaatactggtcttcaggctctgcaagtctttcttctgcttgggccggtctattgttaaagctttcagttgtattttgaaattccttatgtgaattttttcaattccagaaagtctgattgatttctcttaaagatgcttatttcttccttcatttcctggattactttagaagtttttttttgttgattttcaactttgtcttggatctcattgggcttactgcaatccctactttgaattctttatctgtcatttctgagtttccattttggttagggaccatttctgtagagctagtgtgatcctttggtggtatcactacattcagatttttcatagtgctggaattcttacgctgcttttttcttatctggagaccctaacacttgtaacttctgtaattattttcatgcaggtaggattttttctttctttttctttccctataatgttattatatatttttttctcctttcccttttcttcccctcccttcagaatgtgactatagagaattctgggtagggtctttgactttgtttctttagtcctctgtgctgcttttggccaattttattttgggctgtggcatttgacctgcaagcctgtagatggcacttagaggtaagagctaactgcagccaacatggcttagtgtataccttgatacttgtttactggcagaagctctttgttgccacaggctatggccaattcatggaatgtaccatggtctgagctcactgcccagccccagggtcagggggttggcagagggcaggaatggcagggccagacctgacaggtccacctacaggtcccctgatgacagacacaggcactagtgccgagggagaatgcagtgggtggccaccaagggcccagagatgtgcctagtagtgtagctgggaaacctcctcagccccaagttctctgcacagggataggggatggtctaaacttctagtccaggagagtaggtgctcaagatgcctagagcatggagcagagaccccctgcactaagatctctgcataggaggggtggggtgactcaaactccagaagcaggcaaggaggtgctctgaatgcctagggatcttcctgggtatggagcagagagagctctgcttcaccataacgttatgtccaggaggagtgcggtggctcaggctactcaactaggcaaatggttactctggatgccagagatgtgcttggagatggagcagcaagggccctactgcaccacaatctcaggagaacagagtgggttacccggcaatggcacatgcgaatctgttccaggttgccaagctgaacgtgactgcaagttttgcagcccaggagaaactgcagctgtagcggctctcctgctgccccaggcttgaaagtggggaaagcacaattctagccctgttgttggggtactttccacagttttgactgtgaagcccctatcccattccagagcaggtgttttgatctctggtccaagactgacatgcctgtgcagccacactgctgggtcaccaaggaatggctgagtttttatgtgcccaaatttaaaacattgtcctgctctttttcccgggtctggaaaaatgccttcagctttttccgtcacagtgactccaggccactccccaagttagctccaggactgggagaaacaaagtgctctcccttggcctaggttgcttggatccccagtggaagggtgagtcacagagggaggctccttgcctctctcatgcactggggcttcacttaacttttatcagctggatgccgtcagtggggctgtttgctggccttctcctctctgggatctggagtgtacgtcatgattccagtagattcctgttttccttcttgaattaaagctcacagagtttatctttatctgctatcttgctatgtccaagtggctgaggcgtgcagaaagcctctaacccaccctcttggggaaaagcaaaaagtctatttcttccatttcttttatgcttagaaaattcttcttcatcttgagactagataaccacttacacatattttctagttttttaattttatattggactaatacatataaattttattttgttatgaggtgaaaattaaattttatgtttcttcagagttaattattgttgcactatttgtcattttcctgtatactttatcatatattgtcatgttcaagtattctgtattaaatttttataacctaaaataacctgttccttgcttcattatttctttggtgtttcatttgtgtacctattccatatgaattgtagttatataagtcaatttctttagacaaacctttttcttgaaggcactatttaatatgttgcacagaaaccttctggttcaataataccttggctcacctcatccatttttttaaaggaatggtgtattatttctaccttcacattctcttttcagcccacctaaatatgacaacttacctttgaaaagtaacagatgacctaattcctaagtacagcaaatgttcctgtctttctgaaactttattttcccttcacttcttgtagtcttgcttcctttttttatatctcttagtattccatctgaatgtcctgttctgcttttttctgtcctatgtatagtagtaccctaagattctgccttcacttatcttttcagtttttactgaattcctagactattctttgctttctcagtcttaacaatatcctttctatgaatgattcccatatctaccttcatgaacttgcaaagctgtgttatcaaatgcctatttagatatcagcatgtcaaaataaaacccattgctcctctgtccccattcccattcttttcctttatatcagcatctactcagtcagccatagagaaacctcaacatcgttgatttctcccttgacccaagtggtaaaagctagttccctctggaatattgattctctttatatgtctgttactactaccttagctgatgtccctcagaagctctctgcaagctcaaatataacttctgatatttccaaacatgcttattctttgaatgtcttttctgctttataataattaccgtaactttagtagaaaagtttatgtatctggctcttgtaaccagatagtgatgtccttgcagattggtacggttttctctcattgtgtctgcagcttttcataacagtggtgatcagtaacttttttgttgtactttaaaaattgtttagcagtctgtagtctcaggcatttttagttgattctctcattgctacccgaattgcctttttaacattatgctaattattttattttatttttaagttccagggtacatgtgcaggatgtgcaggtttgttacataggtaaatgtgtgccatggtggtttgctgcacctatcaacccatcacttaagtattaagctcagcatgcattagccatttttcctgatgatctccctcccttggctctgccccacaagccctaatgtgtggtggtgttctccctgtgcccatgtattctcattgttcagctcccacttatgagtgagaacaagcggtgtttggttttctgttcctgcgttagtttgcttaggataatggcttccagctccattcatgtccctgcagaggacatgagctcattcctttttatggccgcatagtatttcttgggttatatgtaccacattttctttatccatctatcattgatgggcacttgggttgattccatgactttgctattgtgatagtgctgcagtgaacatatgcatgcacgtatctttgtagtagaatgatttgtattcctttgggtatatacccagtaatgaaattgctgggtcaaagggtatttctggttctgtgtcttacagcaattgccacacttgtcttccacagtggctgaactcatttacattcccaccagcattgtaaaagtgttcccatctctctgtagccccactagcatctattgtttcatgattttttaataatcactattctgactagtgtgagatgctatttcattgtggttttgatttgcatcctctaatgatcagtggtgttgagctttttttcatgtgtttgttggtcacataaatgtcttcttttgagaagtgtctgctcatgtcctttgcccacttttgaatggggatttttttttcttgtaaatttgtttaagttccttgtagactctggatattagacctttgtcagatggctaggttgcaaaaattttctcccattctgtaggttgtctgttcactctgatggtagtttcttttgctgtgcagaagctctttaattagatcccacttgtcaattattgcttttgttgtaattgcttttgatgttgtcatcatgaaacattgcccgtacctatgtcctgaatggtattgcctagattttattctaggttttttatagtttggggttttacatttgtctttaatcaatcttgagttaatttttgtataaggtataaggaaggggtccagtttcagttttctttatatggctagctagttctcccaacaccatttattaaatagggagtgctggccagatgcagtggctcatgcctgtaatcccagcgctttgagaggctgaagtgggcagatcacttgaggtcaggagtttgagaccagcctggccaacatggtgaaaccccatctctactaaaaatataaaaattagcccagtgtggtagcacatgcctgtaatctcagctactcaggaggctgaggcaggagaattgcttgaacttgtgaggtagaggtttctgtgagccaagatcatgccactgcactccagcctgggtgacagagtgagactctgtctcaatcattcaatcaagcaatcaatcaataggatgtccttccctattgcttgtttttgtcaggtttgttaaaaatcaaatagttgtagatatttggtcttatttctgagttctctattctgttccattggtttatgtgtctgtttttgttaccagtaccatgctgttttggttactatagccttgtaatatagtttgaagtcaggtagtgtgatggctccagctttgttctttttgcttaggattgtcttggctctgtgggttcttttttggtcccatgtgaattttaaaatagtttttttctaattctgtgaagaatttccatggtagtttattgtgaatagcattgaatctataaattactttggccagtatggccattttcccaatattgattcttcatattcattagcctggaatgttttcccatttgtctgtgttctctcttatttccttgagccgtagtttgtagttttccttgaagaggtccttcacttcccttgttagctgtatttctaggtattttattctctttgtggcagttgtgaatgagagttcataaatgatttggttctctgttgttgttgtataggaatgcttatgacttttgcacattgattttctatcctgagcctttgctgaatttgcttatcaacttaagcttttggactgagaggatgggattttctagatacaggatcatgtcatctgcaaacaaagacaattttacttcctctcttcctatttgaatgctctttatttttttctcttgcctgattgccctggccagcatttccaatactatgttgagtaggagtggtgagagagggcatccttgtcttgtgctggttttcaaggagaatgcttctggattttgcccattcagtgtgatatttgctgtgggtttgtcataaatagctcttattattttgatgtatgttccttcaatatctagtttactgagaatttttaacatgaagcgatgttgaatttttttgaaggccttttctgtgtctattgagataatcacgtggtttttgtgtttagttctgtttatattatgaattacattcattgatttgcatatgtggatccaaattatgctaatttttaagctaaaattctttcatacttattatctacagaaaaaaaattcatgctcttgtcatgttagtaaagatcctaaccaatctgatctcatcttttttttccagaagtcctattatttctctgattatatattattttttggctacatgtgttccctacatgtgttttcttgccattgctatttttcctctttagtattaatgctttctaaatttttattaatcacctactatgtgcaggtactgtcctaggctgtgttggaaatacaaatggataaaacttgagtagcacttttttggagatttttcccttaaattttccattatgaaaaacctattcttcaaaacttaggtaaagctttttcttatctatcaagtctccttacatgatgccagcacagattaatccctctttgccttcaaagtacttttaatatctgagttataaaatgttatcacaaccctctttttttaaaaatcaatacctgtgtcctcttcattcatattgcttaatggcaggaattgtcttttgtttaaaccactttattgagttatgattgatatacaaaatgctgtatatatttaatcggaacaacttgatgggtttggagttaagtgtatactcatgagaatgttaccgcactcaatgcttggaatcataagagattctgtcttatcactgtattccctctttctcttctccagtgcccagcagtgactttaaaataattgatactcactaaatgaatgctgaattgaaaagttggttcagagccaaagtagaaactgagaaggattagccagagagttaggaggcaaatcaggagagagtcatattaccaaagcccagaaatgtgtttcaagaaagagggcagtaggtgatgtcctaagcttcagatttggaagaagcagtgcagactgtaaatagattattggatttggcgattaagaggttgttggttatcttaacaagttccataaagtagtaagggtacacatcagatagcagactgagaagtaaattcttacccttaaatataatttttagctgatatatttatagaaattggctggcagacacattgaagatacatagtctaaataaagatctagaatcttgcatatattatatcgatttagggaggatccatattttttgtaaagttaaatgagtgggtaagtaggcttgacattcttttaagaaaatttagaaacctaatcactattttcatctcattagaagactactgcaactccacatagagatcacacgatcttttcatcaaagttagtgatattttgcatggcagaaattattttaacctggaaaacatggctccttctactttctatccttgttaggctggtaatacattgataatatatatctaactatatgaaatgaatgaattttttaaaatatccctgagtaattgtataaatgacttgatttttcacatactgtatttgattatttggaagacatacttaacatttctgtaatcagaatgccttttagaatagatcatgtgttatagttttaactgacaaccttttttaccttggtgttttataaaatgatgatgcagtcccaattcgtagcatatgagatttgataaaatacagtaatatagtaggaagcattaaagtttagagactgcaaaatattttagttttaatataattattgttgtgctacactttttggggctataggtgatattttctctctctctctgtttactatgccaatgggtcatgcataaagcttatcttataatatgctgttaagtgaaggtgggggtgggaatggggaagaatgaatttatagggaacctgttttatgttacttgaaataatgactttggtgtatgcagaacaaatcttagttaaccataattttcaccaattttgtagaaacattatgagtcaatgatccatgtaagggaaaaatttctgatcttgcagtcaagggtacattggctgattggttcatttttttcacagacatgtattgtgtatctattaataaccatgatacctggcaatatactcagcactgtaaacaatctttcattgttctgagcatgtttcaacaacaaagattaatagtcaattcacagtgcctgaaacctgctctttcttcatgtatgttgtccaattgagataatatttgtagtttctttaatgaagaagtggcctattggagagccgtgtacttggtcacagtaagcacccagtgaatgtttgttgactatcgaatggtatatgttttaagaggttgactaggaaatggatgggcttatagttttagtgataatatgagaaaggactggcattgtagctaattattattgaaaatagaatatacattgagaactgcaataggaataatggatgtttctcagttcattttgggcattactaaaataaattaaaaacataaaaccttaaagtttctcaccatagaaaatgtcaaattattttctattttcaataataatttgactttgaaaatatttttagagatatcatgattaatcaaaaattgtagaatataacaagttcgcgtaaatcagtttcagcaaattgacagtcttgtctttgaaatcaaataattaagtgaaaatatatctgtgcttgtgttcatttattttagtaatatctcaatacctaatccttgaagagtgaagcaacagtatagtgagggggaaactgcaatctgatgatgcatacctttttcctctggtaactgaaggttaaatgggtagcaagcagaatgccttaaacaagattggtatattgattaaaacgctgatttaacagctcgcagtttccccttggaaacctggaaaagataagccagctgctgtctaagagtgctcagtgtccactgagagtacactatctatcatcacaatatggtgatgagaggtgttttatgtttgtgttaatttcccccactaaatcagtaattattacaatcctgtccctgctgtttaccctgcagctgtttttccatttgtcgagagagcgggtgttctctgaggaccgcacacgtttctatggtgcagaaattgtctctgccttggactatctacattccggaaagattgtgtaccgtgatctcaaggtaaaaaaaaaaaaaaagtaatcaaaatttgtttttgcagagactatagggacaaacataaagtaattacaaagttatacagttttgagaaaagcagatttagttgggaaaaaagcactatgtttaaaaatttagttcactacatttgaaggaaattttattcactaacatgtatgtagttgatttatgtgtgagtttttgatttgcaaagcaatttctgcccgactgcttggatcaaataaaaatgttaaacgtgattaagtcaaataaattcacaagttacacttaaaacaagttttattatgtttacagaaatgttttatgaagaaacatagtaagactattggaaggaacatattcattttgattttagcattaactttgggtggttttaaatacctgaagcattttaatataataaccatttattaatgtgcctcgtgttttatttatgaaagcactctattttttctgttggtaatagtgttttgactgctgtaagttccattatgatgagacccttagggtagctcaggattggcaaactttctataaagggcagataaaataatttaggctttgctgttcgtgtatagtctcttttgtaaactactcaactccatcattgtagggtaaaagcagcctcagatagtatgtaaatgaatatgtttggctatgttccagtaaacaaaataggcgatgggctcaatttagtccacaggttgtcatttgttgatccctggagtaactcatacaaggtaatagtaattctcatgacagtgttatgaattaggttggcgacattaaaggaatttgtaccacgacacattttgaataaattctagatgttagtctttcttttgtaagaagcaaattgtgtataaaatttgacacagaattgccttattgatcaaatactatttcatgtaacgtaatgattggtagaaacagaagttacatgaggcttttatgaaattctgttttgtttgaaatgaggtatatagaagctataagatgttgtatgtaggaagaactgaactatgtacctataaaacatctagatcagagatgaccaactgtctaagtgccaaaatgggctaaagattaatacaaattaatagtttgattgtatttagcctgaatctttttataactaggaatgtggcagaattcagcattcatgtatctgcatggccagataatcctatactgtctaaatgtcttaaatatcaatttctttaaaggaattagttatgtggcatgacaaaatgtgttaactttccaaatatacttagaagtagttagctctgctcttcctgagtccacttctcgtattcccactacatgttttatgaatcctatttgtaggggtgaaaaggggaaggatagaagcatggaggcttagatttaaggaaattataacaattttgaagtaataggtaacatccagaaagcttaaattcaaaagattgaattattagcctaaagactgctaaagaaaagaatgttcatttgattgcagtattgattatggtcttggtcagtatttcttctttaatcatttctcatcaaatgaatcaacatattgagggtatgtgtgtgtgtgttttcagatggagtctcgctctgtcgccaggctggagtgcagtggtgccatcttggctcactgcaacctccaactccctggttctggcgattctcctgcctcagcctcctgagtagctgggattacaggcatgtgccaccacgcccagctaatttttgtatttttagtagagacagggtttcacggagttggccaggatagtctcgatctcctgacctcgtgaccgcctgcctcgaccttccaaaatgctgggattacaggcatgagccaccatgcccagccaacatattggtatattgaagctcattaaatgagttccactgccccattctttctgatgatggaattagactaaatttgtcaaactgcaatataaagtacctactttatatatgaatatcagtcaattagttaccacgtgcacagttcaccaagtttactagacaattaagtggtctctgctccctgagtttatttcttaaaaaatatagccttaacttaaagacctaagtatatagttagcataggacagaaactgtaaaggtacacctagaaaaatccatgtaacataagaaatcaaacatccaaaacttacacacatgttatttgtatccacagtaacaggattatttataatacaatgacatattttaggtaagatcacagaaattttgagctggtctttaatttataggtgatctccttcaaacctagaagcctagtaaatgacttactaaaagtaatgacctaagttgatagcagtcagggtttttggaactcatgaatcctagctccttattgaatgttcttgtcactatatcattctgacttctagagttgaaatgaaattatagaggggggatgcattggattaactttgggaaatctttgtaagcctaaacttcaaattaaactgcagaaggtaagagaatgagtgtttcaaatatatttataccagatgtattaaagaacattatcatgaactgatttaggtacccactttgatcagtctcagatttgtctctgttctcattactaataaccttgactttgttcaaatgcaaatccaattgctatgcctacagtagcagcacttctcaagtaaatccatacccgtttgccgctgtctcattcacattggaggcagagccttcttttatgtgcaggttaacttaagatatttttatcagttcctgtttcctaataaattagtgtttatagcaacagaaaaattgttgaagcctttgttgtactttagaaagtaagttcatttaatttgtcaatacacatcatgtaatgaagttttatttttattaaggacccaaattccttgtgattacttaaggaaaactgctgttgcttcatgattgcccaaaatttcgaagaaatctcttcaaagacttcttcagtagtccaaattatatgttaaaatcttcttttctgcttagctcttattttacaaatacaaccaatgaccatggccatctaagcacagcgtaggctgaacagggacatttgcaaaggtgaatataactatattggaaatcattaagaattaatttcttgctagtttatgggagaaaataatacataagttgttgctatttcctatttgtagaacacctaatcttgttttccacctaatgtgagaatagttaaccatttacagtattaatatgagaaagcaccaaataaatttaggtactttctaacactcagtaatggcacgaaggggtggcttcagagagttttatcatagccctcctcgtcctcatcagctccctaatgttcacttcaaataaatgcagtttgggtggggaaagcatgcttgctttgcttgctgagcttcaagacactttccccagctcccacttctaactagatggtcactggatttccccctatatagaaatcttaagccactgctcttcattccttccacttctaaaataaaattgtactggtattggactatgtaccttattcgtaataaatttgtaaatagcctggcaacctatttggggtctgtttacatgatgagtccttttctggattcagaggttgaagtgaagaaacgtttttcttttggaatttcagcattccatggtcattcagtttctgcaggttagcttgtgacattttggcactggatgcccgtaaacttaaacttgcaatgtgcagagtaggaattccttactaccttcttgggcctgagtgagtcttggtgcctaaaactgagtttgatgtatgtgggctaaaatgtggtgtaagagtgagtaacaggaattgtttatttctattgctgcagtagtcatcggagcccttaggaactgctattttcattcctttgtttaatcacaatgtcagtcgtttaattaaaatgataccatatatatggtgtttttaaactttcaaatatttagtctggcctacattcaagcctagcttctcagactgggtgctacaaacaggttacaaccatgcctcggcctgcaaagtgttcagagaagcttccaggccagtgagttctggcttcaagcatcttgtccagttaacctggtatgccccacaactttaaattgttattttactgtgaaatgtaaaaggttgggaagcattgtattaaagacagctaggatttttaaagtttaattttatgctagccatcagcaagaacaggaggaaacatagtaatttttgttacaattttgtgcccactaagcacaggaaaaaagatttaaaaatctaccatttcttcatatacacactgaatcaagaccctctgtcaagtaatgcctgtccacttcaactgggcaaaaaatgttacccttttttttggtggaaattctatgatgtattatgtctagtgtttttttttttctctctcctcaaaagcatgaccttttagataacaaccctctgatagaaatagtaagcattacttagatttttaatatacaatcttgtttcttatgacttcatatttgacttcatcactacttttgttagtggatgcatccattaagcataagcatgctgccctactctccatcttggaaactgagattggctgtgaatattaaacagatgcatgtaaagtttcataaatttagagtacctaagcagtcagtgacaatatgcattacatattgtctggctaacaaagggaagaaggaaagtgatctagaagagaagactaaagaaagatcatttgtaaatatttttcttcctcctttacgcagtagaaagattcctaaaaatgtatgactactgtaaataatgtaaatactacttacattatgttagtgttaaatgaaccaagacagtgatttccagatgttactgatatatctaggccattgatatgctttggaaagacttacaggtgtttctgtgcattctgcaggtttacgaatcaccctactaatggtccttgtattttacagaaactctgttaatgcatcctgagtaaaattatcatgtattgtataacagaactgtacattttattatctcctgatttatctttatacaagattagatttggggatattattttttaagctaatattttggtggacaagttttagtcattcatgctcagcaaaacaacgttttaggatggtgagagaagacaaagtaattgatagaagaatgtggacactacttcaaaataactgggaaattatgaggctgggcacagtagctcaaacttgtaatcccagcactttgggaggcagaggtgggaggactgtttgaactcaggagttcgggaccagcctgggcaacatggcaaaataccatctcttaaaaaaaaaaaaaaaaaaaaaaaggaagaaacaaacaaaaactagcagggcgtggtagtggtgtgcgcctgtgtacttaggaggctgaggtgggaggatcagttgagcctgggaggttgaggctgcagtgagctgtgattgtgccactgtactccagcctaggcaacagagcgagaccctgtctcaaaaataagaaaattataaaatatttgtgttttgtttttttgagacaggatttcactctgtcacccaggctggagtgcagtggcaccatctctgcatattacaacctccccacacacctcgggctcaagtaactctcccgcttcagcctccagagtagctggcaccacaagcgcataccaccacgcacagctaatcttttgtattattggtagagacagggtttcaccatgttgcccaggctggtcttgaactcctgagctcaagcgatctgcctgcctcagcctctcaaattgttgggattacaggcatgagccactgtgcctagcctgtgttttgttacttaaaataaattattgcatattgaaaagtatttttaatgcagtcattgagccaacagaaatgttttatggggttccactcttgaactttgttcttttctttaaaatacagtgttttttagaagagcccacatcatgacaatttacaaataagccattaaactcttcatgttttaagaaaagatgagttcatttattcaattcttatggtatgttaagtttgcatttagcatctcatttctcaaaactgtcacattggattgttactgttatttacttttgttttatagatgaaattgaagcacgtagaaattaataatatgcccaaggtcacacagtgaataagggataaagctcaaattttaatatgaaccctctgacttgaacccatagtcttatccattttgctctctactgcctcccaggcagtatgctaccagtccccatggccatgacccttaccccatctctctcagtcatcccttaggcttatcttatttcttactatatcattgtaatttttttaaaagctaatttataaaacaagtagggtaaccagctgtcttggtttgcccaggactgcccagttgtagcactacacgtcctgcattctttgaaacccctcagttctgggcaaactgggagttggtcaccctcagcctattccttacccaaacctatccttgcatctcatttcattcttcttctcacaaccatgatctgaggctcagagatgagatacgaggttacagaattagatgcaagtcagaattttacacacacgtacacacacacggagctaggtattaaaaagcagtgtttatacattttggtttttctgtatccagccacttcaaaaatagctttgtcaaaacgtggagaaatagtgcatcctgtctgtcatgtttccatgaagactttcccatgcatacaaagcatgtgaggagtattggcacattacacaccaaactagatgggaatggaatggtgtaaaaagtacattcacattttgttcaatattttgtattatttggaacttttataagaattgttaatgtattatattagtaaaagagtattcactaaagatcttcagcattttatatatttataaagcatatttttaaaaattaataaaagggcatatacatttttattcagtaaaacaacagaagctttagtatatacttaacgtttctcattatggcaaagtgggagggaggaagaagagaggttgtttgaaagaggtggaaaaaagagagaaaccagaggctgagaagagacagaccaaggcagaaagagaaaataggacagttgaagactcttgatgtttctgattggtttcaatatacaagacttattgtcatttgtgcagattgggtttggtttctaggttctggctggtagagaaacaggaatatacaagataactgagtttggataaaataaaaaattttaatttggtggggcatggtggctcatgcctgtaatcccagaactttgagaggctgaggtgggtggattgcttgaacccagcaggtcaagaccaacttgggcagcaaagtgagaccttgtcactataaaaaaattaagaaattagccaggcatggtggcacgtgcccgtgttcccagccattcaggaggctgaggtggcttgagctgctgaggcagaggttgtggtgagctgtgattgcaccactgcactccagtttgggtggcagagtgagactctgtctcaaaacagaaatttttttttaaaggttcagcagtatattttatgtgttcattcagctttctgtagaaaaaaattgaagccagacttacctctgtgagacatgctatacatgaaatgtatatcaagcatttggtttagttagatggcacattgaagtactataaaaaaggacttttgtctgttctgaactttgcttcagtgaacacaacttgcctaactgtatttagtgtctggtttataagacatttgacaatatggcagagagtataataacatattttatatgactgatatgtttatgttctaaagtggagatctgttttaaatttgatattaacttcagagtccaggtacattctttcaaatgtcatcacattaaggagtagaataagaatctactcctcaaataaaagttaactatcatttatcctgttaatatacttttcacattttgtatattttttcagtatgacagaagaaatacctttaggttgtgtctacatgactaggcaaagttttatgggccctgaatacataaggctgtatgatcataactcagaactcatctgtatctttgtttgatgataatcataatcttaggttcaaattagctcgaggggaactggctggttacattgttatttctaattgtgttggctttgcacaaattcctcctctcttacatttcataattttccgcttgaggcacatgatcctgttacttggttaaatctttaagattttctttggtgttttgaattaatgggttcaaagagggtccaactttataacatttatgctatatatttttattaactgttgaatgtttgactttgatattctttttctttttatatttaaaagggttggtatttctttattacaaagaactgcaaaagaggatatcgccttaccttacaaaataagatttaggtttgatttacaagcaccaccaaaaaacatttctgtaagtgaatattttataatagcaatagattcccaggagaaattgttgaaaccatctgtatatatctagaagaagatgctcatctctttgggattgtttagatcacattttcttttttaaaaaaagaggattgatgtttgctttgaaaagttgattaggctttaatttcagaacttacaaaataatggctcttaaagctatatcacttattcccatcggtttaaaaatagataattttatcatcgtgaagtatttgataaaacatgtttctttttacacgtgaagcaacagagtttgtaagtactgagcgttctattagctacaactatgtcctgtttccaaaataccttactcagcattcagtagttttttaaaatggtattttcatgttgttgaagactatagaacaaattatgtcatttttcttaatacacagttggagaatctaatgctggacaaagatggccacataaaaattacagattttggactttgcaaagaagggatcacagatgcagccaccatgaagacattctgtggcactccagaatatctggcaccagaggtaggcttcggttccattaataggaaagtaacattgacataatgatttgcaaagtaaaccatttaagcattaaaagttaactgtagtatctactacttttatctatatttcaacctgaatcaaaattttttggctcttaatttgttataatggggtattgtaggatcaagaatatactgaaattaaattttataaactataagcacaaaggtactagctatagtcagttaaatcaatttttatttcttggccatatccattttatcttggctatacccattttgattcatttattaaaatagaataattgatttcagcaagagtatttatatttataaaccatcttggactttccttagaaacaacagtggtttttaatttatagtattgtgggtttatttaaaattattttattgggaaaattattgaaatgacagtagctacattttggaatttatgtcagaggaagctccaaactggtaacttccctgtgctaagggttccacaataatttattaatttgtttattcaacaaatatttattgtgtatctgctgtatatcaggtacttttctggatgatgtggttacaggcacaacacagaaaaggatcctagtctcagggaacttaactttcagtggagggagacagaataaaaataaataaataacataatgtcttaagtttcataaacaaacaaacaaaaaagcaagattaaatgtaagggtgtggtgtggctgttgtagatggtgttccagttactaatgctgtgtaacaaaccaccctaatacttagcagtggaaaacaaccattttatataaaataatggattttctgaatcaggaatgcaaatgggcacagcaaggatagctagtttattctccactatgtatgaggtctcagcttgaaagactttacagtgagagcatgattctatggctggagactagagtcatcaggaagcatcttcactcacatgtccgacagttctgctgcctgtccactggtaccttatttgggctgttggcaggaacacttacatgtagcccttctctccatgagtctggacttcctcataatgacagtttcaatgcagtcagacttctttggctctgagccctaaaagcaaatgtcctagggaacacattagaagctgcatggtgcctttgtttccacctagtaaaccatcaagactattaactttttaaaaacttgatttcacagatatttttataattggagtacaattcatatgccataaaacttactcttttaaaatacacactttggtgatttttaatatgttcacagagttgtacaactatcatcgctgtccaattccagaatattttcatcactccagcaagaaaccccatacccgttagctcctcattcttccttccgccacaggcaaccactgatctgctttttgtctttatagatttacctattgtagacagttcatacaaatggaatcatacagtatggagtcttctgtgactggcttctttcacttagcataaaattcagtgttcctccctgttttagcatgttatacttatttcattcctttttatggctggataatattccattatatggatataccacattttgtttatttgttcagcagctgatgtacattgggttgcatccattttttggctactatgaataatgctgctgctatgaacatttgtttatgcatctccttttatggcctattttcagaagtcacacaacatcatttctgtcatacccttactccctgaagcagttgtaagcctgcacaggttaaagtggtagagacagagaccacacctttacattacagaagagcatgtgagatgggagatactgccacagccatctttgaaaaataacatctttcacagatactatgttcagcgaaagtgatggttgatggaaagtgatggtacctgttgcaaaggtaaaagggaagagctttccaaagagagcagctggtgctccatttcccctcaaactccaatacagttattgtggctataggcaaatagggaggtgttaatatttgatgtgtgagggtaactatttaatgagcatctactatgtgccacctgctgtgtaagtgcattacagctattatttcatttaacatttggaataatctttgatgatagatagcaaatgcaattttttaaaggtgagggatcataagatcagaatatttaaatgttatctgtacacagctaagaggtggtagaagtgtaatgaagattctaattagtgtgtctgactataaagcccacttttactttttaaactacatacgtcctggcctcaaaaaatcctaatttgaagaccacttacaaatataaataatcgtaatttttaaatgaatgctttgtaaatgcccaacaggaaaaggtaatcaaaagaaattaggaagtaaaataaatccccaatgatactagcattccttaaacataaagtaactcatgctggtctattattctaatacttcttttcaactagggattacatttacatttcaacaatgttaagttattgtaaataagtgctactatttaaaatacaataaatttcatactattattttcttgccaaaaatataattttctctctttaaaaatttgtagtttagaattctctatttttgtggtttaattaggtaaaactttagtaacactgtttcttgtttattcaaataaaatattttctagaatagaattgtttttataaatgtcacaaaaaattatttgtttctctggagttcagttacccctgctataaatttgctatggaagaagatatgccatatttagaataacaaaattaattgtgtcacaattagggtaaattatttctgaagaagatgaatacatctcatttaagaagcagatgatctgagaaacaaatatattatttcatatgcagtgtcatcaactgaagaacaaattaagaatctaatgcaagaagagtccacttgtttctgaatggaaagtttatagttgccacaaaattatcagtttctctttaaagacaagaaaacatttctgtataccttttttaatacttcaaaagtctggtctttaaaaacagtttgtatacccatccttggtggatacacattgattcataattcaaatctggacaccatgtttttatagggaagagtgattattgttgttattatttgagtatgagaaatcttgaaacaacttacgaaattgtaacttttatattttaaatgttgtgtcacatattgcatttttaaactttgactgtgtttacccttaaaaaaataagaatttaattcctttattctggtcttcagcgtggaccattttactgagggacactcattcattcatcaaagaattatttattgaatattaagtatcaggcattacattaggtactgggaatacaacgatggtagaagatgtttttgccctcaagtggcttgctgttcactgaggtgataagacatggaaaacagttattactgtgcaagaaaataactgctttactagttccatacagtggagtggaaggaaaaggaaaagtgcttaagcctgcagggagggtccggcagtggaaaaggggaagcaggaagagaggaggctggacacatagatagggattgaaatgtaacagttttagatttgatcctgtgggctagggaaaattacttgtgaattgagagcaaggcgatactgtgatcagatttacatggtcagtgttagggagcgattggcaggagctgaagccagcctcttccttttacctcagatggtgtctcgcactttttttggaccttgaaatttctagtacattaccattattaatgctgggcttttcgtgacagtactagaagtagtagttgtgtatcagatctgtaatacattcttgactactgcttctcttgtgaatgactcactgtcaacattttcccctctgtctttacagaagatttgtttacacattatgtaggaatcttgctgcaacctatacttcatctagcaatagtgttccttcgccttttacgttgttttaatctggtataaagacaggtgaagggtattttgaagatacttcacaaagagtgttagaaatcagtttaaagccagtttattaaatgtccaatgtcagatacatggcaggttttaaaataaacttgagttttaagtgaacttaatttgtttcttatggcaaattagaaaaacataaaacttacagtataaatatgccatttgttgaaaaaagaatatttttaaggtatttgttctcttatctcttttgatgaagaatgcagcttacaatgcagttttccaacttgggaagcatttaacaatactgctaatgtagaaaaggctagctttgttttgttttgtgtttttaacaggttacagcggttcagttctagctggcatatgcactgtgcatttagtgtgctacatcttgaaaactgcatttgtatgtatagttttaaatgaatgtacttttgctcttttgtacattcgaaggaaataaacttatagtaaattatggaccatatgatatcttgaggggattttgtttttataatctgtgctgtattttcacacctagaaattataaaagaaattagaaatcacatataaactcttactgctaaattttattatttgatttggctcctattgaatccaaaccattttatgcagtgctaattatttagagtctcagctttgctcttgagttagcagtacctgatccactttccaactgtaaaacagtttgaaaatcaaatgtagcttacatgcaagacccaacaaaattaaaagtgttaagtgcgttttggcagttcacttttattatgcccagtcctcaaatgtaccagcagataatcatctgaatgttagttatttttcacatgcttatgtgatcacacaaaaagtacatgctaaaaagaggcagatggtgacagatggggaaggttgaataaggtggttttggaaacctagagaaatgcacttctgtaatagtgtaaaaataaaaattatttgataatcaagttagaactaacaaagattgcaaaaaatgacttgattgttgggaaatatatctagctgtggttgctattgagaaaaaaatgcatctaattttatttcatctaaatgtaaaatgatttgtttttccagtggctgaagtgcagtatttgatgcattctttttagttttttagaaccccattcttagaaaatgttttgcttgccaaaattttcctgattttttctttgaaacctactatctttaatatcttgcatataatgtaacatttttaaaatagctgaaatagatgagaatattttgacaactattttgatacaaagatttgctcaaagtcattgtgttagctcatagtacacatggagattaatttctatataaattaaaaaccaaagatatatattaacttccacaaaaggtagtaaaggcagtgccagggcatggactagtgttgtaggtgtgggaaatagttagaagctaacttgcttgaaatgtattaaacagaattttctttattttaaatccaacaaagaataaatgtaaaatatgtcattttgtgggtgctgccaatgttgtttttaggagatctgaagagaaatgaatgaggctaaagttacatatgtttgcacatttaatctgtaggtaaaaatagtagcacatgtagttacattctgattagtctttgcacaaagtcctactatattccagcagattgtaaaactagtcttagaatctctatgctttttgtgaaaagaaagagttgttttagtagcctttctaaaattgtggacaaccctaacattttatttacttattgataattcatatgatatctctccacctggggtaattttgaaaaccttcatcttcctgggaattcagaaaaggtctcatcaccatgattaaagggaacattaaaggagtagagggatgagttcagatagaagctgtctgctctatagttagaattcatgtttaagaacttctaactctcatatgagttggcttactatttagttgaatatatttaatttctttctatagtatgttgctattttatatgattttctgggtaatattaaaagccattccattttatctcataattggacattgtttaaatatgaactaaaatggaattaacgcctctcaatgtttataagtggcatcttttacttacttagaggtctgtcagttcttaaagtagctatttttcgccctaacttcttttcaatgttatatggtcttttggctttaacagaatatttgcattcagtacttcggtgtgattctagtttaagcatgaagtttaattttaaattctctgtaccatgagaacatatacaaaactaaccctaactggaaacactggtgattacctatagtattttacaatggctattgttacttgggttatgaaggctcagtttcttggaatcccataatgtctattgcttcagaataaaaaagaagtatagaaatttcttggaagatatgtgtaagtatgatctaatcatcattattgtatccatttagcctttctcttgtcaaaggatttttcctgtgctagccagagtttgcttttgaaagtacgatgttaactgtatacaagtatttgtgtgtgctaggagaggtggccataaagcgtacagcattctaattcatagcaaatggcattgacagttgctgtcacttaagaactattaaagcagttgagaaatagttataaaatatatatttatgaagaaaataccaagcaactgtagaatttataatcttatgtattgaaatggatacttttcctgaagctgcagtttactttaaaatctgaatgagaagatttataggtctttttttcttagcccatacctgtgatgttaagaatatctgaagggctcccataaatgataaatgatacagatgtatgtttaggtataaaacacacatctatcagttacctgaaatgtaaggctaccagaaaaaactttttttttgaattagtggtaaattggttcatccaagttcgcagtttactttcacagcataggtgtgcagacagtttgtttagatgtttaattttttcccccatctgttctgtcaggattattgattgagcagtaagccactccagggcatacatagcctccttataattgcttgccttgggtgcattgtgtggcctggtgggcaagctgagagaggggtccctttaacctcctagtaaatcctcctggtaaacaaatattgtaatgaatagttttttttttgttttgaaaaagcccattagccaaataaatatttacattagtaacttgaattggtagtatcatttaaaaatatatagtttctcattcaatatcattctttgaaattaataacaattcaaaaactaatgtgttttaactcacctggctgttttataaatgtaagtgtcttcatcaaatattgatcaaatatttccaggatatttaatgttaatttgtatctgctgtaacctccttgagtcttaggttttatcgtatcataaagtaaagcagtttctggctcctattagaaatacagccttgttttctagactttgtgctctgtttaagttttcatttgatgtgacctctcatcattttttaacaattacatttttttgatgttccaaatctcctctttcatctctgtttgggcatttgtgttaaaggtaggtataatgtacaactacatctgtggttacaaaggactgtaggggtagaggaaataccaaatgtctgctttcctatttaaagtttgggtttcatttacaagtcagtaatgttggttttatggaaaggagacagaagttatttcttcaagataaatctttcactggattttttcaggagcatattttgatctgcatttatatccaaattatatgagaaattaaccttttaatgaagttgaaatatgctctaccattgttgtacctgtccattataccactgtttatcatacctttcagccagccctcacaataaccatgaaataaattagccttttagctagaaaaaaatgatcagaggtagccagaaagaatttgcaatccttaagttaaaaaaatgtaaattttatatgttatgtatttatagaataataagtgctttgagtagagggagaaaaattgtcttcttaaaataatgtgaaagaggttattggattcgaattggttaatttggctgtgggatttccagagtatttgaaagtattgtgttttgaaataatttagattcaggaaagagaaaggatattgttttaatagtgggaacatatgtatccacatgtaggatactgtaatcattatttatgtatgtttcatcttatagctgtttggagataggatttggacaaaaatctttctaattgatagtgaagtctcttaggtaaagagggattttagttgttagggtgttttcttctcagcattgcttaagtttacatgtcaggaagacaatacgttacatcagttttgttcaatacaaagtaatacggcaaacagttctaattatagcattatgtatctgtagatcaattaaggcacgtatgttcagaggcaaaatcacttattttaagaatcgatattcattttacaaagctaaataaaatgtattttattttatcaaacagatttttttacaatgcagttttatttttcagttgcttacttctcttcaaaaataaaaccccccttttttatgtactcactttcccttctggctgcaaaccaggtatttaaaaaaaataaaggattgccagttttgccagctggggatgagaacccggctggtgaaatgtgggttcgggaggcagttaatccagcttttatgctttttatggttttatgaaaaaaaaaagaggttaaaaaccacatttggctccttttcgtatatgccactgttgtgttggtgttgtaggaatgtagttaaaggttacttagatataaatttttggttgttattagttaaaatcttgtgtcaattagataaaggcccaccaacagtgcattgtactaattggccatgagcgagatccttgaatcatcaaaagtcagtggtattttaaaataatacatgcagcatttcctttaacgtaaatatgaagtagaatttcttctgcttttttaggttattttttgttttctatttgttctcaaattactcatttcaaacaagtaaaaatatgacattctttgcgctgatgatgaaaactagaatttgttgttcttccagaaaatgtttttttgttagtttgtgatttacaaaacatttctagaaaagcataggatctaaacatgtgttcatatcttaccagtgaagttttcagttttttagccgtaaaacaaacattgatataattgaattaaaaatcttttcataatagaaatgcttattgaatagatcttttaagtaacatattttttcttataaattatatcctttgtctttaaataccctaccaaagtgcctttcatagtatttttaggtaatcataatgtaactgtcaaaaatatcacctgtaattctgtgagattattggtaaattttaaataaaagtcatgtaggagtaatcttccagaaaatatttaattcgaagcaagaaagtttggaacacaagtactgctttgtccttatcaaatgttctcctttgtaatcggttgtaagtgtttttaaattgataaattcatatatttggttttccccatctggttttccaaagctgagaggatcaaataaaataagctttaagattatcaaatatagttttaaaataaaatattcaaagttgcatatagatgaggaatattccattggatgaagaacaaatctgataaaaagataaaaccaaatttttcctggggcaaatggtaggttaccatgttaccatttgaacaggttgctccagcataggcaaacggatacttttgtatcatttctaactaaatttattttacgtgtaatatattttgggaaaaatttaaggacatataccacacagatattaagtccattttttttgctgtaacaggaatttttgttgtgaggtataaagctgtggctatcaaagtttattacagctcgtaccataagcttttatattcactttgtctcttaaatagttccagaaagagttgaaacatacaggggcatccaaaggtttttcaaagttattttaatggttgtcttgccctgtagacttctccattacattgcctttgtttactactgtctttcactgtttaatttgtattacttagttcttcttaaggcaagaatgtacagtgcactttatgtgctctataatcagcacaccctagctctgagttgttacttgaagtccacatgggtggaaccagaatgaaaaagtcagtaggcctaagaaaaaatatgtaaatatgctagctaacgtttttcatttgatccttatgtatattcatgtacttgggatttttttttttttgtacgacctgcccctttttttgtacactggccatttgtggatatatattgaatatttcacatatttgatgtgatttgtattttttgtaggatgcttcacagtttaaatgtcaagatctcagactacctaggctttgaaagttaagattcatttttatgtaaaaatcttatgttttatgaataatgctttaaaagttaacatgtaataattaatctttttactgatttcacttttaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacggtaagcctcaaataacgcttagtgaattactgatgaatgtggttaaaaattgagatatggaaattaattcaaatataactaactccaagaagcaatgtatttggtgtagacatcttcccactgagatcctgacttatttttaactgcataatatagaacatttaaaaatttttctcaactctttcctaacttggaaattttatgcagatttaccaaataaggattttgagagtttcattatccatattatgagtgaaaatttcttaattgctctgttacttgatcttgtggggatagaagaatcacttttctttctttcagtctctgggcctttgtatttcttataaaaggaatagacctatttttcaatactctcctcccacccgcaacctgtgttaacatatctaattgcatttttttttttttttttttttttttttgagacagagtctcactctgccacccaggctggagtgcagtggcgcgatcttgactcactgcaacctctgcttcccaggttcaggtgattttcctgcctcagcctcccgagtggctgggactacaggcacctccaccacgcctgtctaatttttgtgtttttagtagagacggggttttgccaagttggccaggctagtcttgaactcccgacctcaagtgatccgcctgcttcggcctcccaaagtgctgggattacagtcgtgagccaccgcacccggcctctaactgcttttttgtcatttgaaaataatcttttctatgcatagctgaaagagttgatggcaaaaaataattgtacacacttttaatttctgtttttgtagctacagctatgaattgaagaactctatggctcttgctgctttgttcaatgagctacagtatttttattcatgtttatacattcattcatatttataaattcataaatcatatgtgaaatgactattaatattaaaatgtttcttaatatgtgtgtttgtatatggatatatctgccttcccatctaggtatctgtgcatatcagtatttctctgagtctactcatttgaagcatagatgatttcacatattgttgaatattttataatacctcacatagagttttatgaaaatgttttacgtatggttgatgctcatatatatatatattatatatatatgagtgggttaatgagtgaatcccaaaaagttggatttttaagtctatctgagaaatggttttcattgtattcttctagcttttaaccttgtaaggaacatggctttatcttcagcagaaataagcaaacataataaaagagatattgtctttctgctttgtgaagactcattcaagaaacattttgtaatcctagctgcagatattatttatatgtgtaaagtgattttgttttcttcttcagagcactttcacagctattaattcccttgctttttcaggagccttgttgggtggataggggagatactattcttatttccatttcattgagttgaaaacaaaggcccagagagggttaggtgatttcttcaaggtctctcagaacattcatgcagaccaagagtagaagtcaagtttcttggtgcctatttggtatttcttatgtatcttatttacaatgcagcagtttctcagtttaagttttgaaatgtgttccgtttgatagcgttcttttacaattaagtaaggagcagcacccgatgataggtaactttaaacagagtggtgacttttatcttttttttttttttttttttttttttttgagagggagtctcgctctgttgtctgggctggagtgcagtggcgcaatctcggcccactgcaacctccgcctcctgggttcaagcaattcccctgcctcagcctcctgagtagctgggactacaggcgcctgccaccacacctggctttttttttttttttttttttttggtattttagtagagatggggtttcaccatgttggccaggatggtctccatctcctgacctcgtgatccacccccctcggctttccaaagtgctgggattacaggcatgagccaccgtgtccagccgacttttatctatttcattttttggtctaatatttggcttggtattcgaggcagtgaatatttatctcatcgttttcttattcctgcaggcaactttgaccaccctttactttgtggccctctttatataagtggctagtagaacaaaatgtacttgtggttttcatgtgtatgtctcattcatttttttttatttgtcagcccactccatgaatagcacatagtcggtacttaggaactattgaatgaatgtgaggcaaattcttagaatgttaaccgcctagtatgtattaatagaacaattcctaactgtttgttcaccaggaggttgatattgatctaatgagaagatgcagtattttcaatgatctaataatttcttttataatagatgtgtcaagcccctccactgctgcatcaaaatacagagaatacaaggatgagtgagatgaaccagtctctgctctagatgttcatagaataatttggggcacaaaacatatactcacagatgctcaggtcaaactacatacaaagtactgttgaaattattggctttgtctaggggattgggggacttgagctggatcagaaaggagtttgaatttgcattggcactcaagcacagaaatttacatgtagagtatagctaggattgcaaaagaacatggcatttgagaagttcagtgactagagtgtagaatatgagttgggtaacactgggaaatgaagctgatatattagattataaggatcttaggtttcttagaaaatatttaatcttcattcagaagagggtgagatactgcttaagtgtttaaagcaagggatagtataatcagatttgtgtcatgaaaaggtaactctggcagctttgtcatggacagattagatgagtgaggatccaggggcaggcagagcagttaaaagtgtttatggggccaggcacagtggctcacacctgtaatccccgcactttgggaggccgaggcaagaaggtcacttgaggtcgggagttcaagaccaacctgggcacatagcaagattcatctctactaaaaaaaaataaaatgctgggtatggtggcacatgctgtagtcccagctacttgggaggctgaggtgggagaatcgctggagcccaggaggtcgagactgcagtgacccaaggtgacaccattgcactccagcctgggcaatagagtgagtccctgtcttttttttaaaaagaatatttatggaattgttcagataatagatggattccttcctgaagcagtagtacacaagtgatagaggttatgattaactagaaactatgaggaagtaggaggagttaggaatccctctgaggtttccagctagggtgattaacagacagggtatgcaaaccaaggaggcttgatggggctagatgttgataataactttgggtacactgagtctgaagtttctatataaaaccaagatggaaatgtcaagtgagcagctggaaataatagaatgaatgcttaaaagaaacacagtaactgactacatggattgggaaccataactatatctaggaggtagctagagccaaggcagtagtggcaagggtagtggataaggagaagagggcctaggacagaatcttagggaacctcagtttcagggggagaaagaaaagaaagctaacaaggaccttgaaaagcctttggaaacataagtaatgatagcattataatacacctcttcattttttctacgcagctattttaaatactactggaatttttctggtatttcttattgaattgctgttagttctatccaagggtcaactatcattttgcttttatttcttagtctccatcctttctgttcattctgttagcccctcctttatcttcctatgcggagttgataggaaaagcatgacctcatgtattcagtaacattaggaaaatgtgaattctgtgatgttcctaatagtaaaggaatttgtagtagctgaggatttagtctggcattctgatactggagtttagtattctagacataaatatcttacttcaaagcatattttgttattatttttgaagtcttaaattgtatattagagagtcattgacactgaaatttttgacagtttcacacattgaagaagtgtgttaaagaatttctcctagcttctaaaatggaagtctgattgtattctcagactttgcatagtattcatagctgatattttagttttatatgtatttgataaatatagaataaatgctggctatgttcaaaaccaaagtattgctagaaaacttgaggagttacaaaaatggataactaaagctggattaaaacattttatttacaaaatgattatgattctccactccaactcccatctcaagtacaattcaaatgaaaacagtattgaaataaactacaacataagtgtaagaaaatgccatggagctttgatgtttctcatgcagactatgttgacgcatgcttgaaaatattaaatgcttttcagaaacgtgttttggtgcttttgcttctctggttccccaagcacaagcttagaatgccttttggataatccagcactgatcttgccttcaaaggagtttgcagtctcctgggaaagaaacctacacaactgaaatagaatgaaaaagagggcagggtctgaaatgctgagctctcactgaacacagaactaccagtctgaaaattccaaatgcaaacatcgaacagcactattatgatcaaacctaaaagtgccatctctggggtatagttcatttagagaattctataaggatctgggagttggagacccagctggtgggaattatttatcatcactaaagatattcaggtatcagttgactgttttccattttaattgtgtgtcaaaggatactaggtccttcccagtcatgtgtttcttagatctaataaccagaattcattagaattatataattataaatgatttctgacctacgatggcttgacaattttttgactttatgatggtgcgaaactgatgcgtatttagtatgctcctcaactaatgatggaattgcatccagataaaaccatcttaagttgaaatgtgggcttatctagacataacccatcattaagtttaggagcatctgtatttgttttctatgacgtatttggttttcttccaacccagtggtgttttggagttagcatataccagctctcaagaaccaactgttaaattttcaccaattttatgagctggttgtatattatagtcattactaaaaattatataaatttactaataataggaaaatcaaaggtcataaatactaaaaagtcattactccttaatttgttatgtttcactgttatctgtatttttgagattagttatgtctgctgtatctgtttggacataatatataatggtttgctactatgcatctcttcctgcctacatgttcagtgacatcttattggtagctcgaaactggccacagtggaagaatttataccgccagaattggcaaatactatgagttggggctgcacttactgttttgttgactgtttagacttaagagaaaatattaataatgcagattcattacattgtaaatagcaccaaaaaatgaatcttcttccaccatcccaaagttactaaacatttagcaaagaaatcactcacataactgacaagtgaagttctgaagtctccattgtatcactttcagctttgactttaacataaacaaaaatgtcaaccaatattcatgttggaactaatcgtaagtttcatccattagtggctttggcgtacagcagaaattaacaagttttctgtgagaatcaggtgactaatttacaatacacaacattgtatgttttatgatctttgtaaattttgtgttttgcattctttatatcagtaaaatttaaatttatatgtctggggtgtggtggtggctaggtcaggcaaggtttggtcccagcagctccatggctgctctgctctgagcatctggtatctactgtgcctttgaaaaaaaaaagaaaaaaaattatatttgtataaatgcatgattgctcacagagagctggttgttaagcacttaccagcacatatcatttctaataatgaacaagtccaaataaagcctactatataaaattcagatttaaataggtttattttatcttcctttccttgttcttttcccctcttttcctcctgttcttcctatttctcacttttagttcttttatgcttagtaatatatactatattaaactgaataagccagaaaacactgaaatttctttacctattattagtccattttcattctgctatgaagaaatacctgagaccgcataatttataaagaaaaaggggtttattggacttacagttccacatggctggggaggcctcacaatcatggcagaaggtgaaggaggagcagaggcacatcttacagggcagcaggcaagggcatgtgcaggggaatcgccctttataaaaccatcagatctcatgagacttattgactatcatgagaacagcatgggaaaaacctgcccccatgattcagttacctcccacctggtacctcccatgacacatggggattatgggagctacagttcaagatgagatttgggtggagacacagccaaaccatattcctatgttgtttctaacccttgcagtgacccaccagcaaacgttatcattccccactctgcagatgagaaaactgaggttaagcctcttttctgttgtcacacatctcataagtgccagacatgattgcctcttccagatctatctctaaagcctctgctcttttccaaataccatactgttctgaagctagttcttacaagcatattaggaaaaatagatcttatagcaaaagctttttacttttagagctatttatcccaagaactgtttattacacagaaaattacactttcacaaaatattttttgttatgctttgagcttatgtaaatgttttatacttacttaattttatttctgttctcatagccttggtggaggaccagatgatgcaaaagaaattatgagacacagtttcttctctggagtaaactggcaagatgtatatgataaaaaggtaagatttctttatggcatagtgtgtatatattttggctgcactgctaaaatgaatttatagcaaaaatattttaagtgaataaaagttaatgatgtaatgatactttccattttaccgacatttaagtgattattgaacttctgtgcacaaaattttactcatgattttgactccccaaatgcctcttgagattttgctcaacatgatcacagaatttttctatttttttcccataataatttgtttgcctctcattatttctttaattttaataaagataccaagtgttaatttttctttaagaaaactagttaaaattttttaatttgcccttatgtctttaattttaaagtgaacacttcagattcatttatacaaatccttgttttaaaagaaatttaaagaaatttgtttttaatatttaatgaaggtagtaaacacagtgtcttactttggacttctctgtcatttgaaacagaactttattgcccacaaaattaatactactaggccaggcatggtggctcatgcctgtaatcccagcactttgggaggctgaggtgggaggatcacttgaggccaggagttttgagaccagcatgggcaacacagtgagaccccatctctacaagaaaaaaaaaaaatcaactgggcgtggtggcgcactcctaagaaggctgctaaggcaggcaggagaattgcttgagcacaggaggttgaggctgcagtgagctgtgattacaccactgtactccagcctggatgacagagtgagacccaatctcttaaaaaaaaaaaaaacaaaaaacaaaaaaccactactaattacatatgtttagttttattgtgatctgcttattactttttattcatttatttatttattttttgaggcaaggtctctgttggccaggctggagtgcagtggcacggcacgatcacagctcagcagcctctacctccccaggctcaagtatcctctcacctcagcctaccaagtagctcggactgcaggcatgagccaccatacctgcctacgtttttggtactttttgtaggttttgccatgtttcccagtatggtactgaattcctgggctcaaacaatcctctctccttggcctcccaaagtgctggattacagacgtgaaccactgcacccacccttcttgttcttagtactgcaatttttgcttaagttcaggagcaggaaattattatgtctgtccccccctccccctgctttttttttttttttttttcccccactacctcagatattgttagtacagacagggattttgatactttgattttcagatgcttgtataaaatgtttactatgaaatgtttttcattcaataatctactccgaatttttctgtaattatttttagttcatccatttcagtttattccaacatttcatatttttctctgaaacatttattagtcaacaacatttatttggggtctgttatgtgccaagtgttcttctctgttaagccttaaggtaaacatagaattatgtcatatgaattagatgagttaggaggaagtaacacaagcacttcatgtctgtattatgttattggttactgggagtatggtgattttctgtttcttgtaactaggaatttaaaataggtgcatcatattagacacctctactcgattcaactcacatatcttgagtttctactatgtataaagtaccatgttaagtactgaatccttcacaacctttatgagaagcacttgagcattcctaaatgtttattcacttcttacagacaattttatatccacttagtatcactgaggatgttccttatgagttgcatgcatatataggaatgcctctaatgagctgtgtactgttttcatcgtgtcagtacactacaaaagaacctggaaggaagaagggcttgctgtctctcccagaaatcatgcatggttttatttttaataaatagctaataataagctacaactaaatatcatcctttctagacaccctcttctaggaggacttactccaaaaaaaaagaagaggaaaagaaccatttctttaagagacaatggttgaggtaccaatgtggccctgtaaattcaaggaagggccaaaatatggaccttcttagtcctgtgaggaaataagatttgctacaacgtttccttatctcagtgttcagctattcatgttgaataagagtttggccccacctggagaaagctctgagagcccaaccagtataccagtaaggaagcaaggcctgtcctatctcagctccactgggttagacatgcccagtgtaaaggtgatagtaagacagccaggagctaccatgtgggaatggaattaggggagccagcagctctggcagggaggaggagctgcctaaacaccttctgatgacatgtagataaattcgttcaagttgttataattatttttttttaatgggtgccacttaatttgagcaaaggtgttaaatatcttgcataaagaagcacaacccaaaatgactgtttctgtaaacaatagattggtcgtggattggtgccatctacaggcttactcacggtgtcctgtgtgacccgcgaggctctggtgttctctgccgccccatatatacttgaaggagcaactttattatagcagcacttttaaatttgagtttctttctaaaaggaaaatgtgattgagtctatttgggtttgtatcatatcacagatgaacatgaaattaattttgagaaccagcctgggggttagtagctgttttaatgaattcagttaaaatttcagtgttttagtgtaaattactaaataatttataaaataaaacattttaatggagtccttatatctttaaaatgtgtaatttattgtaaaagtcaattcattcctaagatcagggattattgttacatttttattgttttgataaatttattcttaatttattatcacataattattggttatttttctacttattgctgcacatcgagaggtgatggcacatctagagattctggcatctgttgaggagatctgaatctctttctaggcaaagtaaaaagtgaaagtaatcttaattacaagtagcatgatgtaccactctaaagagcacagtatcaaaacatgaaagaacaaagttggatcctggtcctggatttgcttcttgctttctttgtggaaatggacaggtcatttactcatgcaaaagatatgatcctttaactaccttcaagcttttaagattctctagcagggtgttttatagcatgaatttatctagattaatgtctatatagatttctacgtaaattttacactctgtcagtctgctaagattttgtgtgagattgtgttgaatctgtagataaatttaggaagagctgacatcttaacaatgagtcttcagatccatgaatgcaatttatttctccatttatttaggtggtctttaatttctcacagtaatgttttgtaattttcaatgtttaagtcttacacaaattttgttaggtttatccttacgtgtgtttcatgtcttccaagggaaatgatatttaaaatttcattttcactttgttttactgccagtatatagaaatacagttggttttttcatattgaccttttctcctgcaggcttgcaagaattagttgtagtaaccttttttgtagattacttacaattctctgcacagacaatcatatcttctgtaaataaagttttacttcatttctaatctgtatgcatttcctttcttcttttgccttgctgtattggctaagaccttcattataatgttgaatagtggtaagagtgagcatcctgactttgtttctagtcttagggagaaaagcaccttttaccattaaatatgatgttaatgagcacatctagcagccagatctgggtttctaactattattctccaataaaaggaaccaaggctccttgaggacgcgactgatttcagcactagtatagggggagaaaaaaagatgagcgtggagaattttgtggtgtcagaaagtaaggagggagccttaaaaaaaaaaggcaagacctagaaaacagcccaagctgaagggtcctgtagcagaagctgaaacaatttcagtaataaagtaaatatagtgttagtttatgatccaaaggatgaaatatgtaatcatgagtctatattgcataaataagtgattgattgtctaaataaagtgttgagagggacatgtcttccttacagatgaattccaattaatgtaaaagaggtgagtagagtagaaaatcaaatcaccattagaactccagagtgaaaattgctcattcagaattcacctatgaatattaaaattagtaagcaaaagtttaggaaagaggatatttccatactctcaagatatctccctgtgaacatttatcatttacaaaggtaaaatgactaactttacagtggagagatctggaaaacacagttttaaccaagtgatcacggttaacatcaccagtaagtaagatgttgacttcatggaacccatgataagatgctctgagaagggcacagtacttttgaagtgctctcctccaagatgcataacctcagtataatcatgaggaaacctgaagaactcacagggagggacattcctcgaaatacctggcctgataactttaaaagtgttagcctcatgataggcaaagaatgatgatggaacactcatagattggagagactaaagtggcatgatgacttaactgcgatgtgggatcctgggttgggtcctggactaggcaggggcattggtggaaaaactggtgaaattgaaataaagttggtagtttagttaatagtattgcactgatgttaatttctttgttttgatattcatactatggctatacaagatacagaggaaggtgggtaaagggcatatggtaactatgtgtactatatttttgtaagtcttctctaagtccagaattatttgaatatgttataaaaacatgatgttataatatagatgttttatgcctcctttatcagattgaggaagttctagtcctaggttactgagagtttttaaaatcatgaatgggtattgaattttattaaagctttttctgcacttactgcaatgatcatatggcttttctcttttatgttctgttaaaatggtgaattaacattgattttccaaagttgagtgaaccttgcattcctgttgaaaaaaaccacttgttcatgatgtgttattatatattgctagcgttggtacattgtatttctaaggatatttgcatcctgaaatcctgagtgatattactatgtcatcttcttttcctaaaatgtctttgtataattttcacttcaggatcatgtttgctttttaaaaacaaaaggggaagtactcctcctttctctttaattttattgaattgtttgtatgggatttgtattatttattaatgaaatatttggtgggatttactagtgaagctctccctagacctggagttttgtctttgttggtaagtttttcactgtgaattcaatttatttaatagttacagggctgttgtggttatctgttgttactcagatgaattttgctctttgtgtctttcaaggaatttatcatctaagttaagtttctctctaaggactgttagtcatgctttgcacattttgatgtgctgtgttttcatttcaaaagagttttaattccccttgtgattccttcttaagggttatttgtaagtgtgttgattaatttccaaatatatggatttttcagatatctttctgttactgattcctagcttaattctcttttggttggagaacatattttatatgattttaattgttttacactttaaaagatttgttttatggcccagaaaatggcttatgttgctgtatgttctatatacacttgaaagaatctatacattgacccttgaacaatgtgggagttacgggcaccatgctcaaaaacccagtaacttttgacttcctagaaacttaactactagtagcccactgttgacgaagccttaatgaacagttgattaacacatattttgtatgttatttgtattatatactgtatttttataatatagtaagctacaggaagggaaatattattaataaaatcataaggaagaggaaatatatttactattcatgaagtggaagtggattatcgtaaaggtcttcctcctcgttgtcttcatgttaagtaggctgaggaggaggaggaagaggagggattggacttggctgtctcaagaggtggcagatgcagaagaaaatccgggtgtacgtgggcccatgcaattcaatctcatgttgttcaagggtcaactgtattctgcttttattgcataaattgttctaccagtgttcattaggtcaagacagctggtagtattgtttatgtcttctatattcttactgattttctgcctacttgttctattggtttctgaaaaagatagttgatgtcgtcaactatgatcgtggactttatcttttaggttttgcctcatgtgttttgaagcctcattgttagttgcatacatatttagattaaggattgttttcttggtgaatttacctcatctttttttctttttctttttttttttaagagatggggtcttgctattttgtgcaggctggatttgaactcctgggctcaagcaatcctcttgcctcaggcttttgagtagctgggattgcaagcatacatcactgcgctcatctttacctccttatcattaggaaatgttcttctgtatagatggcagcaatatttgttttgacatctacttcatctgatattaatataagtactccacctttcttttgcttttgtgtaatatatcttttcccatcattatacctttaacctatgccaattatatttaagtggatattcttttagacagcatatagtcaattcttgtttttctgttattcattagaaaatacgacttaatgtaatgggtagcccgttttcatttaatgtacttaatgacatacttgggtttaaatatacaatcttgctgtttgttttttttttctttgttcctttttttctctttgtctgccttcttttggatttgttgaatattttatggttccattttatcactgctattgtcttcttgtatgtctgttttattgtttggaggttgtttctagagtttgcagtacacatgtttaacttagtctaccttgagtcataaccaattctcatacaacagcatatttctgtttcctccatctattctttaggctattattttcttacagtttactttcacatatgttaataaacaccacaatacatggtaatggtaattagattttgctttagataattatattttaaagtggttgaaaatgctacacattaaccattattagcactctccattcctttacatagactatgcttctacctgccgtcattgttttcttgattataaggctcctttaactccacttccacctccctgggtttggaaaaattcatggaaaaatgtgtttgaaggaatacaggattgggaaatgaaggaaatgggacatttcagaatgggaaaacaatgtgagaaaaaaaagtagtaacaagagaagtgaatgaagatatgctgactggaggaactgggaatctgtggtggatagaatctggatgtaaacagcggacaggtggcctgtgaatacactgcggcttcttgaaagtcgacctcgtatgtttgcttgatccacttaacagaactgtagatgctgaagtaaggaaatgacacgcagcaactggattttttcaagttttgttggaatagactcttatggagaagagcctggaaaagggaatctcattaagagactactgcagtaatacagtgttaagtgacagagctcttactaaagcagaacataggcaacaaagggaaaggaagtgtgaattccatagaaattatcaagaaattgaggactcctattttagtctgataatactggggaaaatactgggagaaagtttaaggaagaggattatagctggtttttggtaattaatttcagatagaattgtctaatggctagaaatatagcacttctgggagttaaaatggaaataaatatgtctggaaattcagagtttaattagagctgtggaaatgattaaggaggagagggctaaggaaatggataggagagagggaagagaaaatttgaaagggaagtcaggagggagggaagcagtgagaatgtggaaggttgggattgagtgctggaaaatattcatggtcaataatggaagttggtttgaggacacatttttgcaaggtgtatcaagatcatttgtgaagcatcgtgccagagttgaagtggaactttcctgagttgtgactttctactttctggttgagatattcagcctgaagagttcggtgattgatggcagttacgcagaggttaatgattgtaagctactgctttacaagtgaagcaaggccagaggagtagaacagatgcaccagcggaagagagatgaaaggctgaaaataggtttctatttgatacttcccttatcacactcaaataatggcccacttttaaacttggggtcaaagaaagatgtgttccaaatacctgctagacattctgatggctaagccttacaattagtgtcttcttttggtcatgaggcattgtacttaggatataaaaacacaaacagctgtcaaaaccagtgttatttctggcataaaatgtatacagttaaagctttaaaagccttcaaattgggttaggaaatataactagatgttccttacaaaaaatctcacctagaataaaattacacagcaaactggaaaaaataagaatgaggaaaagcttaatcatcaaatgacacaaaaagtaaacagaggcaacaataataatttgaggctaagtagatttcagatattaaacgtgataagtagatcatgtgtagcataaatgagaaacatatttatttgcaccaaataacagcatctatatgcacaaaacaaacactattaaaaatgcaagaattaactcaagatggattggagacataaatgtaagacctgaaaccataaaaaattctagaagaaaacctatgaaaaattcttccggagattgacctaggcaaagaatgtgtgacttaagtccccaaaagcaaatacagtaaaaacaaaaataaataaatggggcttaattaaactcacaagcttctgcacagcaaaagaaatcatcaacaaagtaaatagacaacttacagtttgggaggaaatatttgcaaactttacttctgaaaaagggctaatacccagaatcttataaagaactcaaatcagcaagaaaaaattcaaataattccattaaaaagtgggcaagcaacatgaatacacatttctcgaaagaaaatatgtgcaaatggccaacaaacatgggaaaaaatgttcaacatcacaaatcatcaggaaactaccaaataaaaccacagtgagataccattttaccccaatcagaatggtcattttaaaaaagtcaaaaaacaatagatgttaatgtagatgcggtaaaaagggaatgcttacatgctgttggtgggaatgtaaattagtacaacctctgtggaaaacagtatggagatttctcaaagaactactagtagatgtaccattcgatccaggaattccactagtaggtatctacacaaaggaagtcattctatacaaaaggatacatatactcatatgtttattgcagcacaattcacaattgcaaagatagggaatcaacctaagtcctcatcagccaatgagtggataaagtaaatgggatgtgcacacagacacaccttggaatatcactagccataaaaaagaacaaaataatgtattctgcagcatatagatggaactgaaggccattatcctaagtggggtaactcaggaacagaaaatcaaatactgcatgttctcacttagaagttggagctaagctatgggtatgcagaggtctacagagtagtagagtggacactggagactcagagtgaggggaggatggaagagggaggtgagggatgaaaagtcacctgttgggtacaacgtacactatttgggtgatgggtacactaaagcccagagtttaccattatacaattcatccatgtaaccaaaaaccactgtacccctaaagctattgaaatttttaaaatatattttaaaataattttaaaatatattttaaaattattttaaaattttaaatatattttaaaatatattttaaaatttttaattttatattttaaaatttatgcaagggagctgatagaaatacacttacttaacatgtctagaggtttatcagttcattgatatttacaaagatctggcttttgcttttgttagtttttctccattgattttctgttctctgtttcattgatttccgctctaattttaattatatcttttcttctccttactttggatttaattttctctttttctagttttgtaacctgaaagcttagattatttgttttcgatcttttctaatttgtgcactcaatgctataaattttcctctaagcattattttaactgtatctcacaaattttgatgttttattttcatttagttacaaatagttttaagttttattgaattatttaatatgtgtgttgtttagaaatgtgttgtttagtctacaggtattttggagctttccagctatctttctgttactgatttccagtttaatttcattgtggtctgagagcatacttttatatgatttttaaaaatttgttaaaggtgcattttatggcccagaacatggtctgtcatgatgaatgttctgtgtgagaagagaagagttacatattctgcttttcttggataaaatattccataatgttgatattaaatccagttgattgatggtgctgtttagttcagttatgtccttaactgactggggggacatgttgatgtgtccaactataatagtagagtcatctgtttctccttccagttctatcagtttttgcctcacgtattttgattctgttgctagacacatacacattaaggactgttatgttttcttggagaattggcccaggtatcattatgtaatgcccctctttatctctgatagttttccttgccctactttgtcttaaattaatatagctcctcccactttctttaaattactatgagcatgcctatcttttttccatccctttacttttaatctatcagtgtctttatatttaaagtgggtttcttgtagaccatatagttagatcttgttttttttatctactctgactgtctctgtcttttagctgatgtctttagaccactgacattaaaaatgataattgatacagttggatttcttacaggtttttttgtttttctttttgtttttggaaacggagtctcgctctgttgcccaggctggagtgcagtggcacaatctgggctcactgcaagctccgcctcccggcttcacactattctcctgcctcagcctcccgagtagctgggactacaggcgcccaccaccacgcccggctaattttttgtatttttagtagagatggggtttcaccatattagccaggatggtctcgatctcctgacctcgtgatccgcccacctcagcctcccaaagtgctgggattacaggcgtgagccaccgcgcccggccttcttacagttttttatccattgcccttgctgtttctttgtgtgtgtgtgtatcccatttttattctgccttctctggtttaattgagcattgtataaggcaacatttttccctctcataacatattaattgaataaattatgcttttttaactttttttaactgccagcccttgagtttgaagtatacacttataactaattcaagtcctcttttaaatagcaccattcatttcacagatagtacaattgccataggtactttgctcttgtgtagaatattctataaatgtcagtgatagaattggctaatagtgttaagtcttctgcatctttactgatagcttaatggcttgcttttatcagttactaagagagaagtgaaaccttcaactataattatggcgttgactatttctgtttatagttctatcagttttgacatttttttagttccatgtgtagatgcacccaaattgtagtattgttatatctttttggtagttttacctcttcattattttggttaaccaatttattggtgtaaagattacaacggaaataaatgaaatcgataattgaaaagcaatagagaataatgaccgaaaccgaaagttggttatttgaaaaatcagcaaaactgacaaaactttaaatggattgactaaggaggaaaaagagaaaaatgaaatactgaatcagaaatgaaaaaagatattactcctgacttgagagaaatagaaagggttataagatgatactctgaagaagtgtatgccaccaagttgagtaacctagatgaaatggacacattcctggaaatacacaaatcaccaaaatgacttaagaataaattgaaaatccaaatagaccccgtaactcttaaagaaataaaatcactaatcgcaaacctcccaccaaagaaaagcccagggccagttggctttactggggaagtctacccaacacttaaagaaaaattaatgccagtccttctcaaactcttccaaaaatttgaagaggagtgaacactctctcacttgctctatgaagggagcattatcctgatgtcaaaactagaggcattataagaaaagaaaactacagaccaatgtccctaatgaatacagatgcaaaatttcttaacaatactagcaaaccattcagcagtataattaaaggattgtacaccttaaccaagtagatttattccaggaatgcaaggatgttcaacgtatagaaattaatcagtgtaatgtcccacattaatagaatgaaggagaaaacttgcatgatcatttcaactgatgggcagcatttgacaaaattcactcctttatgataaaaacagtaaaaagaaaaaaaagctaggaatagaaggaaactgccacaacattataaaggtcatatatgaaaaattcttggaaagactgtcctttaagggatcatttctatagtttggaaaaccctcagctcacattatattcaatggtgaaagactgaaagtttttcccctgagataaggaagaaaacaaagataccactttcaacatttctgttaacgtgacactggaagctgtagccagaggagttaaataagagaaataaaaagcaatcaaatttgcaaggaagaaataaaactacccctactaataggtgacatgatcttatatgtagaaaaccctaaaacatacacacacacgtgccacacttgtgcttagaactaatacattcagtaaagttgcaggatgcaaaagcaagctagaaaatacattgtatttccatatactagctatcaacaatgtaaaattgatcttaagaagatcaatttcatttaaaatagcatcaaaaaatgtcttaggaataaatttaaccaaggaagcacaagacttatacactaccgactacaaaacattgctgaaagaaataaaagaagacataaatgaatggaaagacatctcatgtttatatattggatatttaatttaagatgagagtactcaaaatgataatacagattcagtgcagttttttcttaatcttatggtagaatactattcaagaataaaaaacaactcaaatttataagtatcaatattgataaatctcaaaaaacaaacacagaaaaacaaaatactgaggatatttacagaataccgtactacaaaaactgaaaatgcaccataaaaagcattgtatttatgacaaaatatatatatgggagaaaactataaaaacttgcatgcaaatgatatgaagtaacttcaggacaatatttgcttgaatcataggtgattgccattctcacaggttaaaatggttgaacatttccaggtgcagtgactcattcctgtgatcccagcattttgggaggccaaggtaggaggattccttgagcccaggagttcaagaccaatggcaaaaccccacctttaccaaaaataacaaaaaattagccgggcatggtggtgcacgactgtagtctcagctactcaggaggctgaggtgggaggatcatttgagcccaggagatcaaggctgcaatgagctgtgatcacactactgctctccaagcttgggtgacagaacgaggcctcatctcaaaagatagagagagggatggatagatagatagatagaatggttgaacatcaatgagtaggaagaaggtaggtatttagcagtaactattttacatctgaaaaaaacagatgtttgaaaatacatatagtacaatgttaacatccattagatttggttatcttattttctactcttaatgcttaaactagttctttttttattttcaattcaagtgtaagttaaaagaaatagaacaccaagcttaggctactcaagaaaattgaagagtagtaatgacccctttgtcatttctgattgtgtttatttggatcatctctctttttcagttattctagctagcagtctattttgttaattctttcaaaaaaccaactcctggatttgttcatcttttgtactttttctgcatttcaatttccttcaattccgctctgattttggttatttcttgccttctgctagctttggggttgctttgctcttgtttctctagctcttctagttgtgatgttacattgttaatttgagatctttctaactttttatgtgggcgtttagtgctataaacttccttcttaacactgccttagctgtgtcccagagattctggtatgttgtatctttgttctcatttgtttcaaagaatttcttggtttctaccttaatttcattatttacctaaaagtaattcaggaacacgttgtttaatgtccatgtaattatatggttttgagagagtttcttagtattgatttctgtttttattgtgctgtggtctgagagtgtggttggtatgatttcaggtttttaaaaatttgctgaagttaaaccatccatgtttgcagacagtatggttctatatacctaaacaacccgattttctctgcccaaaagctctacaatccaataaacaacctaacaaaaattgacaaattaacataagcaatatctcaggatacaaaatcaatgtacaaaaatcaggattcctatgcaacaacaacatctaagctgagagcaaaatcaagaatgcaatcctattcacaatagccacaaaaagaataaaatacctaggaatacagctaaccagggaagtgaaagatctttacaatgagaactacataacactggtcagagaaatcagagatgacacaaacaaatggaaaaacattccatgctcatggttgggaagaatcaatattgttgaaatggccatactgcccacagcagtttacagattcagtgctattcttattcaaactaccaaggacagtcttcacaaaattagaaaaaaaaaccaaactatttttaaatccatgtggacccgaaaaagaacccgaatagccaaggcaatactaagcaaaaagaacaaagccagagacattacattacgcaactttgaactatactgcaggctatagtaaccaaaacagcatggtaatggtacaaaaacagacacatagaccaatgggacagaataaatagcccagaaatgtcacacagttacagacatctgatctctgacaaagtcaacagtaagaagcaatagggaaaggactccctcttcaataaatgatattgcgataactggctagccatatgcagagaaggtggaaactggacccctttcttacaccatatacaaaaatcaactcgagatagattaaagacttaaatgtaaaacctaaaattataaaaaatgccatataagataacctaggaaataccattctggacatagaccttggcaaagacttcatgacaaagactccaaaagccattgcaacaaaaacaaaacttgacctaattaaagagcttctgcacagcaaaagagactatcagcagagtaaacagacctctgcagaatgggagaaaatatttgcaaactatgcatctgacaaaggtctaatattcagaatctataaggaatttaaacaaatttacaaaaaaaaaaaaaaaagctccattacaaagtgggcaagggacatggacagacacttcccaaaagaagacatacatgtggccaacaggcatatgaaaaaatgcctaacatcactaatcattagagaaatgtaaattaaaaccactgtgagataccatctcacaccagtcagaatggccctcattacaaagtcaaaaaataacagatgctagcaagattgtgagaaatgggaacacttatacactgctggtgcaaatgcaaattagctcatccactgtggaaagcagtttggcaatatctcaactcaaagcagaattaccatttgactcagcagtcccattattggaatgtaaattcttctgccataaagacacatgcacacatatgttcattacaacactgttcataatagcaaagacatgggatcaacctaaatgcccatcaattacagattggataaagaatgtagtacagatacaccatggaatactatgcagtcatcaaaaagaacaagatcatgtcctttgcagcaaaatggatggagctggaggccataagcctaagcaaactaacacaggaacagaaaacaaaatcccgcatattctcacttacaagtgggagctaaacattgagtacgtatcaacacaaagagaggaagagcagacaccaaggcctacttgagggtggagggcaggaggaaggtgaagatcaaaaaacgacctaccaggtactgtgcttattatctgggtgatggaatgacatgtacaccaaacccccccatgatatgcagttttcctatataacaaacctacgtgtgtgccactcaacctaaaatttaaaaaatagagaaaattgaagagttaagaaaggagcagtagctaaagggagcatgtagaatgggtgatatttatttcatacactcaggaatgatccaaaagggagtgtgaaattggagctacatagaaacaagtaatatttaagataaaaacatacagatagtaagatgtaaagtgagtaaatacagaaaaaaatgtaagatctctgaagcatagctaacctatagaaaggaggtgggatacccttgtagtgacatcaattggaaagaagtaagacgcccaccagagcagatgtgtttataagcatttaggcagaaagttatggtatttaggcagaaagttatggtagtttctgactgaaggcctcaaattctctctctctctctctctctctgtgtgtgtgtgtgtgtgtgtgtgtgtgtgtgtgtgtgtgtgtgtgtgtgtgtgtgtgtgtgtgtgttttaagagatggagtcttgctgtaatgcccaggttggagtgcagtggcacgatcacagctcgctgcagcctcgaattcctggccttaagggatcctcccgaatagctgggcctacaggtataagtcccaccatctttatggcagaagttctgccttcttattaagagtgagaagaatgttttatggttgatattagaagttttaagacagtgactgtcacatgtagggataggctcagagggagctagagagaaacccaagtagggacctataaagaggtaccgattgctggagggcccagctgaggttgaaaatcccaaagcccaattttatgctgactgctaaagccttgttcctcgaaagaaaaaattataatgattataaaacataattatataagtattatataaagcacaacttagaaaagatttaagaggtattctaggaagattgatttagaatgtttggattattttgaaatggatcttaatacttattgcattcctacttatctttcagagatttccttcagaaaagaagaaaaaatcttgcctctagagagtaatttaggtactttatagtttattttggtcacttggttgatactcatttcaataggatggcaactgattacataagtaatatttttatctatcatgtgcaaggcacagagaggcctcaatgaaataatgtctcctctgaaagggcctaagtgaatcttccagaccttactatattaattttaagtgtttcggtttattcattaaacatctgtgtttctgtttgaagattaatcttcatatctgtcccagattctaagttaggactcttagtatttattattttcttacgtatttgctgtttccagtgttattcttttgttaattttttattgagataattcaccctttaaagtatacacttccatggtttttagggtcttgacagacttatgcaaccatcaccgctgtctaatttgagaacactttcatttcttcatttttttttcttaaagatccatgttttcgtctggaataattcctgttcagtctaaattttttttttttttttttttttttttttttttttttaaccattttttgtagtgcagctggcaaaaaatttgttttcttttatgggatgatgtctttattttgccttcattcttaaaggatatttttactgaatataaaattgtgggttgatagtttagtgagtacatatttaaatatttcttccttgcaagtcatgtggtatatttcactggctgttttcaagatatttttgtttgtgtgatggctttgtaatatgtcagttgactagactgagccacctttcccaggattccttttgctatttaagattctcgtgggagatttggaggatagacgtgacggaacagccattttgtagctcattcatgttgtctgctagaccatcttattggtacgtggcagtggtcaggcctgcatcagctccacctcctcctgcatcctgttagcccttgagcctacttctgggctggagtgtgtgtttagctccatgatgaaagtcccagcttttgcaggatatccacaccagcaaggtcaggcggtacgaattaacacgggtttcagtctatcctcctgggctccagcttgtgcttctagattccatttcatctttcctctcctggctttgcttgcatcttcgcttctcaacttactgtcctatggacatgaagcctcagcagtgaacttggagacaacagccttacagagacaacataactagctcccacaatcagggaaattcagttacctgtaatctctttacacacacacagagtagttctgcttctctcatggaaccgtgacagactctggttttaagccttttgactataatgtgtttaggtgaggttttctatttattctgcttggagttgcctgagctttttgaatctcttgcatatccttctttaactttggaaaacttttagccattatttcttgaaatatattttctgtcttattatctatctctcctcctccccctccctccctccctccctccctctccctctctctttctttctttctttctttctttctttctttcttacttttggaagttgtccaacaggtatgaagttctgcttgttttttcacattgttttcctgtgctattcaaattggataataatctctgctggtatatcaagtttactgactcttacataatctccaatgtgctccaagcccatagagagaatttcttatttcagatattttatttttttttattttaggtttttccatttggtccttttcctaatagtttctgtgtctctgctgagattttcaacttttttactcatgaacatattttactttacgtcattgaagataattataaagttgctttaaagtctttgtctactaatttcaacatgagatcatcagagcatcagtttcctttgatgtctttttctagtgtatgggttctgtttcctttgtttttttaatgctgagtcattttggaatatatcctgggcattgtgactggtattttgtgcctctgaattcggttaggttgcagcaaagaatactgaattttttattttcttaggccagtcatcatggatgaactcaaactgcaaacgctttcttttttccagtgggttaagattccaggctggtttatttagacttcactaggaggcttggagcctgccctgtgcatgtgtggttcaagagtcagagatctgggcagactttatactgagattttagggcttcttctctttggctgcctcttttctggaatttcacctccttcacttaaaagctgctgtacttgttcaagctctgtcctctgattgttcatggcagtagaactgtgggtttctaatttaagatttttaccctaaatggcataagctggggcccaccttcaggcaaaaagccgtaaaaatgagaaattcatttggtgccattccttattcctagtgcccacctcctctttagtacctgcctgtttttagttgcttcccagaacctttagattgttttcatgtctttctcctgaggttacagttatatggaggagggttaatccaatcggagctgcttgaccatgattgtaagtgaaactgagtatttgttcttaattatgcattattgcatgccagatgtacaccttttcttcatgtggcacagcagtgttttgtattcatgcaaggaagtatctcacagattcacgtttgtgcaaccttctaaagagcttgtgtgagagagcttatttaaacagtgtgaattaccagtgaatgttatggttagttcagtgcagccaaaacataattcatggctgttccccttctcttttgtcccaattctcagtaacaaattcagacctctttttagagaacgtgtaatttcattaccttttgacaatgccttttagacttcactagggagcttggaggcttccctgtgcatgcatggttcaggagtcagcagaggctggtgcctggtatgtatggttcaggagtcagcagaggctggtgcttggtgtttggcaccagtggccaaaacaccaaagaacctcctgtgaatattttcttgtctttactcaccaaatatttagtgcttttctgtaagtcatgcacaacataatgatgcttcagtcaacacaccgcatataccacagtggttccataagattataatagcgtatttctactgtactttttctacatttagatacacaaatacttaccattgtgttgcagttgcctaccgtattcagcactgtaacgtgtacagggctgtagcctagggcagtaggccatcccatatggcctaggtgtgttgtaggttacaccatctaggcttgtatgtaagtactctccatgatgtttgacaatgacacaatcaactaacatgcatttctcagaagagacccctgtcattaagtgacacatgactgtagtttatggtaagtattgtgccaacagctagccttgcagagatagctaagataaagtccctgtcttcaaacggttgcttacagtttagtagaagagacagataaataagcaggcgatttacattttcatgtgatgcgggttgtgtttcagaggtggtagaagtatttcagaggttgcctgacccagattttaagagtaaaggacctgttatagaagctgcagttaggattggattaaaattaattgggtggtggttgatattgtgatgctttagtatgactttagtatgaatatttaggggctcagtgttttcttcatcttaaaatgaggggattggactagatctataagattattttcaatgtgaatattttgtcagtttaaagacacattgaagagatgctcaaaaaacatacttcttttttctttttagggaatagagtatttcagatcatttaaagtcctgtttgagagtttaccaggctaacaggaagtactacttgtgatttctttgcctgttcctgttctgatgtttagctgcccagtacaaacctgcaaggggagccttggatatccaattggtttctgaaaggtgtgtgtgtgtgtgtgtgtgtgtgtgtgtgtgtgtgtgtgtgtgtgttcgtcctttttggagccagagcttcaaaacatagcttgcatcttctgtgtccttcataaaattccagttggtttcctgcattcacttaattagtacagcacctgggcatagtagctctggataaatacaggttcttttctccaatagcttccttgcagaacatagaaattgctgcctgcccctatgcctcaaattgaccttctacctcttcctcctcagcttttaaagcccctatctttccttctcaccacaagttcatcccccaacccaaatgttccctatcactgggtctctccagcattcatctggtgtggtattaagagagtggctgtggctgtcagtgctagaacctggacagagagagagagagggtcttggtcacgtcatctttacagaaatataataggaatttctctataaaaataatagatacttgttagaagctttaatgttatattttttatttatttctggtttaatagaccttaatgttactgcctagtaacctacctacattatatagcctttctgtgtatgtgtgtgtatctattgaaacaggtcccaagttttttccagtttatatgtaggctgcatttttcttttcttttcttttttaaatttttgagccagggtctctctctgtcacccaggggagtgcagtggcgcaatcacagctcacttcaccctcaaccttccacctcagcctctcaagtagctgggatcacaggcacatgctaccatacctgggtaatttttaaatttttttgtagagatggagtctctctatgttactcaggctagtcttgaactcctggcctcaagtgatctgcccaacttggcctcctacattgttggaattataggcgtgagccactgtgcccagccttacatatataggcttttataacaaaattagcttgtaagttggaaattgcctttatgtcatttctccccagtctgcatacttattcaacttttgctcatgttcttgaatatttctaagagaaatagtgattaatggctgccacactgctgatgttggacagagcctataaaatcagctgaagaagggagaaagtagattgtttcactaggctcttagtgaagttctgatagttataataaatgcaacttgtcctttaacactactaggtgcaaaatctttttgttaccctctcatgccttttaaaaaggctcccagtgtttcactaatgagagcccttttgttgtaatttataggtgaatcctctccaggtataactgagatcttcaaataatgtatcgtatctatggatgtttgtgaataacatcacctgggcataaacctacagtcaataggatgagtgcttatgaagttatttttgaatgagaaaatttatcacagaaaagaaaatacaagttccagtttctggggattactttttaaagtaatgcaaatcatccatatcatgtgttaacaaacccctcagaattccaacaaggaaagcagatgtattaattaaacatttaatgtcttttatagttaaagtactcattttggcaggtctaatattacgatacaatagtggtatattaatttgttatataccttgggccccttggtacattttatgtaggcacaagattaacagcatgaacttcaattattactgtgtagttttgtaaaaatgaaatataattattttagtttctagttttatgtcaagaagaattcattggtatggcacagcttagcatacaaagtaactaaataatgtatgccacatacccattagttttgttagaaataaatcctcttttatactcctgcttttccagtacatgcacacctacatatacacaaagcgtgaagccagtatttagtagagattaaataaaccagaatctccacctatgattgactactttctcatgttgtttcagagaagtgaaaattatagcaccagattactgtctctgggaaatctaaacatgcaatagtgttggcaattctttactgcaaacatctatgttcactggattttggaccctatatgccaacacaaagtggtggaaataaccacagttgttaaggcaattaagataccacaatcactgtccacatcagctgtcccagaaagtttcaagttctccagtctatttcttaagcccctggaaggaacaatagaagaaagaatatagatatctgatagtagcacgtgacttgttactaaaaaaggtctgtggaatctcttaccttcagagaccttggtgttcatgcatacactcatggaatcattccagccataccagaaataccaaatgtgacttactctaacaaccttcagaaaattatctctttgttctttcattgacacttttaggaagatagtaaatggtagagtgatttcatagcatttaaaatttgataaaagatcagtgtggaaagaatttagggagcttcaacgttgctgtcaccatacggacttgaagttgcatattttcagtgagatgaaattgatgtcttgaacccagaaactttatcctcttgtttaagatcactgaatactacattttctgaaagcaaattggttttcaaataaagatttgtttcaagtttagtgcatttgtcagaaaaatatgttgtttgcagttaatgacactatagctgttcattgagttgatccataaaagtagctgagatttacagaaatatatatgactatcttttctaaatgggaatttacattcagtcagttgacagaaatgttttgagagatgtggttagaggaaaagaagagatgaagatactggtttaaagctgaaataggaaattaatgtatttatgtgctagggctgctgtaacaaaataccacagactgggtggtttaaacaacagaaattcattttctcatatttctggcgaaagtccaagatcaaggtgcaggcagggttagtttcttctgaggtgtctgtccgtggcttgcagatggccgtcttttccctgtgtcttcatatggtttttccttagtgtgtctacttgggtgtccaaatttcctcttcttgtaaagataccagactgagttaagacatatcctgatatctcattttaatgcagttacttttttaaagaccttatctccaaatagagtcacattctgaggtacttggggttagggtttaaacatactaattttggagggacacatttcaacctataataatacaatatttgaaatttgttcagctgttgtttaaagtaaatatgaggggacttcaaaaagttcatggaaaatggtattaaaagataaaaacagaaaatataaactttatttctcaacataagctccgtcaagttcaagacacttttgtaagccatgataccagctagttagttcatccctaaagagctgaacatcctggtaatttacctatatcagtgcagtcttttttttacattattaagtgaagaaaaactaatactctttaaaagcttttttaagtttaggggaaaaataagtcagaaggagccaaatcaggactgtaaggtggatgcctaatgatttctcatgaaagctctcatgaaatacccctgtttaatgagagggatttagcaggagcattatcttggtggaggaggactctctggtgaagctttcccagaagtttttctgccaaagctttggccaactttctccaagtgcttataatcaggtgttatcattctcctgccctccagaaagtcaataagcaaaatgccttgagcacccaaaaaactgttgccatgacctttgcccttgacctgtccaatattgctttgactggaccatttccacttcttcatacccattgctttatcttcaggattatactaatagaaccatgtttcatctcctgttacaattcttcaaagaaatgcttcaggatctttattccacttgtttaaaatttccattgaaagttctgctcttgtctgcagccgatctgggtgcaatggttttggcacccatcaagtggaaagtttgctcaacttaaatttttcagtcagaattctgtaagctgaaccagatgagatgtctatggtgttggctgttgtttctgctgttaatcattggtccttttgaattagggcacaaacaagattaattttttcccttgcaaattgatgtggatggtctgtcgctgctggcttcgtcttccacattgtctcatcccttcttaaaataagttatccatttttagactgctgatttatttggggcatacttcccataacttttcataaagcatcagtgatttaatcattcttccacccaagcttcaccatgaatttcatgtttgttcttgcttcaattttagaattcatgttgctcttacaggggctctgtccaaactgatgtcttatccttcttagtccctcaaacttgatcctgtacagtcatgttataacaaatcagtatgagttaattttggtgcagaaattttttgaaatctgtgcatggttttttcataatacacattttccataaagtttatgaagactactcaagaatattatatattctagaaatttgtaatgaaatctgaagttggggcattctgatgatttttgtgggactgcttctgttcaagtactgtggcagtttttttttgttgtttgacgaggtcttgctctgtcacccaggctggagtgcaatggcatgatctcggctcactgcaacctccacctcccaggttcaagtgattcttctgcctcagcctcccaagtagctgggactacaggcatgtgccactacacccaactaaattttgtatttttagtagagatggggtttcaccatgttggccagtctggtctcaaactcctgatctgcctgcctcagactcccaaagtgctgggattacaggcatgagccactgcacccagccatactgaggcaattttttacaagccctacccgacaatgttccccatatacataatgtagggtctttgcttccctacaaatgtttatattccactgagttgtcttcaccttcagggacaggggaagtggaagggggaataatgcttcctagaatgaatatcttgactaatgtatagagaaacaatcaaaagcaaaagtagttttcattcaaagccttcacattgtaaatgctacagtaaaaagaccttgagatcaagaaacctaggtttttgccgctccagttcttattcgtataatttttggcaagccatttaaccagtgtcagctttaatttcctgatctctaaaaaggtacactacatgctcactgacgtcttactcagctgcaagactgaatgattgattcatttattccgcaaatattgttgaatgctactatgtggcaaggactgttttaggagttgggaatatcacattagtgcaacacaaagttccagaggagacaagtgggaaacaaatagcaagatggtaaatttaatcttactcgtatcaataatcacattaaatgtaaatgttctaaacaccacaattgaaagacagagattagacttggtaaaaagcaagaactacctatatgctgcttataagaaaccaactttaaatgtaagatataagtagattaaaattaatagaacagaaaattatatactatgctcaacctaatcagaagaaaactagagtgctatattaaatcatatgaagtagatttcaaagcaagtaatattgctggagataaggaggaacatttcataataattaagggagtcatttcatcaagaagtattaaccgtcttagttatgcatctaataacaaaacaaaatatttgaagcaaaaactaatataaggaaaaatagacacatttacagttactattggacagttcaatatccatcttcaaataattgatacagcaattggagagaaattggtaaggttatatagcaacttgggcaatactatcagtcagcttgatctaactgacatttatggaacacgctacccaacagcataagaacacttatttttctcaaggtcacagatcatttatcacagtgtaccatatgttgagcaaaacaactccatgaattttaaaggatttaagtactgtaaaacattttctctttgaaggaaatgaaattaaaaaaacacagatctatggaaaatccccaagttcttggaaactaaatattaatccatggatcaaagaagaaatcaaagggaaatgagaaagtattttgaatggactgaaaacgaaaacacaatgtgtttagctgtgatatacagctaaagcaatacttaaatttatagtactaaatacaatttatagtactaaaagatatttttaaacattagaaaagaagaaaagtgtaaaattaatgaccttagcttctatcttaagaaactaggactgggcacagtagctcacaactataatctcagtacttttgaaggccaaggtagaggagttcgagactagtctgcacaacatagtgagatcccatctctaaataacaaaatattagctgggcatactggtgtgcacctgtggtcatagctgctcaggaggctgaggcaggaggattgctcaaggaggctgaggcaggaggattgcttcaggaggctgaggcaggaggattgctcgaggccaggagttttgaggcttcagtgaactatgatcacatccctgcactctagcctgggtgacagagccagattttgtctctaaaaaacaagaaaaagaaaaaggaattagaaaaataagaacaagttaaacacagtgtaagcagaacaaaggaaataaagattgggatagcaatcaatgaaatagaaaacaaaaaatcatagagaaaattgatgaaaggaaaactgggcttttgagaagatcattaaaattgatgtatttctcacctgactgaaaagaaaagtgagaagacaaataataaatgttgacactgctacagattctattggtattaagtggataatatggaagcattatgtataactttatgccaataaattcaactatttagctgaaatggacacatatgttgaaagatacaaattaccaagaagaaatagatgtcatgaatagccttgtacctgctaaagaaattatagttgtggttaagatccttctgacaaagacaccagacccacatattttcaccaacgaagtctaccaaacatttaaggaatattatcagttctatacaaattattccagaaaattgaagatgagagaacatttctcagttcattctgtgaggcaggtattaacttgatatcaatatgcaagagatttttttttttttttgagatggagtcttgctccgtcgcccaggctggagtgcagtgacgcgatctcagctcatggcaagctccgcctcccgggttcatgccattctcccgagtagctgggactacaggcacctgccaccacagccggctaatttttggtatttttagtagagacgggggtttcccatgttagccaggatggtcttgatctcctgacctggtgatctgcctgcctcggcctcccaaagtgctgggattacaggcatgagccaccacacctggcccgcaaagagatttttaaaagaatgctatagaccaatattcttaatgaatatatatgctaaaatgtttaatttaattttagcaaatcaaatctaacaatagatacaaagaatcactaccagtgtggtctgttctaggaatataagattgatttaacattcaaaaccaatcactatagttcacctattaacagagtacgaaggaaatgattatatcaaatgatgcaaagaaaaaactaagaaaaatccatcctttttaaaacttatttaaacaaaaaatgaaacgctctgagtgaattaggaattgggttttttttttttttaacatggtaaaggaaaacaatttgacagtttctggaaaagtcaaatgtatacctaccatacggcccagccattccactccttagtatttgtcctaaataaattaaatcatatgtctacacaaagacgtggacataaaagttaatagcaattttgtttgtaattgccccaaactgggagcaggccctgtgttcattgacagatgagtgtgtccattgtgatacatctatgtactgaaatattacccagcaaagtgagtaaactattgatacatgtggtgacatggatgaatatcaaagtaataatgctaaatgaacaagccagataaagagtacatactctatgatccatttgcataaaattctttaaaatacaagcaaatcagtcatggcagaaagtatgtcagtcatggcctgcaggggatgggaggatggaagtacacatgggcacaagaagacatttgaagtggtagatgttttcatcatcttgattttggtgacagtttcatgggtatatacatatgtcaaaacgtatcagttgcatgttttttgtttgtttttttgagagggttttactcgttcgccccggccgggttggaatgcaatagcataatcttggctcacagcaacctctgccttctgggctgaagtgatccttccacgtcagcctcccaagtagctgggactacaggcgcccgctgccacacccagcccaagttgtatattcttaatgtgtgctgtttagtgtatgttaattacgcatcaataaacttttttttaaagtccttgccctcgtggaacttatattttattggtgatgaacattgacagtaacaaatacatgtatatcatatgtgtgcatgtatacgtgcctgtgtatcagatgtcgcaaagtcttgaagaaaaagcaatgtgaagatagaaagtgagggggaggatagctgtttaatgtaagaaggcggtcaggaaagtcctcagtacacgtggcatttgaaacagagactattttaagctcccctataatcttttgaaaactgtgttaagataggtttcagtttgttaaagttacaggtcatcattctctcatctaaaaggacaagtttcccctaacttgaaggcaaatttaaatttttgacatcacaaagaaccagatgaaaaggatggggcagaggtgagcaaacctactcctagtgcccaagagaagccgattccagccacaggaatttcttgtggttaacttctgattggaaagataaagacctattttgtgaacatctgtagaatagtaaatcagaaaaacccaaccagaattccagtcttcccgttttctgccagataggggcaattacccccttggttttctaaaaaaaataaaaaaaacaaaattgttccagcctctgtcacctctggggttccctgtgcgtgtgcatgtgatatgtgaggctggtgtggagaatttagcctgagagtcagagggagggtttctagcagtggagtgacctgcttgctcatgtccaggggatccagcagggcagctagaaagaaatatggtctggcacaatggcaggcttctccttgccactggtggaggagtttgtttcagtttagggattagtcgccattaccagctgatcagtggaacgtagagttggttcatccccaaaggagtgcttgctaatcatgaagaccttagaatagctgtgtgctgggggtaaacagaaagaattataaaaagaagagattaagaatgctttgtagcatgtaccataaactgaaatgtcccttattttgaaaacctgcttttaattctgctcatcccacgattcttaaaaatatagttctgtctagagaataatttaaagattttccttattatttaacatacatttggtgacagaaagagtgggaaaatgcactgatctcaagccaattgtgtatttgtttttgtaaaatttttataaaacatgctgatttctgtcattctgtttgccatgttcctatccccgtgagaactgtattctaaagcagcatcccctgttctgaatgatactctgcagagcacgcactctgaccctaatgctctgggactgggcatcctgtgctagaaggaacctgtgggttccacctgtccctcaaggctagagccctgagaagcaggagcctcgtgttagctccttctccctcccaaccagtggaggttcacagggctccggctcctgaaacctccagtagcccgagactttccttccacccccaccttccctaacgccatgcctgccgcaggtgcagtgcgaatgagatgattcctgccctgtcaatctcaggggagctactcttaatctcttctgggctgtggtcccctttgaggatctgatgaaagctgtgggcaagattttgcatgtaacgtcaggggctaccaggaaacccttttccagagcagggcaggcatcaatgcccatctcttatcagcaaattcttagcaaagtacaaagttgtagttctttacgaagggcaaaggcagcactctcatctgtaacctggtgatagctgtattattaagttgtatttttattactaccctcttcagctagcactagaaagaggttgcccgaggaagagcccacatcctggcacactgctccccatcaatatggttttgcatgtatgtttgttattggggaaaaaaaccagcacagatttttcaatatccctctcccgtcctattcaatggttttcttttgttgtttttcgtgatccattagattttatacagaaccaccaattacccaccggttggtttagactgttgactgggaagccaaatatcatgtctcccttacccagcgactcagcattgtagacttttgttctgttcatttaactacgtgctctctgcttttttcctagaaaggaattttcctgaattgaaatcagttaataaaactctttttctttctttttacagcttgtacctccttttaaacctcaagtaacatctgagacagatactagatattttgatgaagaatttacagctcagactattacaataacaccacctgaaaaatgtaagtaaatttagaaggcaattgataaatttctaatataatttctcctaatgtaattgaagaaaacagtcttttaaaaactcatctgatattttcaagatcaaattccacagtgacttactccattctatttaagaatattgaatattgaattgaatttaagaatattgagttcccagtggtaatatcaaaagactgcaagaaatgcttttctgggtaggacaaattatatagagagaaattgtagatgaaattacagactagctcttccttactgttcaccaatagattgttttgacaccaactgaaaggattgtgaaatagagactcccctctttcctagacttcgttcattcccacataaccttcagaattttgccagttttggtctcctacttacttaatagttttaaaattcatgtagagtcactcctttttacttagctctctcttaaatagtattatctgtgaagacataatttagtttgctaatacttttggatacctataaattacatatttatgaaaactgtgtgttcatgtaccacttcaagtcaattcatatacattagtatgtctcacacttggagaaataccataaataagtggagctgtaatgagggaaaaggtgatcagacataattgataaacattttcatgctgacagaggtctgtgtgtatcatcattaacttaagaatgtggataagattgcgtttcagggcaatatttggatggctgcaagaatgcttcaagttacacatctttgggttcacatcatagtttttctttccttttctttttgattccttccctatatgtcttctcctctcattccttttttggaggcagatttatccatagtgctgatgtggactcagtgtccgggagaggggcgattggaggctaatgctgtgccagagatggtcacaggcagcagattctactgtcgagaggcaaacaaggggtcatgtgggccaagaggtcttaatcttgggaccatggtctggccacaaggggattgtgaacaccctgaaagtgaagatatgatgacgtgtgtgtgcttttctttctttagattcacaaaaagttaaggtgctccaggtcctgaagttgggtcagccatagccagaagcagggcttaccaacttgaccgatgtccaggctaagttgtgaaataccaatccattgaagtgagctactcatggtcagtcctgtggtgaggcagagtttccactcaatcttgtgccattgctagaattttagaatcactaagagtcacagacaatgttggaaagcctgtggagtcatgggcaagtagctcagcgctgagtagaaatcatgggcataggccttggcctctgtccccagcatagactgtggcattagaattgtccaaaatgctgggtaacaccagtgagttttcggatcggcccatgggcagttcctgccatacagcctttgctaggccctttcatttggatataatcctaactgtaatcagaccacatcattcctctgcttaaaaccttccggtgccatcccattgcactctaaatccaaacttgctcacactggtttgcacagcactgactgatctgggccctgtccacctctctgacctcttcctgttccatcttcccccactgtccctgggttccagccacacctcgaacatgccacacgtcaccatgcctcgggctctggggacagtatttatggtgtccaggcctggaatgctcttcttccctgatcttacttggatggctccttcttgtccttcagctctaagcttacatgtcattccatcagagaaccttctttgacctcctagtctgaagagcatcagtctgacaacattccctctctctcttcattctctgcattggcaccttgacttgctggtatttttctgtttgtttggttagtgtctatttccgccactaacatgcagtgggttggagaggaaggatctagtttgtctcattcgttattagcccaagctcctagttagatgcctggcacagtgtgcgtattcaataatacttgttaggtgcatgaatacacagaatatggtgagggcctaggaacttcagagccgggaggacacccaggcttgcctcccctctgaatatccaaagcagatattgggataggaaggtcttgacaggtctctttcctcagtctcagcctctgagaaagtttccattcttaaatagagcatttggcatttgcgtacctttagagcaagtaaatatgttattttggaagtcatagaaataagaaggctctaaaatgtcaagccaggagtagatattttacttaagaaagctaaaagtgaaatcccaatttgggacatggagtgaggctgaaaaagcccaggactcagacctggggaacctgccttgtgtcctgcctgtgccccttacagttctgggcgatggccggtcactttgtcccctggaaaagcagggagcagggctgatagtctctcagtggcgtttttgtcctcccgtgtgcctgagaagccgtctctttaggagaggcaccgagagttctgccaatttgaatcaccctattttcaattctgctcaagcaccagattggctagtccatagtgttactgtatgctgtgggccagtccatttagggggatgataggcccaacgcagcaagcacctggctgcaggggtggtgtagtggagggccggcggacagggctgactaatgcgatgctcagaaatgtgagactagaaagaccagagcaaatcaaaatggatttgggtacaaataaggtcaattagaaactgttgtatatgactcttaggctagtcagtcattttttcatgattgacttgaatttcaaagccctagctttcaaggaccagaatctcttcgaaattcatcttacctgctttattccttactcgacacccgcggggcacttgtcctgatgagaatttgtcattagtgtgcattttattgctcaatctctaggacttctaaaatgagactgaaatgttagaaggtgttagaagtcccccagcacagtttctagaacataatttgaacctagttccttggcttcattaatcagcaatataaaagccatcaagaatgtttttcctggcatgtcatattttaccactgacagcacctctgttcttaaataacatgtgtcatttcagacatggatcatgctgtaaaagccctacaaccttggtgtctttaaatgataataggttcacttctagattgagacagagatacctaggaagcctgtacattgtagtaactttcaagatggttatcaaaatccacctgcaattgtaggaccacaaaagtctggcttttgtctaggcgcagtggtgcacacctgtaatcccagcactttgggaggccaaggcgggtggatcacttgaggtcaggaggagtctgagactagcctggccaacatggtgaaaccccctctctacaaaaaaaaatacaaaaattagccagacgtggtggtgcattcctgtgattccagccactcgggaggctgaggcaggaggatcgcttgaacccgggaggcagaagctgcactgagctgagatcacaacattgccctccagtctgggtgacagagcaagactctgtcttttaaaaaaaaaaaaaaaaaaaaaaaaaagtctggcttttgtgggtgtcagaaatggggtgtggtcctgccctgctcctgggccctggacagtacggaaacgagagcccagcaatgtcatctgtttctgacagggcacaccgcaattgaggggtggggagggcgctatggacttgctgtgtttttccctattcaggacctctgtagcaaggaaagtcagacggaagagctcagcagagtatgcccaggcaaagactagcatcgacgcatctgcaggcacctctgttcagcagcctctcctgctgtctgtgtggctcagcagagcgcagcgctcagcactgggggccatggggccctgggcttcctgtcttaggggagcagccttgatggtggttaactgcagcttctgggttcttctagggcaacggggcagtatttttagtttgacagttcctggatacatcctagattcccttaaggagcagataaaatgagaatcactgaaaccttgaacggtgattacattcaacataacctttttcttgcagctttgaatagtttaactggtaagaaaccgttgcagctccctaagtgctaacacacagaggttttgttgataaaagtccagggtagtaccattcgttagcaattgtcttcccacttgccaccttgcttgtataaaacagaatacagttattgtttagaacaaatcagcagttagaaaggcaaaatgttccattttctacaaacagctgcagtgacatgccagattgtcctcactggcgttaataatggaacagatttgggaatgtgtcatctttcgttatcgccattgatggtcctcctccttcctcttacagaaaaagagggtttctttgagatctggtcgcttttactgccatataatgccatttgttaaatgttctaagaaaatcaggcaactgatgttccttggatgcagggattcaagggatgtagcaagtagagttgatcattgtcttctttttccagataagtgtttttgaaaaacatagttcatgttcattatcatcactattccctatgcacagcctctcacagcaggaactaacttgtgtacattgacaggctccgactcagagtcagctgccacttcctccagctcccctcccaccgcagcccctgcccaggctctcagctcttttagggccatgatcagatgttcacgcctcattgtttccaagcctgacaacagaaaggggcaggaatgatggagggagatcattggctttaaagaatatcaaggattggggccctcagggatatctgtgaaatttcctagattcagaattgtgatgaatgtgttactgaagtgacagaatgaaggctgtctctcaattcttagctgacaccagcaagagtccctcctcttccaaaagggtgtctagcacctgcccctgttgagcatctggctaacctgggtgctgaacctcgccgggctggaatgagtcctggccatggccccaggagtccaggcagctcctgcccttcctggctgagcaggacaagcaccaggctccccactgctgtccagagccagctgcaggtttgctgtgcagaaacactgagtaaaataaagctgttggtgaggaaaattgtttatttgaaatgtgattggctcatgtcagaatctgaacattaaggttttagctgcccgtattctctagagagtttttatactctggggctcaaccacgggtacaccatcattcccagctccttccgtttttactgtagctaaaaatactgctgaaggtatttgatctaaaagatgtgtgtgacttgcttggtacaaatattggaaccaataactttataaggaggtagagatttccccaaatctcaataccttctagaaatgctgactgcagttacagtggtctatttgcagaagaagagagggcctccgagttcagtgtcttacacagagcagggagccacaaatgcttcttgatggatcagttctcacctaatacgaggatatcttctggtacattaggggtcagaaattttggctaatgccagcttgatcccatttctagaatcttctgcattaagagtgggatacagaaaagaaaaacagtgatacaagaatggaagtgtttattcttcagacaaaggcagagccccctcctcttcggagtgacagagtcagagcctcagtgcagtgggatctggcctgtatgctttctttgtttacacccacatccagcggatgctccctggagaggttagaatattcaaaaaaattggtaatgtacttcctatatgggtttgaggacatcgaattattttgcttgaagagaaaagggttgagtattggaaagattcactgatttccattgcaggacagcatatgattaaacaagcttagaggcaagcacgggggatttaaaatggagcacctcccccaggagactgtgaggccagggggcccttgggactttgttcaaagttctgcggtccttgggcctgacgggtgctcagcccagagcagatgcgtgggagcgcatgttgactgagtggctgaccacgtggccacataccaggaagagcttccaacagcacaggactgtcatcacaggacatttatgagaacagggtgctgatcatctgtgatctttgaaatacaggaaaccaggaaagctgacaggaggaacactgtgattgtcagcggcctgttttgatgcctttcaagtctcttccattgtttcctgatgagctaggactcagatgttgacatccttccctctttttctttcacttagtcccttcatgctaaagttttatcatagggaaattgggaaaggtgagttaagccagatgctagatgttgaatgaaatttcataagaagctttattttgcagttgcacttaaagcatcacaaagaaaaaatataagcacttgaagacattcgatgatgaattctatacagactttggatgctgtggatttcactgacttgcagttttgatatatgtggttacatgaaatgaaaggttactgaagactgctccttcttaaaaacttctgttttcttcaataccatttttttcactgtttcattgagtcttgaaattttgatgtcttagagatgattctatagtattatttcttcatagactatgtatttatgaaaatcagatgatttttgaagtataattactctacagcttattgatgaacacaagtttatgggagctattgcctctgttcatctttcctatgttcagagtttaaaaaacatagactagagataatgttgcaaaaaatgaatgtgtaaaattaaaatagatgtttcctgcccacagatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctcatgttcttcaatgttatttgtcttctcatttgctggtttagtcaccttttatgatgaaaactgttgttggagaaaaaaacctgttgctaaaaatgtggaaattatatgaaaagtttgtgcctcatcttgtccacatcaaagcccttcacatatgaaataaggttaactggtttaatgggttaaatttgaagacaacctagacaaaagacacgcctgcctcttaaataaggacagtctggtgttaggacatggccagagagccatctcttctgtccgggaaaggacacattgatttgtgccataatctgtttactgaaaatttatctgaccttaacggcaggtaattctagaacaaaaacagggtgtaggccaagtgcccctaagaaattcctcgtgaaacaatacaagctgaaacacctccaaatttgtaactgcaagcaatttattgtaacctatgaaaaagtactttcacatggaaacctcacatgtgttggaagaggggattgggtgtactgaggtctcttagttttacgcagatacaaatgttccaaagtagcttcatgcagatcaggttgggggagaatcacaagttcagaaagtattgaatactgttcctggcctctgctgccatggctgcccaaattagtttaaaccacatcaggaactagagtcagaagccactggaaatgtttccactccacaaagcatgtctggagtttctactgtgcactgtgtgggaaggtgactgggccacagtcctcgccctctagattgtgaagtccagagaaaagccaggatggtattttccaaatcccggtttctacgtcagataaattgggacgcactgcagggccaggggcccaatctggtccctctttctttagttaggaaccatcttccaaaaagagaagtgggcctgcccctctccagtgaggattttccaagctggactccaagggaggactctatcaacctaatttaagccatcattaacatggggatttccaagacagggcaatgagtgaaactgaatccgcattcaagagaaatatatgaacatcagcctgttgccttttatgaaaaatgagaaaaagtaatgtttacatttcaagtagatttcccagtgtgtgagagaccctgaggacaactttttcttgaacaggtctgtgagtagtggggtggtctcagcagggtagttagagtaggtggggggcctggcctcaggctgaatgcaggtggggctccggcaggaggcctcactcctcctcgtaaacctgccatcccatgcacacagccctcccaggcccgtggagccaggtggacaatttcctgggcccacgggatgctttgttctccaggccctgtctgagtggcccatgaggagtccaccccatgcactatgccctagagccctgccattgcagaggggactcccttctgtcctcagtgggatactgacagcacggagactgccaccaacacgatctgattgtcaaacgcagggtttgcaccaagctgacgtgccctccaggccaggtgatcgaactgacccagcacagtcctgctaaatgactggtttgaatggccctccacccctgctccatggattggccacataaggcaggtggcctggtggcctcgctcttgacacagtggcttcctaactttagaaatgctaggatgactgaatacaaaagggataagcataaatcccaacagataacacttcaaaagaaaaacaacccaacagtggctcacacctgtaatcccagtgctttgggaggctggggcaataggatcgcttgagtccaggagttcgagaccagcctgggcaacatagtgagacctcatctctacaaaaaaaattgtaaaaattagccatgtgtggtggcgcacccctgtagtcccagcgactcaaaaggctgatgtaggagaattgctgtagcccagaattcaaggctgcagtgatgaattttgggtagagaacacacccacgtacacacaatacagaataggcgtaaagacctgaagtaaaagtaaaatgtgttgcggaattttttgataagctccaggaaacaggcatttctcatgatgagtctacataatgcctgtgggctcccaggccacctagcaatttatcactatcggagctgttccagaaacgggtgacctcctgattccgtgggcctgcatgggggtgacacagatgtacgggcctcaccaggaaccaatcaaaagtcagcctgattccttcctgcggcagatcagccatggccatctctatgggctttgtatttcctgcggttcaggtgagaagccccatatccatccccactttcacactgttgaacttaccgttcactgctcaacgcccccccccccacccgtgcctacagccgtgcctgacccatggtgagcgttcagtcagcactggagggctggataatttgtcctaggaggtcaccgttttgtcgcctccatttgctgactctttggtaacacacatttctctgaccgagacagaagccttagttactgcccacatctggcttgtctgccattagggatatccacgatgcttatttccaggaagtcctgtcatcaacaccacagtgatcatggtctcgtccaggagagtagagcgtgcgtatgccagtgggacatgagccctcagccagtgtctcccgtccttctgcccttccatttgtcatcatggcccttgctgtggccctcctgtggctgtcctgcagctcagaggggggcgacagggcgccctggccactgctcccctgccgtgctgtccacaggtggtggaaacgtgcccccatctgcaggcacacagctgctaacccattttctttgttctcattttaaatcctatcggagtcatctctccacaaaccctgcctcatttatttctaaagtttgttaagttctgagtgtaagaaatcagttgctctgggtgacctgaactgttccccaggcaaccacactgtggggtccagccagcctttgctgctgctttgttcccaaaccagccagaagtggcagcccggggagatggtggcacccctcgcccctgctcacaggagacctgcccgggcttcgcacttcactgtctccgtgggtggctctagccaacccttctgaaggtaacaaccccttccccccctgctgtccgctctgctcactggcacgctgtctctgtttggccaagtcaaaacgtggtcctgttccttgtgtgtctggcaataaagcatccatttgtaactggagagggcaggcccctccccctacctccatctggggcatttcaaagctggccctgagttgacagagctccagggcagcccctgcctcgcttggtggctcgcctcccgcctccgcctcgtgttctgggcaccggggccagggctcggcagctgttccagccaggcccggctccgcccgcacccgctcgggtacctgcccccatccacacatcctgtggcctgagaagaagttcatttccctgcccagccacttcccaattccattcacttcatttctctgggccttatttttctatctgtacaaaatggttatttatctcaaatggccctttcaagcccacaatgatctcagcactaatcctgttggtttcataatcatctgtgctgggctctgggtaatatgaggcacttccttttaaagggaagctggttctttctttttctctgccagaaatcaagtgacatgaaagctaacacatgtctctgaagcaacgcagagctgagattcgaatccaggcagtttgacctcaaagtccagactctcccatgcgaggctctcctgcttgctctggcagatgaggggcagccagtttgatatctacggaattaagctgccaaattgggaaggcaacctggatgaaataagccacgtgagctctggctcgccaccaacgcactgaggagagaggtgccctcagcatgctgggcagaacgtcggggaaacgcggccttcgagcaggaccgcccacctgtcagaagggagcactcctctacagagccgaggggcagtcagccaccctcaggcccctgcggccctgctgtccccagcacagcgactgaagttctcactgaggggcctcgtcccctccgggtcaggcctttccaggaacctggctctgccagctgcaaagcaggcgggggctcacggttaaggccatcgcagggcagcggccattcttccctcctggctgcccggctgggcccctgataacagcctccacaccgcagtcagagttcaaagccctccttcccttccaccgcagggcttggctttgctgcttctgggctccgagaaaggaacagggccgcagaaaccagaggaatggaaaggtatccacagagaaggccgccttgcagacatgaagtgggacgttccgtaagacagcatctcgagctggacttggcggggagagggaggcggccccgcacaggccagggaggccccagcacacatgaggccggggtggaggccctggctctgcggtgccacctgtcctccccagggcgcacccaagcccaagggttccttcccaaccgtggggtctgagtttgtcatcttccagctttctcaagtcccctgagtcatgagaacttcctctacacacaggcaggtctgtgttttatatgaaccatgtttccatggtaaatagattttaagaattcccaaaggacagacagtgtcaccaacagcagagagtggagcctctggctgcctcatgtttgaaagtgttaaaaataaagacaacactgacatttggggttgtaatgtgacggaattacagtcttttaaaggcaagaaccacttatctacactacatgcaatattcagtgttttgttcacttgtctaattggattaaaatatttagctccctttaaaatcttgattgtgaatttatattgtgaaatgtaatgtctgactcaggaagcaataagtagagtgaatgtatctgaaggaatataaaattcaattgacttttctcccatgattcttattctgaaagtactcactcttggacaaagtgaactgttaacggaagagcaagtctggctaaaatgaagccctatgcgcttttcaatattaattatacacggggcgctcagtcaaaaaacaaaaagtttaactgtctgctgttggaggtgtttggggaagtttctccgaaggtcgcgagatgcttatgttagacatgcagcacccagggtcttgtgtcattttttaaaaacactcaggcagcagggagttaatgacattttagctgcatatgttcaagtttatttaaaaaaatatgcaagtcactttggttgacagtgtcttgtacacagttttgaaagaatcagggcaaactttaacagagtcagtttttatttgaaaaatattttctgggaatgtatcagtgtttatttttgagactgacaattcgggtgaaaatcaggataaaaacaaaaaaacaacaatttggttgaaatcaaattgtttgttttcatctatttagaattctttccaaaaaatcttggttcaggaggaggctttttaatttattttattcaatgtatttgctgttctattcaagcgccatctgtcttacaggtagctaactttgtggtagctcctaagtcagctgggcgaggcccccagggctcctggaaggaccacagtaaattaggtgacacctccaaggcctaacatgggcagcctgcagcagctccgccttgcagccaggcctccctcggcagggagtcttgctccctgagagctgtcacttttctagaacctcccttctccctttgcttccagttgcaatgggcctttcctcccttcatcatcttctgtgtctctgtgtcccctgcttgttttcggctctcttctatgagtcctttggtataatgagataatgtcgatgatcttgaatataatcacatatggctgctggatccatgcacaagtttaaatcaaattagaaagtaaattcactgccaagaatgcttaaaagtcatagggccaactgattaaccactgacaagtcagtttccgactctgttttctaaactgtaagtgattcatatgaggggactaaaagggaatcactccccagattgaacactgcagacagaaccaagcagcctgctcaggatacgacggctaccagaaaatgcaagtcagccaaaaccgtattcattaccaaataagaaagcagacacagaaaatcatcttgatggttgagaccatcctctaagtggacagataatttctgttttcccctgtcccagatgccattctccccaagactcatgtttcctcaccagctggctccaaccttcctagccagatgttagagcccccaggctctgggccgcagacccctgaccctgctccaagctgtcaggccctgcccaaactcccctgagacccaccaccctcaccccgaatccccctccccccacccccaccaccaaggtttcagcctcccccagccagggcctgcctctcaagagggcgagagtgcgactacccagcccagtctcaaacaaaagacaggccagggtgtgtgtctggaggccctgaccctcccggaatacagagtgtggggaactgcatctaggcaaagctgggctagtgcttcagtgtctgtttctccacaaggacaagtaagagccatttcatgacatttaaaagctattttcttgaagttgtttccgaacccaggtgaggcaggagatcaataatgccattatttgtagtcaccctaaactaagaacaagccaagaggccgggcaaagctcatgcctgtaatgccagcactttgggaggccaaggtgggcagatcacctgaggtcaggagttcgagaccagcctggcctacgtggagaaacccagtctctactaaaaatacaaaattagccaggcgtggtggcaggcacctgtaatcccagctacttgggaggctgaggcaggagaattgcttgaacccaggaggcagaggttgcagtaggccaagaccatgccattgtactccagcctgggcgacaagaacaaaactcatcaaaaaaaaaaaaaaaaaaaaaaacagctgggcgcagtggctcacgcctgtaatcccagcactttaggaggctaaggtgggcggatcatttgaggtcaggagttcaagaccagcctggccaacatggcgaaaccccgtttctattaaaaatacaaaaaaattagctaggtgtggtggtgggtgcctgtaatcccagctacttgggagcctgaggcaggagaatcacttgaagccgggaggcggaggttgcagtgagcagagattgcaccactgtactccagtccgggtgacggagcaagactccgtctcaaaaaaaaaaaaaaaaaaaaaaaagccaagaaacgagccgagagcttgagccagtgccctgagtcctgcccaccgcagacagcgccggggagcggggaggatgggggttctcgtggccaaaagcatccatgtggcagctaccactaccaggggctccctctgccagccatgttgttgtgagtgtttcagaattcaagcagaaacaattagaataatgaagcctgccaacaggctagacacttcctgttggaggccacaggccagcctgagccccaccaccaggggcagcggggctcaggacccaggacagggagggaaggaaaggggtggactttgctttggaaccattgcccgacccattctcttctgggtattaagtggacagagatgtttagagtttgacatgcaaaattaagttaagcttaactcatccaggctgagaaaacggaagcctttagttaaaccatctctaacccggacatgaggacagctctaaccctcagctgcccaagatctggacccacaggccactccaggaaaacagagagggtggctgagcactccggagccctcaggcggcaccgcatccaaaatacctgctcgaacctacagcagcctcgcccacatcatggctcagcagaagcctaactcacaactcaagctgattccatgacaagaaggcatcgcagaggctgaagcccactgacagcccctacctagaggtgaaggccaggcttagccagaaaaagcaggctctgggtttagatattcagcagagagcttgcaaacctggatccctgcctcctctctgaccactagtatttgcaactgaaagccaacattccctctaccaaatttcttttgtcatgttcatattaaaataactccaagtgtaatatttgaatctgaaaggccgctttagagatgagccagatgggccagtatcagatagcacaggaatgggcaaatcattgctgttgcttcaggcaaaagaagaaagaaagacctgctagtttttctgaggattttttgaggtttggggtttttttaatgcgttttgtgaaaattttgcaactcatttggcaatagccagatttttaaagccctggaagaagcttctaagcatcggtgatccatgttaagatctaagtgtgctgtaaagcaggcagatggggagttaaaaggcaaagcccacgttctcctgatctagtccagagcccaaaggaagctgccgtgtgctccagcttccacggaagactccccacaacctgaggtctgacagagttcttggctttagaggctgaagattcactcatgccaggagtcacggtccctccctcctatgtgacaagagcctagtcacctgccaggagacctagtggctccagtggtcctgatctttggctggccaggcctaaagcaggtgctgctggggccctccctggggacctgcccacagggctgggttctgggctgggtctggtggaggatgagggggtcatcctgaaagcagaggggaggggagtggcactggtcccacagctgctgctctgcaggcctctgccttccctgaacctctcccaggaccctctgaagatgagggagaaaggaaacaccctcacacgtcctcagcctgtgtgcccaagggcccgtggggcatcccgcctgcactcagcactcccagtagcccgtgaagccaggcgtgcaccatgcccactgtgcagaggagaaactgaggctggaaaaaggcttaagttacttgtccgaagcgggggcaggggattcagcacagtgacacaacctggaataattctctgttctttccagctccaaacacttcagaggttttcaaaatgtagtgtcgtccagaatcatcccaacagcttggcaaaattcaggttccagggccctgccatggagcgtgccaggtgaggcctcgcctcctagattagctgtggcagtgcggctgtggctcggactttgagcggcccgctcccccacagtccctgggagcagtctcagaagcatggggacagtagaggcatttccacctccaggccttagctccgtggcgcctgggtgtgctcatttactgtctgtgaacacatgtttggcagagggattttggaccgagtgggaaaagtcagtacttacaggttccttgagcacagggtcattttgtgaggagaatgagactcctcttcgttttcatttccagatgcatttttcatattaatcattccaagcacttactgcctgaagtccccagggcactcacagagcacctgggtgcaatcctaattaaaggcggaggccttggtcagcccacggaccacctcattatcctaacaaactgcttgacggggcaaaatgcacagcctctctgacaggaagagaagcgatttagcaaacgaggtttcatactgtgttccaaattcaccgggacactttccttcctcccttttccctgctggtggccccggatctaacctgaatggggaaagcctgggctgtggagtcaggcttagcctccgtttgcggtgtccctacttgccagctgtaatgcttgtctgggccttagtttccctatctaaaccatgaagacaataaagtcagcatcgcctgcttgttcaagggtaaagggaattaatgcatgttctgtgtgtaacactgccgggtgctctgcaagcactccagatattagcccagtaatcagtcagctaatttaggatgagatgcctgccttccattcaagacgactttgctaattgggaacacctctttcctcaaccaattcaaaccatacacgaccttcagaggcagctcaaggccaccatcctccaaaaagcctgttctgccgcccacggccgtcctcccgcttctccctgctctcgcaccctccgcagcctgcacggcgcaacttggcactcggtgtggttcgttgattcgcgggccggggtctgttcacctgcacggactttaactccctcaccaggacgggcccatggctccgcttctctgggtcctgcactgtgcccagcacagtcttcgggacctccctcccagcttactgctaaccgatgtgatccgtgagaaagccggcctgttgaggtgcataaaagatccacctgtagacgcccgcccaaggactcccacctgcgccgcgttctgcacagtacctgggtccgcagccggtccacctcttccgacaggctctgcctctccaggagaagctggttctgcttgctgaggagctgcaccagctgctgggctgtggcctggctgtgcttatccagctgccttagcctggagaaaaatccaccgcagaattaaagagggataacgtcagcctttcaacaggcccaggggctgtgtgtatctgagggaagcccctgatagggaaccatgagcaggacgcctagggtgaccctgaggtgccaggctctggctggcactaggtccttggtacgcactgtgtgaaggtaacattctagcaaatgtgcgtgggaactgggagccatctcagtacactatcaattagaaaacacgcagataagtggggtaagtagaaggaaaaggaagctttgaactcccaagcagaggtcaaagatgaggggcctaaatgccgccattgttcagctggaaaggtctctggcaggctgagcagacggccgccccggctggggaagtgggtgagggccgtggaaacactgaagtaagggttttccattattaatcactcagtcaatcacgagctccggcatcgctgaccagatgtctttaaagatcctaaatttgtcattctgctgatgggcgctcctctccagacttgctaattcactcagaccattatcctcatctgtccacagtcggcttcctacagccagcagcacagtcacccatggaactgttggctttggattaaatgtggaattgaacgactacccagaagtgttctggaaagaagcgagatgtgtggcctgcctcaccgtcctcacccatcaaaagcaccagcaggcacgttaactcgaattctcacaaggaaaaggccattaaagctcaaggtgcatttcaaactccaggctac

SEQ ID NO: 37747 - DNA, 355023 bp, Homo sapiens; identical to SEQ ID NO: 37746

SEQ ID NO: 37748 - DNA, 91181 bp, Homo sapiens; identical to SEQ ID NO: 37344

SEQ ID NO: 37749 - DNA, 205721 bp, Homo sapiens
gccaagcctcctgcctcgcaggtacctcctcccgcgcgcacgctccgcgcctgatggcagcgacaagtgccggctcgcggagagctagcggggctccctgggcccggtgcgcccgacaataacgcgtgaataactttttcttgcagcggtcccccgcgtcccggcctgcagcctccccgggcgccggcgcccccagcacgccccatcgggcaccccactctctccgaggtgtgggtgcggcgggctgatgaggtgatccctagcccgcctgggaggagcgcctggactcgcgggcggcggcgagcgcctttacaatggccctgaccctgtttggtaagtgcagccgtctccccgcgccgccgcaggtgggccgcgtcccggggctcgggggcgggggcctggggggcctgggcgcccggggagggggcgcggcgcgtggggtcggggcgggccggggccgcagagttggggcgcccggggcgccggcttgctccctcgcgcctctcccattgtttcctctcccggcagggccgatgggcgtgtgctcccctggccaattctcggctgggaggctcagaggtcctgggtgttttgcaaacgcacaaagattctctaagatgccaacttgggagtgaagttaactggttgttttcaaacctgcctttcccgtcggtaaataaatccttggaaagtttatttattttgaacgaggtatctgtgagtccccagcctccttggaattgccaaatgcatgtgttgcttcctgttggactattggggaattttttttttggactcagtatattccgttggaaataagtatgatttgtgaactgaatatgggttaaaattgaaaatgtttgcactaacgaatgagagcagacagaataaagttggttaccagaagataactgtaatctcaggagactgagtattcattaagaatgaaatgttatttttgtggtgtaattactgcagcactgttgcttttggtggttaagacttcaagctgtttttttctcagtctgcaatgacaatgggttgggaaaaaggactgaaaagatacattctttccttttacaaaacgactatggtacatacgtacctgactttaagaaaactcaatatgtgaacattagacgttcaaagtattcagcttttttgaagaagcaaagtacaatgatatgtaattgatagctacgagaacagcctaagtaagttattcacaatatcaagtttccagttcagttttaattatgtcatttgatcaaacacgttagaggtgttacatacctcaaatgctttttgaggtaaatacttcccagtgaattaagctgctagaatcaaagtgttacttttatttaactatcttattttataaattaaacttagacccagagaggttgtttcccaaagtcacatggctcttttgtggcaaaactgagcctagaattcacttcaccaggcttcagtctgggactgtgtttactgtgcccaagtgcattactagaagtgccatttcttacttggtgatgatcctccataggtactttaaaaaagtgtcttctttttctgaaaaataataaaattctcgctgtttctcagtaccttgtatctaagcattatttaatagcagcattttccttaaatgtggacctttttggtacaaacattttctttcctaaagagatatttggcattttcaaggtgtggtttcagaagtaaggtttacaagtcaacttttcaaatactcgcattcctgacgaataaaaaagataaattggggtgaaaaatgctcttttaaaaggatttctaaattctaaatctttaaccactgtggtgaagatgaggaagggaaaagcatggaatgtggcctatagaagaaagtataagaaatcactcccagccttcaaaatgaataatgtatctttaaaattttaaagtctacttatgggaaaatagaattcacttcccaaaatccagtttgttacagtgtgaacgtttctgtgttataaaacaaagcactcttgagtgcagaggctatttgttaagtagtgatagagcagcagctgtttttaaaagtggttgtacaccactcatcagtcatctgggatgtctattaaaaatgtagattcttttgcccaaagacatgggggaaggggattttaaagtgactccctttgtgattcttatgctcactcaagtttgagaactgttgtattcaagataaatgctaggagattgggtcaaactcgcccaatacaaaatagctttttgtgtatgttgagagatgtacctaagggttagaagaaatggattttattttagattttactacctttaactagttggtcttagtcagaagtgcctcatgtcccttcatatttactcttaatgaccaacttagaacagaagagcaatggagcaataaagttctgtgagatggtagtgaaaagagttagaggcagggacctaaccagatcaacaggatttgtcagagctcagcagagtttatacctgaggctccccagagtaacgactgccagggccctatcttttgtatcttggttgattagttagtgcagtccagcagtagagtctagactagttatttgctttgtgttttacattttctttccattcaggctttttataaatttaagaaatgttctttttatagggagttggtgacttagttttaaaaagtggagcctctaacattacctgattttgtatttgcatacatttaatttttttcacctgttaagtatattataggaactcgaatacttgttaaattaagctgaatagttaagactgttttatctctcatcctcactgttaatcacctttgctgcttaacatatttttaatgcatattagttttattttgggatagaagaaccagaccccaatcttgaaagattttacagtctcatttgggaattgaaaatgtgcatttttgaaagcttaagaatttgcacccgtttttcttctcctttcaaatgaactcacatctcattatcagcttcgatatagtttttaaatcccccaatttcaaaaattatccaaatgtattacagactctgctcgctcaccttgctcattttttcagcaaacatctgtcacagcgtacaagagacatggtcctctagtggcacttcagagtcttttctagaactatagcgaatgcacctaattcactaattacctaattccgtatagtgagtggcacttaactattaactaattccgtataggctttgtgagaacttccttagtagagagcacatgttttctagtaattactgggataaaaggaaagtctcagatccttgaatatgggaatttgtggctggtgtacctgacaaaatgtcctgattggccacaccaatagagccttagttggcagagctgggtgaataagcattctgccagctcttgccttggcaggaatctctgtcatttatagcttaatggggctgtggtttatagcccagaccaactgatgcgattgggaactcagttaccgtcggctgggctggctgaaccttgaataatggtcctctatctgggtagagtcacctctggcgttgctgctcaccctccttgccccttattcttgttaccatttagtcaccatcttactaccatagatcacttctaataatgcttatgattttgctataattttgtaccatctttcctcagacccttctgccatggaaaccttttcattatctcactttattcagcatctgtcactaacctgacacacctacctatggacatcttttggagcaattaaatagcaatggcatattctttgtgatgtagttaggaaattttctgatttcccataggaatgtcctgaaattaaaatgtattttttaaaagacaagtcaattgaagattttcatatttgactgaaagctaattttataggaagttcccacttgactatactctctgctgacatttttatttttcagttgtccaaagaatacaagaggctggcccagtggtgtgagctcatctgcctttttcagaatatattcttttcagctgtcatttaaatcatcatccttatttaaatttttgtccatgttccttcttgtactggtgtcaaaacttaatattttagtcagacatggtggcaatgtgcctgtagtccctgctactcaggaggttgaggcaagagaactgcttgagttcagaagttcaagactgtagttgcactatgattgtgcctgtgaatagccactgcactccagtctggacaacacagcaagaccctgtctctaaaagagtaaaaataagaaaacccagctgggcatggtggctcacatctgtaatgggtggcccatgcctcctggcactttggggggcctaggctggaggatcacttgagctcaggagtttgagaccagcctgaacaacacagggagataccatctctacagaaaataataataataataaagcctgggtgcagtggttcatgcctgtaataccagcattttgggaggccgaggtgggtggatcatttgaggtcaggagttcgagaccagcctggccaacatggtgaatccccacctttactaaaaatacaaatattagccaagtgtggtggcaggtgtctgtagtcccagctacttgggagggtgacacaggagaatcccatgaacccaggaggtagaggttacagtgagctgagattgtgtcactgcactccagcctgggagacagagcgagattttgtctcaaaacaaacaaacaaaaaaaatcaggccaggtgtggtggatcatgcctgtaatctcagtactttgagaggctaaggtggatgatcacttgaggtcgggagttcaagaccatggttaacatagcaaaaccatgtctctactaaaaatacaaaaattagcctggcatggtggcacatgcttgtagtcccagctactctggaggctgaagcaggagaatcgcttgaaccccaggaggtagaggttgcagtgagctgagatcacaccactgcactctagcctgggcaacagagtgagactccatctcaaaaaaaaaaaaaaaaaaaaattagccaggtgtggtgatgcatgcctgtggttctaatattttagctttaaagtttgtcttttaatgtgtggagagctggtactatgtaagaacaataaaataattatagttgttataactctgatagtcaccatctgtgtacactgtagaggaatgttggcactgcagtcttttgagtcacatctgtctctgcaggtaaccatcctataagcagcctaatttttgaacatagaagacagtgatatgtataattatacaaatttgacatatttgtcaataaagattttagtttcttttagattactttttctcaaccttttaaaaaatcctccctctcccggccttttaggcctgttttctaattgttctccccatgaaaatttaataccagagatatactatgtatctgtttatgtactgtagatatatctgctttctgcataacgtaaatacagtacttttttttaccccaactctccatctcctcaactcattgagaatacatgttttatactaatttaaagcaatcataaaatagtgaggcagaaaaatactgtttggtcatgctttatatgttataataatagttttaaaggaatgacattagtataataagttataggtttttcataagattgttttaacctaggaatttactatcttgagagcagccatgacaaagagtaccttgctggggctggtgagggtgtagcgtttctccaagtccctctgataaagatgaggtcctttgctatgggcaattgatgttttctcagtcttatagaaagcatcaattacagcatctttagaagactttatttatctgaaatatgtaaactaaatgaaatcacagaactttctgtgcaaactcaattcaaggcaagtccttgagcctggccttgtaaccaaattaccagccattagttattcttacatagaaaataatttctatgaactttgattttttttaattaatataatcctactatccttaaaaataggataggacaaaactaaggaaacagggtacagtatgaccatatttacattgaaaagtcatattgaatagaaaaaaaagcctgacaaaataaagttataaatatacattcctaatttggctgcttatttttaaaagaatagatactttgtgaatacactaaaaaccactacattgtacactttgaaagggtgagttttatggtatgggaatttatgtcagtaaagctgagatatattaatttaaaaaaccacctgagctttaaaaacaaagattagatagaagaaaagaatggttttatatccaagaacctttaagagctttttacatttttagatttttttttacttttcttcctcaaagaacaaaaaataaaattaaaaattgataggtaaaaatgttcctacctgttttaaatttagaaaagtaagcacttcttggaaagagccaatacccacagttgagagaatgtgggagaagggaagatgagtcaggccagcatgtcaccagctgctcagtggcctggcatagagccacctcattgttttttatccagcagcgctgaaagtgtttcctttctctttccactctgactctgacctttcgattcctttggattgcatatgttccgtggagtaaggcaagcacaaggatatgtcagacatatctctccttgaatagatttttgtgaccacagacttgacatttcaaaactgaatgagtctgaggctttttaaactgcaaattcttcctgatttttcccatttctgtcataatcttcagctcttaaagtatgtttttttttttaatctcgtatcttttttttttttttttttttgagacagagtctcactctgtcacccaggctgcagtgcagtggcgcaatctcagatcactgcaacctccacctcccaggttcaagcaattctcctgcctcagccttctgagtagctgggaccataggcatgtgccacaatgcctggctaatttttgcgtatttagtagagacggggttttgccatgttggccaggctggtcttgaactcctgacctcatgtgatccacccatctcggccccccaaagtgctgggattatagacatggaccactgtgcccggccctatcttgtatcttttttttttttttgcgcccccgagacagagtcttactgtgtcacccaggctggagtgcaatggcatcgtctcagctcactgcaacctctgcctcccggatttgagcgattctcctgcatcagcctcccaagtagctgggactaccacacccagctaatttttgttggccaggctggtctcgaactcctgacctcgtgatcctcccgcctcggtctcccaaagtgctgggattacagacgtgagccaccacacccggccttttgtatcttttatatagaactttgccattgttttctgttctttaatggctgtgaagttactctggtaaagatgattttaggttttgaagtagttggtgctaggtttgacaggcagcaggtgagtggtgtggatgtccatttgaggaaaatggaaacatctgtttgactgaaatattttttcctgcagacctcccatgtaagtgaaatttacactattaaacatgatttttagcatgttacctatgaggaattacatgctgagcatagataagtacattcttttagcatgaaaagattatttcagcttatggatgaacagtcttaaagtagtaaaaacatagggcaggcattttgattgaggcaattatactgtaagagaaaagaaagtagaagttttagagggtggggctttactaagaaggcttgtaagaggtgatgtcataagcaaaagtgtgtgaaaaagcagaggacgttcgaggtctggggaaggaatggatgataccgttaagtgagagaagggtgtagaaactagatgagtactgttctataattttgccaaggagtagctttgaggcttttcctattttgtgatttgtttacccatctatctgatgaatatttagtgagtgcctaatatgtgcgaagtatgtatttgttcctgccatcaaggaatttatatttgcagtggagggagacagacaataaaacatgtataatgtgccaggtggcaaatgctttgaagaaaaatagaggagagtgaggggtaaggggttacctgtctcacaatgtcgggggagagggggtaggcctcacagacaggtgaattttgagcagacttgaaggaagtgagaaacccatcatatgaaatggggaaattgcctcatggagcaggctttgaagcaaggatgtgctgggcagttttgaggaacagaagggccagcatggctggagtggagtcagcaaggggaaagctggaggagttgaggagagagaggagagagggcagctgggggatagagagtactggggtgtatctcccatggcctggtaaggacttgagattttactgagtgagatgggatgtcatggaggatggtactttcgtagcatgtagtgtagtggaaagagcttggatttggtggtaagggagctatgtttactcctttctctgccaaggatcagctatatgttctagtgtcaatttctttacaggtaatcaggggctgttcccttatcccatctgtgcaggaataaatgagattattttataaggttcttagtatagtggttgaagatacatagtagctaatattgtcacctatatcgttattgtaaatattaacaaagattgaagataccagaacaatttctccatttaacaagtctgttgacccacttgaaaaagtggttttgtaatatttctactttgtgtgtgtggctgaataagtgccatgtgccattgcagacctggttcagggggcttacagtgaagatcaagtaggtttctgtgatagtgctggccactatgacactttctgttactctctgaaaatgtaaacaataccctgttcaacaggcaatgtttgcttctcctttgggaggtaacccagactatacagtagtctccccttatcctcagcggatacattccaagagcctcagtggatgcctgaaactggatagtacagaaccctattatctactatgttttttcctatacaaacatagcgatggcaaaattttaatttataaattaggtacagtaagagattaacagtaactaataataaaatagaacaattataatagtatgccagcattgctactcttgtactttggggccactgttaagtaaaataagggttatttgaacataagcactgtgatactgctaaaatggctactaagtgacttacaagcactttaagtggctactaagtgacttactaggtagtgtctacagcatggatatgctggacaaaggaattacattcttggcagcaggtgtccccaacccccaagccatggacttgtgctggttggtggccttttaggaactgggccacacagcaggtgagcagcagacaagagagcattaacacctgcgctccaccccctgtcagatcagcaatggcattagattctcataggagcgtgaaccgtattgtgaactgctcatgtgagggatctgggttgcacactccttatgacaatctaatgcctgttgatctgaggtggagcagttgcatcccaaaacattccctttgcatgcccccatccccccaccgtccatggaaaaattgtcttccatgaaaccagaaccggtcactggtgccaaaaaggttggggaccactgcttggtgggatggagctgtgtagtgtaagatttcatcatgctgctcagaatagcatgcaacttaaaaacttgtgaattgcttattttctggagttgttcatttaattttttcagattgcagttgactgtgcgtaattgaaaccatgaaaagtgaaaccttggataaggatttctgtaatcagttacatccctgccctcataacgcttaaaatttatcaaggactgtaaactcaatgtttggcacataataggtactcaatctaagcaaataaatgaagaaagaaagaataaacatataacaatactgtcactgtatacatgtaccttgtgaataaccttcaatcaatctaaacatttacttttatgttttttcttcctttattatttcacattttccttgcttattatatgagagtctgtaatcggaaacttaaacctgcctcttagaaattggttagtttacaatttacttccctccttaaaatcgtccagtggttccttgtcaccattaagtccaaattccctagcttgtatataagactatcaagataggacccttgacctgtctgacttcatctctcactgtctcccacttagagactgtgcttcagccatgctgggctactttccagaaaaaattttacttaatgagcctttggcaccatcatgtccctatcccttctttgccctcacctctacacatcttgcaaaactcagcttgaataatcgtctcttctacctggccttcctttgtgcgttaccccttttctgcatccagagtgccctatactacccatctctgccctagcacttattgtgtggtgacgtaatagtttatagtctcgtgtccccccattggatgaagttccctaatgggaaagctataggtttttttctttgtatatttaacaaccgccacagtgtctgctgcataccagctactcaataaatgttggatgttatggagtctactgtatttattaaatttgggagttgactgtaaggcccagatccatatgacatggactccctgttttcctttcgtcattttctgtgcatttttaaaaatttagtaaatgtgtcattctgtcatcccttggttctatattctaatatggattccccaactgtaagctcacaaaagctcgaataaaatagaaatctctctggatcaaattctgtgaggtttaactctaatattactaaccaccagcagatgtttctaaattatttggcataattagataacaaattccacttcattaaactattgttcattttcatttcagtggtacaaagggattgtacataaattagcttggtttgttcatgttttaccctcacagtagggaacataatcaaactgaataggaattcagtatgaaaatggctaatttaaccttttcgaggtctgaaaataaaaacaacataatctttcattaatttgtctgctacaggaaccttcctattagtttttagatggttgtgagaagagcagatataaacagcagtttaaacattaacatttttaaatggattaaaaaaccttttatttctgttatttattaatgcctcttgtttttctaggaagaatttgaggcaatttacaaaaagattcagtgcaagaagattgaaacaataatcatgggaatttgtttttctctgtcttgtgtcattaggttcttcctctcctttgggttgtttccctctgattgtagctgtgatttgccattccatatggtaaagcctttttctttcttttttttttttttagttttggtaccctctcaagcactgtcatgtgtttttttggtgctcctcccattaccaaggacttattgaaagagaagtctctgtatgctccccttccactttctacatgtctgttttcatctcttcccagccacggtgccacagataataattagtttttaggtgtttgtgaatgtcattcatctctagtgaaaaaggagagattgacaactgttaaagaaaaacttattctaacgcttgttaaagcagcaaagaagattgtatttaagataatcatgataggttgtccagactattgtgataggggagagagattggactcaattccgaatataacatgaacaagcaggaatttataaccatgaagcaggttgtgggggtggtggatggacagttactaagaggagacatcaagggtgggggaattattgctaaactgacataacaggattcttactgagggcatgtcagtgtgatcatataacaagggtagggggttgaggaattccattagctagcaagtgattggagccaggtgtggtggctcatgcctgtaatcgcagcagtttgggaggctgaagctgaaggattgcttgaggccaggaattcaagagcagcctgagcaatgtagtgagactctcatctttacaaaaaataaaaaaatagctggcatggtggcacacacttgtagttccagctatttggggaggctgagcctggaggattgcttgagcccaggtgttagagcccaggcttcggtgagcactccagcctgggtgacagagtcagactctgtctcttaaaaaaaaaaaaagtgattagatatcaaaagtagagggattctctctcaactgacttagcaggcttcttggtaaaactgggctatgcaggcctggtggggcgtgggccaaggtggaggcctggttgagaagagggcctaggagaagcctgactaaagtttggtcaaggagagcatcttgtcacaagtgtcatcttatatttgcttctgatcaactggaagtgctttatccattaggagccagtatccagtggcttgtttgaatatttgttctttctgcactatttgatgtttttgattacatctttcttcttaaaacttttttctctcgtcttttgagacattgttttctgccgctattccttttcctccctttcctatgcttcagtttgttctgtttgatcccctctatgtcagtgcttttcaagaactgaccttcttttctcttttggaagcatgtaggtttcaacagtgaacaccgtgtgaatgattcccaagtcttttatctatctccagcctgcccttccatacactccacagctctatctggatttcctatagacacttcagacgccacatgttccagccccacattctttgtgtttattcttccatcctctctttctttgcctctgatacccaaccagctgctaacttgcagactggtctttgcatggctttcatacttctttctttctgtggctctgcctttcctttgagttctgcaacctcttcctctgccctctgtcacccatcagaaggagtcccttcatgttctgaattctgtatcattttttctgtgaatctctcatgacatttgtgaatgcatttctttcgtaatagttatgtatcttatttttgtcatcttttctagactgacagtttctctaaagtaagattcatttctttttcatttctgtattcctcgcagtgcttaaacttagcacagtgcttcacacatagcaggtacttgaaaatatttgttaaatgaataaaatagctcccctaaaccatggtattcctgtagcttaacaatttccagggtagaaatataaagcatttttaaagttattctattgctttataatactttaatcaagttatcaacagttaacatttccagatctcttatatattgtttttgttaactaattatctcattttcaggctttaacagaaaaaatacatgtattcctgcagtattgtttcatgtcaagggcaggtatatcacttactctggaattggttccttttgctagcttatcttttcccaaaagtttcctgtgaaattacagttacatttatactgttatattttataaaaacctctttatccttcttttaactttcaaaccagaggagaagggacactaaacagtatctataaacacagggcttgttataatccaggttgattttctggcccctttaatgttgtcatgtgtccagtagtcaactggaaacagaaaccttctggggggaccatgctaaaggtaggaaaaatgatgggttcttctgctctgagagctgttctctcttcttttagacttttctaggctgttagcaaggaattggtgaagggaagcctttctttgttcaggtctccctttcagaccctggtgggttagccaagttcataggacgtttacatattagtcctccacttaaaaactagcttgtgttttgaaggttgctgaatagatgtcactaagtagtagaccaaaaagctcaccctaatgattgttttacagaatggaatatattaaaccatgacccttttaaaagatgcagtcagtggtttatatgacatttcacttattgcttattataatatttaattctgaaaaaaatgttttgatgaaattgactttactactcctgtaagttgttcctataagatgattttgcctcttaagtctttggatggtatttattactattctgagatttgtatctcaaatttggatgttataaagatgtcattatatatgtgtacagcatatgtaattaaagatgagagccatgaaaatgcaattcatgtttcttttatcataatgtttaaaagttgactagatattttaaagttattgtatattcctgggaagagaaatgcttctctgggcgtgtcggttcattttttttagttgaagttaaaaggatagattatttcaaaagaacaagaaaaggaacaagatggattaataatacagtggtaaaaagaaagggggcaacagacatcgctatacagtagggacacttgcagaatacttaaaggcttgtcatcctgaattttccagacacatggctctgcagttctctggagagccacaagcccctttcttgcaggggcgggacaggttggtggggattggagtgggtaggggaagatctgctgttcctaggtctctccagacagaggagctcttgctttctcttttagtgtttatttcttcctctcttctccctccctctccatcttgcccgcccccccgcacccccccacgacctcgcactcttgctcttgcgctcgcgctctctctctctctctctctctctcacacacacacacacacacacacacacacagacacaccacacacacacaccccgcacacaccaagtctgccaatgtcaggagcaatgggaaggaaagagcagtgattgaacacacagatcccagaacttactcatttggatgagaccttattcagctcaagatgccttctcatgtcactcttctaatcaaaacttcttcttttacctttattcaagtataataattgatcttcagaggcatatgacaatttttaaacttttttttgaaataatttttagttaaaggttgatcaaaatcttaatagaaaaagtccagtgttttcaggtcttatctgtttgtaccaggggaagaaggaaaattgatgtatgttatttacattaatattagataatttgtaaaagatctgtcccaaaatagtttttttcattggtaagagtacatttaagataaacatgcaacttttttttttttttgagacagggtttcactgtgtttcccaggctgcagtgtggtggtgtgatcactgctcactgcagccttgacctcctgggctcaggcgatcctcccacctcagcctcccaagtagctgagaccacaggtgcgagccaccatgcccagctaatttttaaataatctgtagagacagggtctccctgtgttgcccaggctggtctcgaagttctgggctcaagcactcctcccaccttaggaggaaccttcaaagtgtaattcttcaaagctccaggattacaggtgtgatccaccatgccaggcctaatatgcaactttaatatgttgcttactgtgtgttttcagctgtcataattattaggtggcaaggcacagtttttaaaagttgacgtatttatcttttttttcttttttttgagttggagtttcctcttgttgcccaggctggaatgtggtggtgccatctcagctcactgcaacctccgccttctggtttcaagccattctcctgtcttagcctcccgagtagctgggattacaggcgcccgccaccacacctggctaatttttgtatttttagtggagacggggtttcaccatgttggccaggctggtctcgaactcctgaccttgtgatctgcccacctcagcctccctaaatgctgggattacaggtgtgagccaccatgcctggccttgtttatcttttattttaaaatttaaacaggtttatggtaatacagttaaactacatagttcataggacttttagcagattgagagatgaagactttataatagattaatttcactactatttttgaaaaaatgcagcagcttttaataataaataccattgaacagtactttttctgacttacgatttgaatgcagacagaaatggtaatgtgaactgaaataaagtctaatactttaaacccttgtgttctttcaaatctgtttccctaaattacagcaatatacaccttctttcaaattataaaaataatttattgttaatgctgagatattaagctgagatgaactggtatatttcatactgtatttattaacactttacatgctgtctgttttctaaagagctcaaaccagtgatgagttttataggctcattttattttccactgccatattataagaagattcatagctgctgagaaagctgccatagaatattatctgtcatattgtctcaaggcaactaaatatattgttataagtaatcactaataaagcactaagaaaaaaatattagcaatatttgcaaaacggtacactctgtgctaattttattgaaacagagttgggaagttgtagacaattaaaaatgccatcaaatcttacgccaacttagacttggccaaaatgttcacctatttttccccaagtatttggtctttttttttttttttttgagacggagtttcactctgttgcccaggctggagtgcagtggcgcgatctcgactcactgcaagctccgcctcccgggttcacgccattctcctgcctcagcctcccgtgtagctgggactacaggcgcgcaccaccatgcccggctaatttttgtatttttagtagagacggggtttcaccgtgttagccaggatggtctcgatctcctgacctcgtgatccgcccgccttggctcccaaagtgctgggattacaggcgtgagccaccgcgcctggctgttgtcactttttatggcccaattttactcatacttggaaagtctcattatgtactagcatgttagtgttctttagcatgtgaaaattttggagggttttttttggtctttctcagtttagaccatcctcaccatagttaaaactcacatctccctctccctcatcctggataaggtaaaactgactgtcaataaccaggtctaagaagacaacacatctatataaaattgccatcatctaaatatgtagtctcaacagttattaaaatctgtctcccttcaacctaaaaagtgaaataaaagcagtttctccttacttacctctgtaaaagaatattataacctgccaagcacggtggctcatgcttataatcccagcactttaggaagccgaggcaggtggatcatgagatcaggagttcgagatcatcctggccaatacagtgaaaccccatctgtactacaaatacaaaaattagctggtggcgggctaatacaaaaatacaaaaattagtggtggtaggcgcttgttatcccagctactcgggaggctgaggcaggagaatcacttgaacctgggaggtggaggttgcagtgagccgagattgcgccactgtactccagcctgggtgacagagctatactctgtctcaaataaaaaaaaaaaaaaagaaaaaagagtattatgaccaagaggccgtaatataatttgagtttctatgtatatggcagtgccatgtaaatctagaatgttaatatttcctctttcttgctatgtgaaataataaaaccatactagagttgacccttgaacatgatgcttaggagggcagatatcccctgccccctgccccgcctagtctgtcaaaaatccacgtatttgacttccccaaaactttactaataacccactggttactggaaaccttaccaataacataaacaattgattaacgcatattttgtgttatatgtattgtatactgtattcttacaataaagtaagctggagaaaaaatgttattaacaaaataataaaatcggctgggcgtggtggctcatgcctgtaatcccagcactttgggaggccaaggcaggcagaccatgaggtcaggagatggaggccatcctggctaacacagtgaaaccctgtctctactaaaaatacaaaaaattagctgggcgtggtggtgggcgcctgtagtcccagctactcgggaggctgaggcaggaggatcgcttgaacccaggaggcagaggttgcactgagcccagatcgcgccattgcactccagcctgggcaacagagtgagactccgtctcaaaacaagcaaacaaacaaaaaatcataaggaaaagatatttattgaaaatatgtggatcgttgtaaatgtcttcatctttgttgtcttcatgttgagtagactgaagaagaggaggggttggttggtcttactgtcttaagggtaacagaagcacaagaaaatctgtttataagtagaaccacgtggttcaaacccatgttgtttaagggtcggctgtatttctaaagtctaaagagaatcatggacattgtgactctggggtgttttctttcgtattagtcttgtgtttgttttcgtctttacatactatgtatcttaactcttaatctgtaaacttttggttattaggcatacacatatggtggatctatggatgtgtctattcattagttccactatattttagaattcttggtaacttttttggtttatattttatgaaaaacaaagggcccccttttcttttgcaaggtgtattctatagctgtgttcgctatattataaaattaggagagtaattctaacttctctgctgagtaggtgctttttaaatttctttggtatatcagattctcaagcttcattacataatatatctctgtggcataactcctgaagataatatagggatccagtgtgacggtttggctataaatatttcacatgatttagaataatctaatctcaaatccacaattgcagtttattatagttatggatgtttggaccctggaaaattaaccttttaatttaaattaaagtaacagtttgattattgggaatattgtattgaacatttataatgatttgcttttggaattatactgatgaatagagtgaaaacattttccagagagtccacaagatggcacttgccaacttgtttcctctgtttttccttaacttatggaaatgcagcaaaatttaagaaggaacatctaaatatttatgcccttaaaatgctaaagtttagatttctagaagctttagtcaagactccttgaaattgatgagcttcaatttaacattttaaacagtgttcatttccggtataggagccaaaatcctttgttgaagatccgtaaaacacactgggatctgtagaatacaaagggctgcctgcattcactatgtttgcctttacttttaaagtaataatatgatttatgaggcttgtagtctatatgtctcatttctagacatcttaaaatatggacatttattagaacaatgggtattagtaattgctctaaagtaactgttattttttatttaaaaacaagatgatgtagttggaatatattatgtaatttttaattatgaatgaaatttaataagtggaatggtaatgaaggacgacaggaatctacccaatcacagtgttaattaaattaggcttcttttttactcttgtatatttgacaattaatactgctttagatgtttactgtttacattaacattgtcattagggaagggaatgatgttgaaattatgttgaggttggtagggaagttttatattgtttattgctttctgaaatcttgtcaataatttcaatggaaagagctacatgttcatagaagactaaaacattaaagtgtatcaactaaaatctagagcaaattaggtttaggtctatagcattctgatttttctcagcctcatcataaaaatcatcaagcaaatagtatcaaagacatatcatagaataagaaaagcccaaggaactttctcttgaaacctaagacttgcaaaaatctaaatataagcttataaccatgtattttagagagttgtgaaagcactcattttttttcttcattcttgtgaaggtttgttgaagaaagaatctattacatatgaagaaagaatcaatacaggtttctttttaaaaacgattttgtatgtactggctgctaagcttgcataatgaatatgttctgtgaggaggctgcacgttgaaaactattcctttgttagcttgccctttcttctgtcaagggtttagtgttcagtttcaggttaccatcatttatgtgatactattttgcacaagatctctttttagaagctaataaaacacagccaggcacagtggctcacgcctgtaatcccaggactttgggaggccaaggcaggcagatcacaaggtcaagggatcgagaccatcctggccaatatggtgaaaccccatctctactaaaaatacaaaaattagctgggtgtggtggtacacacctgtagtcccagctacttgggaggctgaggcaggagaatcgcttcaaccggagaggcagaggttgcaatgagccaggatcgcgccactgcactctagcctggtgacagagcgagactccatctaaaaaaaaaaaaaaaaaaaaaagcttataaaacacattctgtaattttcattgaatttatagaaacgttaatttaaggtaaattaattttagaactaaggaacttcttgagaaacatggatcagagagtattatatgtaggagcagatgtaagggatatacacatagcacacagagcagattcatccactgacatctttgaaagatcttattttaaaagtgtttattttccccatggataaaatgaagattgagctttcaaacgtgcctatttctagttatttttttccagaattaaattctaagaaatttctgaaaatgaaaaaaaaaaaaacttgcgtggagcagtagatgctccctttttttctctgtttagatttatagtccacatttgagaccaagtgaaaattaaatagctcaaactgacttttgttctttctgagtctttcccatcatctcttgtgaaaatgtagacatgtatgcagttgtcaatgaaaggatttgtcttttcagttggctgactgattggctagcttatttatttatttatttatttatttttaagacggagtcttgctctgttgcccaggctggagtgcagtggcaccacctcagctcactgcaacctcagcctcctgggttcaactaattctcctgcttcagcctcccgagcagctgggactacaggcgcatgccaccaagcccagctaatttttgtatttttcatagagacggggtttcaccatattggccaggctggtctcaaactcctgaccttatgatccacccgcctcggcctcccaaagtgctgggattacaagcatgagccaccgtgcccggccgtctagcttatttttttttaatgaatgtatgagttctgaagtttgattctatgctcagatacattttgctcatttcttttctgatccctgttttcatgtatgtgggacctccctgggtttttttggcccatggcaagcactttttaagataattatcacatccccctcacacttagtctagtaaaactactgatgttaacctaagaacagtggaactgtaaggagtcatgctcatttattcctaaaagattacaactttttttaaaacaaaagtgtaacacatataaaatatacaatgcataagtgtatttaagtaaaacataaaaagaactaaaaaagtaaaatacagcaatcataagctccatgattaatttcaaactgatcacatctatgtaagtactactcaagtcaaaagatataacattactagcatagtccccctcaaaacctctcttagtcactgccctcttctgcctccccagagtttatcactatcctgacatctaacactataagttagttttgcccttgtgtttttttaatgtcttcttttttctctttggtagtggttataaaatgtttttgtaatactagagtcttcattagaatccagtttagccaagtaaaatgcttctgaatctcattggtgggggaaagggaggaggctgtacatgtgagggaaaactgtattttaaaatatgttttaaattttaaattaaaaaaagaacacaatatttcttgatatataactgtttattttaaactgctgaaatatatcaatagcagctaaaggtatgtgtgtgctcttgcttacagaaaaagtgacccacagcatcctaaccttacacttgttttgatactcgccagcaaaggaggaagagagtgaatgggtggggttaaggattactgggggacatttctgggtcacaaagtgatatagccagaactctggaatttctctaaattaaatgttttatgttaaaaattagtgtgaatttgctggccatcagagaaatgcaaatcaaaaccactatgagataccatctcacaccagttagaatggcgatcattaaaaagtcaggaaacaacaggcgctggagaggatgtggagaaataggaacacttttacactgttggtgggactgtaaactagttcaaccactgtggaagtcagtgtggcaattcctcagggatctagaactagaaataccatttgacccagccatcctgttactgggtatatacccaaaggattataaatcatgctgctataaagacacatgcacatgtatgtttattgtggcactattcacaatagcaaagacctggaaccaacccaaatgcccaacaatgatagactggattaagaaaatgtggcacatatacaccatggaatactatgcagtcataaaaaatgatgagttcatgtcctttgtagggacatgggtgaagctagaaaccatcattctcagcaaactatcgcaaggacaaaaaaaccaaacaccgcgtgttctcactcataggtgggaattgaacaatgagaacacatggacacaggaaggggaacatcacacaccggggcctgtcgtggggtggggggagcagggagggatagcattaggagatatacctaatgtttaatgacgagttaatgggtgcagcacaccaacatggcacatgtatacatatgtaacaaacctgcacgttgtgcacatgtaccctaaaacttaaagtataataataaaaaaaaaattcgtgtgtatttgatactgtacttcacagtttgtctacttttaatagagtatttcatatcatcaggaaaaaaatatttacaattgcttcctaagttaatgggcaaaatgctgatgaactgttacttatggaaaacttcattgaattaagtattcagacatgtataagtctgttaacagaaattagaagaatttattttattgctttgtgatacatgttcaggcattcgtcatgagggatgctgaatagctcagacggtgttttcatctttagtaggaatgcaatagatgtttcatctgctgagaagttaaattgctttgtcatatgaaaaatagagttgcttactcaaaagttagcatcttttactgtctcaaaaatttgttaaaggaatgttttcagtaacaaaagataatggttctgtgatgatacagtagcttctggggtgctcagtggccttaatgctgacaacttgacaataattttacctgcttatagcccacacccatgaatttttttttagctgatctcacatctctttgtttattggcaagcattttgcaaaatgacatgtctacatcaatattatttttataaatatacaaagacccaatttttaggattcgtttatccaactcgaagtgaaagatccaggttagctttctcaataaatagatctttgagcacattgaaaaatatcatttgatcatggcacctttctttaatttggtttccttctttttgctaaatgtggattatactatatccacagtgcaaaatttggtgaaattttacatctaaggttaattctcaacctgatctctttatggaagctttaagcagtttttaaatttgcaaattagcttgagtgtcttactttattgtttctagctaagtcatattttctgtttagttgcaaactatctttggagtttttccttcaaaattacatgattacaagtcactggaagagtgataatttcaatgtagtttttcctcaggtatttctaacatacagaatatcatagtttagattcatttgcaagtttgcaacaatctacacatttaaaaaaatgtatctcatgctttttagatgtctactgctaattattactgattggttggttgtagtcaaggaaaaacagagcatcttcatcactcttaggaaaccaggcatatctcacctgaattttaaatcatttgtgcttccaattttactttaagcttaattcttcaattaggaattgaagaattgtttttaaccaataatgcatgttcctatttgaaaacaattttaaaatcataattttaaaaacgggaaaaaagactaaaaattttcacatgtataaacaggactctgggtatttttatgttctgaggagctcacagcggcaaagaagtggaactaaatacagtgtttatataccaaatacttgatcaaatgcaattatagcaggaaattaaactgctatgtgggggtttgtggagtttttttgtattttgttttcaagtaaacaagcaaggaaaccaaacattggtttctagagtgaaaacttttttttacgtaagtcttgctgttgagtaattccctgggtgaattagagatagcagagggtgtgttggtcagtattaatagcctctcttattctcaaagcattagcttttattgttcacttagacttgagaaaaagaataccctaataacataaaaatgccaacagttgtagttatttattttacagaagcatttctactcttaggactttaacaacttctccttcccctatagagaagtgagagtcagatggtacatataaaaattcttaaattttaaatcttggaatgaaattgttctaaaaaggtatgccatgttaatactgtgtacatctttttgttttgttttgttttgttttgtttttgagatggagttttgttctttcgccaggctggagtgcagtggtgtgatctcacctcactgcaacctctacctcccgggttcaagcaattctcctgcctcagcttcccgagtagctgggactacaggcgcccaccaccatgcctggctaatttttgtgtttttagtagagatggggtttcactgtgttggccaggatggtctcgatctcttgacctcatgatccacccgccagtagagatggggtttcaccgtgttggccaggatggtctcaatctcttgacctcgtgatctgcccacctcggcctcccaaagtgttgggattacaggcatgagccaccgcgcccagccctatgtacatcttaaatattgccttgtaccccttgggttgcacataaccagagcctgccaataagcaggtttcctgagttgactgtagagaaagaaaatagaggactgagattctggcttaagtcatatattagtaaattgatctttctttttttaaaaatagataagtgtgcaatccagaaaaccttccattgctgagtattttatcaagtggaataattattctatgtaaaaattccaataacaagttattatggttgataaggctaacacctctcattttcctatattacttaataattttattttcaaagtgctttctttcattgtaattccactgtaaaatatcttgactgttcataaaatttagtaaatgatgatgcctcgacttgaaattggctatccttctggtatccattaacaaccctagtctagcttttctcatgctgcattgtgattatttaatgtctttcttcaaccctaaactatggaattctcaaatacagagactgtactttactcatgtttttctctgtgcaatttagccctagttggtacttaatacatgtttgatgaatggatgaatgaaggagtgaatggatgagattttatctgattgatggtgatctagatttgttttctcttcagtcactaaaggtctggctatcattctaatttccagagtattttgaaaacattttattactggtttggtcagtctggaaggacaaaggataacatgatgggaacagtttaaaatgattgtgtatcgttagctacatttcacactatcaaaagttattaaagatatatttaaaatccagaatctttattgcattttgacaaatgtaagtgaaaaaagaaccagaaataacaataaactagaattgattagagatgcatttggagcctggaattagtatttacaaaatggattagtctctcaatgtggtgcagggcaaagtatgagccattacctgtgtagtaagtaggtttgtagaaatgtttaacctgaatcagggctggcttcattggcatgtgacctacgcagtcactcagggcccacacgcagagagacctcattctttgtttaatgccctgtgctgccattttgaaatttttaataatttttgaacaaggggcttgcaaattatctagcagatcctgatctgaatcatggggaaataatcacagaaatacggattgtggacattctacaagacagctggtctagatttttaaaaagatgtcattgtcatgaaagatgtttttaaaacctagaggagtgggaaatgttctaggttgaagaacgctaactaaggagacatggtaaccaaaagcaatgcatgaaccttgattggatcctggatcaaagaacaaaataaaataacatttttcacgtaattggaaatacttgatgatatgtttaaactgtaatataccatcagggtcctttttgcccaatattaatttttgagtttcttttttgaacagttctaaatctttatatactttgacatttcattacttttattttttcttagaggtcttccacagaacaaagaaaacaatttacctgtttttaatagaatgaaagtcattatatcttttaaacattttatttattttttcattttaaagccagtcagatttagcaatggggggttatatatcaactttagtgaactaatgttaataaattttgataacccactaccattggagcagccaaaagtcattatatcttgcaattaccacacaggtccctttagaaatgtaagcctcatgaagggattttagtgatcttatcctgaaacattttgccactccatcatcctaggaattatttgctcattgcttatgaattactcccaattatactacaagtaaaaagactaacataaaaatcaaacaaaagaattctgtatttgtgaaatacatgatccgattgtgtcatccttcagttttcttattgcgttgcccaaggtgttgcatcatcttcaacaaggtataaaggcagcctgaagacactgtctttgttgtctgttaaattttcattgaacacactttgttaaacacagttgaaaacttttaattgtttattttcagcccatattggcaaacagcaattctttgacagaggaagatttttctaattattagacaaatcaggtgaacaggtaatggcactctggactctaatgataatggttaaattgattatatagaagaaatgtcaatatagattatcagatgatgatatcctaggtctaaggttgacaagctggtcagagttttattaggaaagccatgtccactaatttacatattgtctatggctgcttttctgctacaaaagcagagttcagtcgttgagacaggcgggtttgttttgcagcctaaaatatctactttctgaaacttcacagaagtttgccaacctagttgtctaaggtgaatttcatcaaactcaagaattgacagtgaacaatgtgtctaaggacagaaggagaaatagtattcaaactcacatagtcattcaacaggaaggattttattgcagcaagatgctggaccatcccgtttgctaataggaccattgacagtattttttcatcttttatgatgtttgtgcaccagaatttacttgatgcggttatttagtggacagatgccaaagacaggtgtgtgtataacaatgactggaaggaaatgagtgatatagaaatgaacgattttattggattgatcagtttaattggtttttataaatctaaaaataaaaatattttgcaattatggagcaaagaagatggctctcttttcttcaacaaaattatgagccatctgagttctttaaggtattctgttttgaagatgcaagtgcaagaggaaaaaccagaagtaatgataaactagaatttaatgaagatacttttgaagtctggaatcttgattgcattttgacagggcaagtgcaagcaaaaccagaagcagctgggtgcggtggctcatgcctgtaatccagcactttgggaggcagaggtgggcagattacctgaggtcaggagttcaagatcaggctggccaacatggtgaaaccccgtctgtactaaaaatagaaaaaattagcccggcatggtggtgggcgtctgtgatcccagctactcgggaggctgaggcaggagaattgcttgaacccgggaggcggaggttgcagtgagccgagatcgtgccactgcactccagcctgggtgaaatttatataaatttgaagtcattttatgaataatttacagatgtaataaaaggatagtgaaacataacatggcagaaattttaataaaaatttaaacaggaaagccaaaatcttagtccttttttttttttttttttttttttttttgagacggagtcttgccctgttggcccaggctacagagcagtggcgcgatctctgctcactgcaagctccgcctcccgggttcacaccattcacctgcctcagcctcccaagtagctgggactacagacacccgccaccatgcccggctaattttttttttttgtattttagcagagacggggtttcaccatgttagccaggatgatctcgatctcttgacctcgtgatccgcccacctcggcctcccaaagtgctgggattacaggtgtgagccacttttgtttgttttaaagatatatatcccaaaagggcagcattctttgaagtctcatcaactaactgctcattaattctgtcatgtatgaacctgggatatatccatttatgtaaatactgattccaggcttcaaatacatctagtttatatcaaatagattctagcttatcattgcttctgttttttttttttttgtttgttttgttttttttgcctggctaaaatttatataaattaaaagagcttatggacctgggtggtaaatggtaatgactgctcttccaggtacagagggttaatttcttgggtgtgataatgttttcgtggttgtattgaagaaggttcttgtttttttagtaggtaagtgctgaatgatttaaaggtgaagtgttgcatgcctgcaacttactttgaagtgcttggggagggcataatatagagaagggagaacaaataggacaaagtactaacaattagtgaatttagatgaaagaatactgatttcttgtactattctttcaatgttttagtaggcttggatattttaaaaattaaaaaaatctaagaaatgaaaatttggctctcaaacacacatgcaaagaaccatttccccccagtagatgtcccttttagaggaagtacttgcatttatactataaatacatatttttaaattgttagtttagcttaattatgattgtgtcagctttttgctactgagcagtagaggaataaaatagtgaagttaataatatgcagttgtttgccaccaggggttttcttagaaattcttatgctttcagaaaatgttacatttagcagtaaaatacatacattattttccttgtctgttaggcaagattgctacaacagttaactccagtggtcagtgtagcttgtgtcgatttgttctgtgtgtgtgtgtgtgtgtgtgtgtgtgtgtgtgtgtgtattaattatttcttatggcctgtttgcagaaaatcagaacttaaagttacaggcatatatactgagaactcaagttttctgaaattatttcatatatgttatatgtgcatgaaggaaaccaatctcatggttgtgtgtttattaatgatatgaacaaaagtatatgactcttacctttattttatttacctttattattacccttatttttgaacattttattggtgctgggaaaacatttactactagcatatttgccttgactttgaagagtaggccaatatttaaaaatttatgagaaaacaatttgatctaattgtcacttgtgaacagtaaaaattcatttttttgttatattatgggaatttgaaaagtcttattagagataaataattctctcttgcagactggtaaaagcacatgaaaatgttttttcattgctgtcatttgtctgtgcttgatgtgggtttgaatcagataactttttcattttccagtgacaatgaccttttgcttttcaattcctagtattcagcatccttgcgggcattccaacagtgttagtgcagtaaagcatgcagacgatattttcaacaaaatgcttgttcacagctgcgtgacataaatcactcagtctgctttttgaataacaaataatattgcttattagaaatccacatcaagtctggagttaaaagaagactctatttgaatattttaaaacaaaccgattatccacctttccattttagtaaacctattggactgtaacatttcatatgtgaagtatgtttggcattgtcacggtattttgagtcctgaagtggaaatgggaaaaaaagaagtaatattttctaaataagggcattttggaaaattctttaaagtatgatatcttgagacctctaggtattctgtttacatatgttcatataagagataccttgtagtactttaattcacatatttcttcatatagctttctagttacatctatatttctttccctggaaatttccttaatgtcagatacttcaggaataaaggtaaaaggttttttgatggtaataataataacaataacaatagctaatattcatttgtccaattgacgtgccctgggtcagactcacaattagtaagtgctggtagagacaggtttccagacttccagggcccacacttctcaccgctgtcctgcactgccaaagctggcagcacaaagtggggtgggtccacatcgtcagtcctgaaactcacatcaacctggctgaaaatgtgtaacttctcttcctcctgagcacccagaagtgaagtgcccaggcatccttcatcttttgcttgcttttgctgctgcttcttcatcactttgtcttctcttgttttgcttgtgcatagaaaatatcccagaacttactttcagtcattagcttccctggccttgaagtatattttgtcacctcctgcctaggtttctgcccttcctgaaaaaaccgtgttttgtgaatgggcttccagcagcctgagttggtctactgatatcatcaggaagatttacagtgctctgtggcatctaaaacactgaataactgtgcttattatgtatgttttctgtttcatgatctggcaaaatgttgtcatgatagttctgcatatcatatgttgaagcatgggttatagtaggaaggaggcatgcagattgcacagtagcccattcaactgtggaagataccagagagcataatcattgttatccagcattctctttctaactcttagacttttactgtgatgacccagtgtggaagaatttgtggttgaacaactgaagagttcaaggcaaaaatagtgttagggtgatcctgggtcactagtaaagctatgaaagctttaattttctttttatatttgatataaaatgaggatagaacactagaaaaagagaatatcagtgattatattaggaacttttcaggatctccctcatttaaaatttggagaatatgtttattagttcactttttctgtggatgcagatattatgcatactaaggggttatattttctatttctgatcttccttatgcatagctgagtcagaatttgttaaacattctctctgataaggttatgtagtataattccttacgtgataacgcttagccttggcactgaatcaacctgactttatggccaccctccctccctcctaatagagtgagtgaggaggacagttccaagatctcactttactttctttgctccaacttccattgtctgaatgctgcatagctcaaactacgactactgctctgccacccacttcaccttctttttttcttcccaatcctagatcactcatttattaatcatccccaacaaagtgattcatagactaaatattacaggaagtgtaaattccaagattttagaaagtctgtctgcatattctagcaggaatgtttagcttaggggaatttgaaattgggttagggattactgttcttgaccttacaggactccttcttgagatgcagacagtaagtgcctgtcttgtcactaagcttattggagtgatgaagcatcaggatatcaccctgccgtgggtcagagagaagatatttcttggacttgatggtttgagtgagatgacaactctttttggacacgggaaccagagaacatcctaaacatttcattgaaggttatactcaagcttgagctacaaggaaaccagtagcagcaaggagaagactttaatagcatcgtgaatgaacctgaccataagggataccagcttgttgtcctggaagctgggcttgaagccagatacctcagggttattattgttcattgtttagcctagtgatagttgtcgggcccttgtggactgcacttgaagtatttcctcaggcatctgcatctgcctctgagaaggtgacctggtctttctcctgctcatatgagcttgcttaggttatctcccttcaatccccaattcatttggctttgtattttggcttcttcttattgccttgataattttagatgtagtcacctaggatgacactgtttgccttgtttctaacttagcattcctttattatactatcaattttggtcaggagtatgagatctggaggcacatgatcttggttcaaggactggctctgctccttgtgactttaaataggtgccttgatccctctcaattacttgttttctcatgcataaaatggtactagtaataataccttataacattgttttgagacataaataagtataaaaacatttaacaaaagactggcacattgtaagtgttcagtgcaacataatttactattgtgttctagttattgttttaggccagtggttttcaaacttttaaatctcaggatccatttatattctacaacattgagaatcctaaggtgcatttgttatgtgggttatatgtgttgctatttactgaatttgaaattaaaattgagaagtttttaaaaattatcaattaaaaaataaactccttacatgttaacataaataacacattttatgaaaaatgactttttttttaagagacggagtcacgctctgtcacccaggctggagtgcagtggcacgatctcggctcactgcaagctccgcctcccgggttcatgccattctcctgcctcagcctcccgagtagctgggactacaggcacccaccaccatgctcggcttattttttgtatttttagtagagacggggtttcaccgtgttagccaggatggtctcaatctcctgaccttgtgatccacccacctcagcctcccaaagtgctgggattacaggcttgagccaccacgcccagtcgaaaaatgactatatttttaaatgtagtaagaagagtcattcttttacatttttataaactctttaatgtctggcttaggagagagctagattctctatttgcagtcagcttttgaaatatattgttttgtttgggatatatgaagaaaatctggccttatacagatatatagttggaaaaaagggcagtgttttaataatcttttcaaatagttatagatatctttctttgatactacactaacacttgacaagtggtagttttttaaaggtcaattgcaatgtagactttgaaaccatatcaatgacatttttactctcgtacattatgatctcctgttctatcttgtatttgactggatcttttgcccacacatgatactgtattatcctacgtttgtcatttcaaaaatattcattgatttatgtaaatcttgtgaatgttaacacatttcattatgcaatatatcttagaatcatgttctttaatatcaccatcgatctcatgggaaaaatctttaaatattaacaaactgtcaagctcatggtggtggatacaagtttccttgaattcttatttccacttgaaagcttgaatttttgtgactggcagtaaatacagttagttatttttgttggagtcgcaagcttactttgcttattctggagtaaatacctgttaaatacccaagtctgattagtcatagtttgtgagtccttctttcaagtgaaatgactattatgaaaatggagctagttcagctcacaaccccaatgacctcagatgtgcttttcttcaagacaaccatcatacttggtatacaacaacagatggtgctttatgcacacttctcacttttttttaacagaatgaccaaaagaagtgtactcaaggatcaaaatttaacaaaaccaatactttaaaactgcttcatcaagggctttcttaggttaaacgatttttctttttactgtgagtgtgtactggtgaagtacagtgacagcctaattgccactgctttgttttacccagcatagcttttgtaccaccagtacaaatgtcagtgtagtgaaaaaggcaaaatccttcttaagattactattaaaatagtttgggttttgtggacctctcctgaaagggtcttagtgacccacaagtgtttacagaccacactgacaattactgttctaggcagtaagaacacagcagtgtgacaacagatgacaaaaaaatcctgccctcatcgagcttaccttctggtgtagagagacaaacaacaatataaaattgataaaatatgtagtattttagatagcaagaagtactaagtagaaaaaaaaaagagtatgaagtgtcagggggttttgaactttttaaatgacaaggaaggcttcactaagtcaagaactgaagtaggtgacggagcaaactatagagacacctgggcaggaagattctagaccgaagaaacagctaggtggaagtgtgtcttatatgtctgatgaatggcagaggaacaaagaggctggagaagagtgagtgagaggaagtgaagtagatgaactcgggggcttagtggggacaggtcacccaaggtcttgtaggtcagtgtttctgaaaaattggtgtgcgtgcacatgacttggtcttgtgaaaatgcagattctgatttgtagttgggagttgggttctgcacttctgcatttccaagttaccagatgatgccactgttgtggtcttctttaaatagcagtctttgtaggcagttgtaaagagtttggcttttattctgagagacacaggaagtcattggagagaacgcagcagaagagtggcatattctgatttatgttttaacacgatcagctgtaaatattaataacagtagcaggtctgtaatcccttatccaaaacccttgggacagatttgtgctggaatgcaggatttttcagactttagaaaggtagtacatttcacatatatatagtatattttataacattcaaaacagtgtctgaggcattactctataatcacacattagtatttctgcaatgaaataaatggtcacattcaatgggataaagactaaatattcttacattgatcaggtgaggtttttggtaccaaatgagttataaagagttattaaattactttgacgttcaggtcagaccaggctttgctgccaaatgcgttataaaaatacttccacttttgaaggcatttggattttataattgagaaaatacggacctttgttggtattatacttgttagtttttcatatccctacactgctggaacttcttcaagacaaccagtccattacatgttcattttaggccttgttgcatgcaagtgtcagcaagaaacgttacagccccagatctttcatattctggttctgctctcaggaagaaaaacaagtacctatcaatttgaaacacagtttctcatttataaagagtttttgccccttggcaacttattctgttgtgtatgccataaaagcatagttaattaaaagatgccaagcattttactatactttaggatagttaacgtgctttagaattatccaactccgctcatttgtggttgccacagtattacttccatgtctgactttgctttcttccttacagctgtgagctgccttattccacatttggctctacagtttataatctaaggcaaacctctctgtgttccttagaatccactttttttttccttagtgactgagtggttttcccagagatatccagtttaaaagaaatgcatttggaaatgatcaaaataagatgaaaaatgttgtggtcttttcccatctcagttacctgtgatgtgagtattagtaataggagccttatctctcttttcccaatagtttcatgtaagcgttagtttatcttactttctgagcaactgtccttttgataaagcttgaaaacatggatgtaaggaagactttgaagggttgctattttaatgcctgctggcaaaatgatatattgactctcattggaaaatcctgtgaatccgcattgcagaataatgcacattctaataaacacactactttaaatactcccaggccagggaatatgatcgattcctgttccaagggcaagaatccaagtaggtcagtgctacaaaactatgttggagtatggggaaagcatgggttaggaataatttctgccaaagaatgaataatagcaagaagaaaaacatcatttgcaatttttcttttaagaaaaggttaaggaggttatatagtgggtctgctgaaggaggtgagggttatctgagaccactgaattacagttggaaagataactgacaaggaaaatctccactaaaagtatagttgattattttccagaacttgtacttataaaaagtaaaaattctccaaagagtgttcgtatggttacatttttttaatatctggaatttcaagtgctatgaatggttaaaagtctaagttgttgaattggaaaaaatggaaacattggaacatgaacattggaacacgaacattggaaaaaatgttcatcaagcatattattttgttgtagtaaaacatatataacgtagtatattcttttaaggatgaattataaagacttcataaacatattgcattttaatttaatttaatttaatttttgagacaggatctcactctgttgcccaggctagagtgcaatgatgtcgtctgggctccctgcagtctcgaccttcctggctcgagcaatcctccctgcatgccactcctgcctcctaccccagtagctgggactacagatgcatgccactacacctgattaatttttgtattttttgtagagacggggtttctccacattgcccaggctggtcttgaactcctgagctcaagtgatccgctgcctcagcctcccaaagtgctgggattacaggtgtgagtccccgcacccagccgcattttagacgtgagatgcagagaagtagaaggatctactttattgtcgttatcgagttttgcgcattctattttctggggcagatggtttcagggaatgtattatattattaatgatgagtttttgaaatgtacccaacaaaatccaaatgggaaccagttgggaatgctgagatatcattgagaggactgacaggaattaaacatcatcttgaagttcccttttggaaatcctgtaggtaaacaggcctgtctgaggactttctgtaaatatgccgacatgtcaggagaaacattatcagaagttctcttcttctcacctcagatttgacttgtctagaagaattagtaggttggagaatgacactcttttacctttggattgagttaaatgacccatttcctgtgtatagctttttgttttcaggagtatagtgaaagatttgagtaagcagaaggactttgtgtaatctgtttgctaggtctgccaagctggttacaggaaactgcttaggtcttttattaaagaccaagctttagttttaaataggagaggtttccaaatttgcttcacgtttcatttaagaggctttgtttgcccaggctgtgggtccgtggtcaggaattgagcactgcatttacaaaatatttttttctgtgatctttgatgaagttaatgtgagcactgtagttgcacagtttcagaagtgtttgtttttttttttcttcctgagtattaacggttctgggtcactattctctgaagaattaaaaataattgtcttttgttttaaaaatagtttatttccatcagagttgaatcatgacacatcagttttcaacttggaacaattttaaatgacttcgttgcttctaagggtgaatttaactgacctgatttggccatgactttgcagagtgaattttaattatcttagttgtaatgccttctttccacattttgaagcatcttctaggaaagaagtttagtcaggatgtgagatacctagaaacctagcaaggctcatttttgtttctcattagtttagaatcgtgtatgttattaggagccattttcactgtgaatttttgttttccaagaaacttcattaaagagcttggatgttttctttgtgactctttcacatattaactatagtagttgtttgtttggtgtttactgtttatgcccttgtttcaaaaatcactttatagtcaaataagagtttaagcatgtcattattttggtgtgtctaaatattgaaccgaaacagaacagcaacaggtggggattaattattattgccgtacatttttggattaaagcagtacaggaaatctcaccagttggttgaaaggcgactcttcatttgaagggaagaaatggtcttttttcttgctaataaatgtcattctgtttatacaattcaaaattgttaattttcaaaccaaaggcaatctgaaactaatatgctttaaaacctaaatcacaatttttgagtgttcataggtcatttgtctaaacatttaaaatgcaatatagtcctttttgagaattcattatattgtttaaaagttgtaacagcctttggtttggccctaaaaaaataaacagcttaaatttaacattctagtctgttctagaatgaactgtttaacttgtaaaacgttaagcaggtttaaacttcaccagaggaatattattctaaaccaaagaatgcataagatatagattatataatgatacaaaaagaatatataataaaaagaaagaaataatttttgttttcagaggtcatttttaacaacttctatagatatagcggatgtaaataggatctaattggagagaacatgaagatgtatttagtcataaaatgttataaattaatccaaaaaatcaggacattaaggtatttgtaagtaaatttaatcctatcagtcagtaaatgaatacttttgagtatctcctaagtaactataatgttataaattatatcaaagatggatttaactagggattttaaaaatcattgcctaaaggctcagatatcttgaaatttttgttatttaaagaaaagtgaatgtcctgacaatactaatatttagagaaaaagcagcacaaaagattatggcaacaatgagtttaacactaaatcttgtttaaaatctatacctttgagtttaaaaaagcaagaaaaattggaatcgcttttcataaacatgatagaatatataaaaatatgtttagataaggttttcttgacttgcaattctagcagttaaccaagaatgaaagaaaatttaattaagaaactgtttttcatttcctataacaaatgcttgacattcagcaaattcaattagaaccggcagaagaggtaaatgaagacctccacagggattctgagggggaattcaaagactttagaagaatgtggtgctttattatgcgtaagtttgccacaaagctatagctgatttttaagcctcttggactgggatttctctggtagtacatgcagttcaagagcccacctaaaacaattagagcctcctgtggagtttgttaaagaggacttttctctgtctgattcagtttccatgttttcttcatcttacagatagtttacttacacttttttgtttttaatagttctctgttagcacaaatgtaatgtattcgttgtataatagagaggcctttctcctcctggttctaggagagaataatactccaagaccataggacatccattacatgtaataaggtaacttctctcctgtgcttccagaaagagtttgttatctcccatacttgggagaactaagaaaacagtcacttgaaacattatccaggcttgctttagaggaggagaaaggctgatctggagatcactactgttaacccttctagtgtgtgtctttctagttctttcatcctctctctccctgctgtgtacacatgcacatacatatacacaggaatatcttttctttcatttataaaaaaatgaaaaaattctctgacaaggttgtactgtacatacgaattaacttaggcttattttgatctcatctttttctttcattttcatggatttgtttatgtttttacatcaagtctcgaggagaatgtctcacacagaacctagcttagacatgaagcttctctcccctttcccaggccttgctgccacctgcaattttcagttccttactttgtgctcttgtgagtcggctccatgagttgtgcttgttgtcttctgtctttggctttcctgttgcctggtttgctttctccgactcttgagaagtgagctggacctgactacagcattcttctgtcctcaaatagctgagtatttaattgaaagaacatacaaaccagagaagaactcatagtgcgttatttgtggatggctcctgacaactcagcccaggttccctccagggcctgagtcacaaactttcctcagtatatctttatttcagccactctgcattgtttgcagttcctcaaacatgtactgaactttcttgtttctgccctctttttcactgtgttctctcctctgtttagtgtccttctgcctgttattcgcagcccctttattttaaaaaccatctatcctttaagagtcttgtcggataatacctcttctggtatgtgtttcttgactctctggccaaaagtgattccttctttccttccattcgttcatcagttcagcaaatacttactatagacctattcttgccaggcatttagacaagacaatgtttgtaaaacttctattactcttactttattgccttgtttgtgaataatatccatcatatttttgttactgccattgaaggcacaaactatatctggacccgcctcgtaactgacaccctcacccatagaaggtgtttcatgtgtaattactgaatgaatgaaactttctgattattttaacatttctgtgtgccagcataactgatatttttataaaattatcttttatattaggtatgaaaagtattactgacacttcatggcaatggagaaaaccttttaatagattttatgggtatatacttaatttaaatagtcgtacatatcatgataaggatatatgtatataataataataattattttttgagacagggtctcgctctgttgcccaggctggagtgcagtggcacgatcttggctcgctgcaacctctgcctccctggttcaagcaattctcctgcctcagcctcctgagtagcagggattacagatgcatgccatcatgcccggctaatttttgtatttttagtagaggccgggtttcaccctgttggctaggctggtgtcgaactcctgacctcaggtgatctgccccccccccccccccccccgggccttccaaagtgctgggattgcaggcgtgagccaccgtgcccagccataccatgataaagatattttaagcagctattcttaagtcataggttatctgcttctcattctcagtcatattctgctgatggagtttgacaggttcataagctgggtctgggcggattttctgacagaatcaaaaagaggtgttgtgagcgcttgagaccttcagctgaaggcaatcacaaacattttcggagtattagccctggataactttgaacaagctgctgttctctgccaaaagaacacacaattttctctcttttctcttcctaatttttgtatttcttctattagatgaaatatttcttctttgtttgtttgtttgtttttgagacagagtcttggtctgttgcccaggctggaatgcagtggcgtgatctcggctcactgcaacctccgcctcccaggttcaagcgattctcctgcctcagcctcctgagtagctgggattataggcgcgcgccaccccgcccggctaattttcgtatttttagtagagacggggtttcaccatgttggtcaggctggtcttgaactcctgacctcgtgatctgtctgcctcggcctaacaaagtgctgtgattacaggcgtgagccaccgcgcctggccctcgatgaaatgtttattaaccccactctatcccatatcctagatatgccaaggaaattacggtttaaaatactcattctcaaagcatggtccagggactcctgagggagattttacaaagttaagactatttttgtaataatactgagacattattttcatcactctcattctcttgctagtatctaattgaatcttctagaagctacatggcatgtggtataacaacagatgtagatatgagaatccagctgtcttgtattaggctagacattaaagagatttgcagaatgtaaaacaatttttttgttctgaaaaatatggttatttttcataaaaatgttaagatataataggcttattatttttatttttttaattttatttttatttttatttatttatttatttttgagacggagtttcactctttttgcccaggctggagtgcaatggcgcaatctcacctcactgcaacctccgcctcccgggttcaagcgattctcctgcctcagcctcccgagtagctgggattacaggcacctgcaaccatgcccggctaattttgtatttttagtagagacggggtttctccatgttggtcaggctggttttgaactcccgacctcaggtgatccaccctcaggtgatcggcctcccaaagtgctgggattacaggtgtgagccaccacacccagctggctaattatttttaaatgaattaacaaaaaaatatgattcaagtttctgcctgcctgcctgccttcctccctccctccctccctcccttcttccctccctcccttccctcccttccctctgttccttccattccttccctccctgcctccctccctcccttcccttcctcccttccttccttccctccgtcagtgtcacccagactagtgtgcagtggcacaaacacagcttactgcagcctccacttcctgggctcaagtgatccttccaccccagtttcctgtgtagctgggactacagtcacgcgccacctgattttttttttctttttgtcttttttctagagacaaggtctcacttgttgcccaggctggtcttgaactcctgtactcaagtgatcctcctgcctcagcctcccaaagtgctgacattacaggcatgagccactgtgcccagctgtgtttttattttcattttttttgagacggagtcacgctctgtcgcccaggtcagagtacagtggcatgatctcggctcactgcaacctctgcctcctgggttcaaacgattctcctacctcagcctcccgagtagctgggactacaggtgtgcaccaccacgcctggctgatttttgtatttttagtagagaccaggttggtctcgaacccctgaccttgtgatccacccgccttggcctcccagagtgctgggattacaggcatgagccaccgtgcccggccccagctgtgttttaatttccagtgtggctaatatcaataaatattaaaagctctttagaatccagatttctgagacccaaaagattgacagccactggtttataagatttaaaatatttaagataacagagaacacactttctaagagattaaaaggtaaagtccttttcatgtagtccaggtatcttcaaactggaatacttaatcatacttaatcataatggattaagctggttttcagttgttggacatttaggttgagtacagtattttagtctttaaaagtaatattgtgatattcttctgtattaatatttttctaacatccttaattaattgtttacaatgaatttctaaaaatagaactgctgggtctaaaggtatgcagaaggaactggcatgacctgttacactctcatgtttttttctattaatcagcaggaaatttattatgttcctttttagacagtctccgcctccaagtttgagccccaggaggctttcccagtcccagagtcatcccatctgcctccaaatgccagaaaaagaaccaactacactattgctcttccttcccatcatcattttttctcagcatttaagaccagccctgcactgtttggcaatagttgcttgaactgccactaggatcctgtttctggtcagaccatggcccaggtcacagcagtcaccgcagttgaaggtcaagattgcagttttttaaaagttcattttcttttactgaaggatttagtgtaccagggaggctgaggtcagagacacttccagcatccaccttaggctgtgccagaatctgtcctacctgataaacgcagaagctttttgtgtgaccttagatcaccagtttcagttattccttcttcaaggccattttatttcaggaatgtctctgcctcttcttgccagtgggacttggcttgagctatgagtgtcttctgtgacagaactctttaattttgaatctcaggaattaaagattggggtaatgtttcttccttttcaggaagatttagcgtcctggaaaattggtcctcctgccttcagcaactaattctgcatatcaagagattgaggcactttttcctaagccattcaactttcccctcccagtgtcccctcctcccctgagtcctaaggacagtggcacctacccactggtcaactaaaggaacattcaagccgcttttctctcagcaaaaggatccacaccagtgatctaaggtctctacccataaacataagaaaggccaaaataatttttaagtgttctccttcaaagaacatctcatctaatctctgccttaatagatacctgttacacagttaagcttatggtatatatagctaattgctctccagagaggttatgccagtttagacttctaccagcaaaaaatagattgctaggaaaatatatttaaaacctaaacagtgctcttaaatgtcattaattagaattgttttaatattaaaagaaatattaaaagaatattaaaagaaattcaaacttttcccctaatatttcttatttttttgccaaatactaaatttatttggccatgattgtgatctgtagcatcttgaataatgtcttttataacagagcaggtgtacatggaagaccaagatagtaagaagggaatacatggctgaaatcattaacagcggcttgaggctaatatggtaatattgtgttttcagaataacttttggtgaaggcaggagagggttcttatttactgaaggtctcctaagtacaaggtgctttatagatgatacctaatttaattctcaacaacaaacctatgttgttactattcccattttagatgatattgttattccattttataaataaatagattaagatgcagagaggtagtaaattttctaaagtcacagagcaagtaaaggttgatgttccctaagaaagcgccacctagcactaagtacacagttcttagagtaaggactttgagaattagcctttctttctcaccttctccaaagtcagaatgatctccgggaggccctcacggctcataggtgcagctttgcacagggtctgtgaggcgttagggccaactacaaaatctccaagacttccctcacttttgacaccaactgcaaattgagtgggggagttccccaaccaccttcatggactaaaattcactagaaggactcaacagaactcactaaacattacttacattcatggttattgccgggaaaggatacatattaaaatcagccaggggaagacaggcacaggacagcgtccaggagaaatgcaaaacacagagtttccattgtcctctctccttggagtcaggacacatgcccaccctccctccctcccttccttctctcctcctgtccttccttccttacttcctcccttccctccctttccttccttccttggtgcccaggctgatcttgaactcctgggctcaagcagtcctcctgcctcagcctccagagtagctgggattacagttatgtcgctggcttcttcttgcatttatgtgtgatgatccacgtgggatatttccaaccagagaagctctcccggcctcggtgttcagagctttcattggggctttattgcataagcatggttgattgactgtccatgtggttccttaactgataccagtgacccaaagccccaagttactctctggctggccccaggcaaacaaaaattatctttgaaggcaaggtctagacctcttctgagacaagattaaattatttactagatagggtcccagtctcattgagtgctccctcccttcctagcccctcacagtggatcaggaggtacctggtcaccacctcttatggtttggagccccacaaggaagtggagacacacatagaatatgggtgtcctgttataaactggaaactcgctccacgtcatactccttaggattgaattataataacagcagaatatcaaggaaataataacatgacttgaatgcttacaggcaaattttttctagtattaaaaatacaattgagttaattatggtttacttattaagacaaacttcaatataattaactgcccccccccccaacacacacaccctagcagaggcattgtggtcacttgcaaataatcacagagaagtaaaaaatttgagtcatatgacctgcctgttcccggctgtggccaagcaaggcagttctccgccttgtttcagctctcacgctgtaaacaagtcctcttttcatggtcttttcagggccacacttttttacatttttgtgggattttattgttgttgttcttagtgattttgccatttaaaatggtccccaagcctcgtgctaaagtgctgtctagacagtgttcctaagagcaagaaggctgtgatacatcttttggagagtatgcatgtgttagataagcttcatacaggcatgagttccagtgttgttgctgtgagttcagtgttaatgaatcaacggtatatacgaaataaggtgtctttaaagagatacacatataacacaaggttatgtatttaatggttgatgaaaatgttgtgaccagaggcacacaggaacctaaccctgtgttgcccccaggagcagtggttcagtatttgctgctaaattcagtgttcgaggtaacttcatagcatataattactgtgaataataagaaatgactctatttgctgcattatttcattcattattcatttattcatgtaatctgttattcattcttttttttttttttttgagatggagtcttgctctgtcacccaggctggagagcagtggtgtgatctcagctcactgcagcctctgcccactgggttcaagcagttctccctgcctcagcctcctgagtagctggggtacaggtacctgccaccacgcccagctaatgattgtatttttagtagagatggggtttcatcatgttggccaaggctggtctcgagttcctcacctcaggtgacccgcccctcttggcctcccaaagttctgggattacaggtgtgagccaccacgcccggcctgttattcattctttgagcagacatatttgtgtgtgtgttttgttttttcattttaccatcatatattccttctctgatgctctttctttatgtagatttgagtttctgacttacatccttttccctctgtttttgaagaatttcttctaacatttatttttggccaggtttgttgtgttgagttctctcatttgttgtttttctgagaaagtctttatctttccttctgatttgaaggataattctagtggatataaaatttggggttgttattttttctttcttcaacattttggatattttactcctctctcaatgcttttatggtttctagtgagaagtctacttgtaattcttatcattattctccaatggaaaagttatttttcttcttcttccaagatttcctctatgtctttaagttttccacaattgttttttaattttcaacttttattttagatatggggatacatgtgcagatttgttacatgagaatattgcatgatgctgaggtttggagtacaggtcctgtcaccctggcagtgagcatagtgcttaataggtagtttaactcacccctctcctcaccttctagtagtccacaatagacattgtgtcatatttatatccttgtgtgctcaatacttagctccacttataagtgagaagataacggtatttggttttctgttcctgtgttagtttgttgaggataatggcctccagctgcctccatatttttgcaaaggacataatttcattcttttttatggctgtttagtattacatggtgtgtacataccacattttattttattttatttttcatttgtttgtttttcaatttatttatttatttctatagatttttaggtggtgtttggttacatgaataagttctttagtggtgatttctgagaatttggtgcacctatcacccgagcattgtacactgtacccagtgggtagtcttttattcctctccccgtccatcctttcccctcactccccaaagtccattgtatcattcttatgcctttgtgtcctcatagcttaactccctcctgtaagtgagaacatatgacgtttggttttccattcctgagttacttcacttaaaataatggtctccaattccatctgggtaagttcacctgaactgctgcaaatgccattatttcattctgttttatggctgagttgtattccatggtgtgtatatatatatgtctatctatttatctctatatatctatatctatatagatatatatatatatcaattatatatatatatatagatatagatatatagagatatatagacatagatatatagagatatatagatctatattagatctatagatctatagatctatatatatagatatatagatgtatataccgcattttctttatccacttgttgattgatgggcatttgggctggttccatatctttgcatttgtgaattgtgctgctataaacatgcgtgtgcaagtgtctttttcatataatgacttcttttcttctgggtagatacccaggagtggaattactggatcaaatggtagatctacttttagttctttaaggaatctccacacggttttccatagtgattgtactagtttacattcccaccaacagtgtaaaagtattccctttcaccacatccacaccatttattattttttgattttttaattatggccactcttgtaggagtgaggtgttaacatattggggttttgatttgcatttccctgataattagtgatgttgaacattttttcatgtttgttgactatttgtatatcatcttttaaaaattgtttattcatgtccttagcccactttttgatgggattgcttgttttgttcttgctgatttgtttgagttccttgtagattctggatattagtcctttgtcggatgtatagattgtgaagatttctcctattctgtgggttgtctgtttgctttgctgattatttcttttgctatgaagaaactttttcatttaattaagttccatctatttatctttgcttttgttccgtttgcttttgggttcttggtcatgaagtctttgcctaagccagtatctagaaggggttttccaatgttatcttctagaatttttatgatttcaggtcttaaatttaagtctttgatccatcttgagttgatttttgtatagggtgagaaacgaggatccacttttgttcttctacatgtggcttgccaattttcccagcaccatttgttgaattagggtatcctttccccacttaatgtttttgtttgctttgttgaaggtcagttggctgtaagtatttggctttatttctggattctctattctgtttcactggtccatatccttattttgataccagtactatgctgttttggtaactatggccttatagtatagtttgaaactgggtaatgtaatgccttcagatttgttctttttgcatagtcttgctatggctgtgcaggctctcttttggttccatatgaattttaggattgtgttttctagttctgtgaagaataatggtggtattttgatgggagttgcattgaatttgcagattacttttggtagtatggtcattttcacaatattgatgctatgcatccgtgagcatgggatgtgtttccatttgtttgtttcatctatgatttctttcagtagtgttttgcagttttccttgcagaggtctttcacctccttggttatgtgtattcctaagtttttttggtttttgtttttgttttttgtttgttttttgcagcttttgtataagagattgagttcttgacttgattctcagcttggtcacagttggtgtatagcagagctactgatttgtgtacattaactttggaaactttgctgaattcatttaccagttctaggagctttttggatgagtatttagggttttctaggtgtgcgatcatgtcatcagcaaacaacaacagtttgacttaccaatttggatgcccattatttctttctcttgaagcagacatatttgaacactctatggggtgccaagcaatttccacatgatttaaaatttccatgttatgttcttatgcccactattagcagtcttgctgtaaccctttttctcaaagtatttgtgtggtttatgataacacattataaatgaagtgtgatattgcagtttaaaggttgcagattggaggctgaatgtcttatgtctatgaccattttacctgagctacttgtttagtcttctcaataaactttccagggattttttttttttttttgcttccttggagatcaaaatttttggatcagattgcctaatgggttcatgttggtttccagcagagccaggtgatgtggctggccatacctttctataccaaaaaatgtttctgcagtcgtggctatatagtcttgcaggcagagcttttgactggcaaaaattagtccccagctatgctttactgatgagaagccacacagcgtagccagaagctacactggccccttcttctttctctgataactccacgtccgtcatgtgtttgtatttccatctctttccacttcctatttatactgtctcctacatctgcactcaggcaacatgaggggaaatggacttgaagagcagatgttcacctcatgttcgttgtggttccctagatacactctcttccattgaagtgtttctcatttcctggttttgattgtccaggatgtgtgaggactgagatctgaaccttgctgttccttctttcttcatgttagtaaaaccatgtacattggaatcccccaaatgtaacgggggaaaataatagaaatacttaacttttgcggtgattaaaatgattaatctggtgaatttgactgaaaaagaaaaattcaataattttagggatctttcagtgaaataatcattaagcccaaagaaacaaagcctttattgactattacttcagtgatagtaagaaatgagtaccagcagtaaaagttaaccttgatgtttttatgtaattagcaattgaataaatacagtaactttatttaaacatctttgtaaaattactccaactaagtaaggaccaagactaaaaaaaaacccttgaatgccccttagtgcctagcacaatacctagaacaaatagatctcaacagatatatattaaatgagttaatgattaaaatgtctcatttaaaatttaaatattcagtaatgttaatttgatgttttttctttcagatacagatgaatatagacctcctgtttggaaatcttactgtaagtctacaaataattgtgtgggttatagtgctttataagtaatataaaaatatgggattattagatagaaatactcattccattttgtacccattgttgaaaaattaatttaaacaaggtttgggagtagcatagaaataattgtggttaagtaagtgtttacacaaagtctgtacagtatatggttttccgtctggaatgcatttcatccctctgagcttatatgaattccatgtagtgaaacttgagaccacttgttcagagtggctaatgaagctaatacaaggagacactgagaattcaaacagtctaattattttcaggtcctgattctttatgtgaagaaaggaatatttaaatgacaataattcaggaggctatgttgatagaaagaataagtgaaaagaggcaaaaaaaggtgatctaacttttaaataattactttcccaaaacataagggagatacttgattccatgctgctctttaaactgcgttaggatatttctttttaaacatctagggttttagttctttattttcctttccttgttttctagagaatattatttcaccaagtaaaggatatttcagattttaaaagttcaaatagggctaatataatcaaaatggttttttaaaatttatgaatgcattattatggaaaagcactataagttcttgttcgttgtttctgtagttgaataagcagcctaagaaacctgttctttaattatagattaacatctttgtaaatgctgaggtttattataaatctgatgattgtaggttgctgaaatttgctgactgaaggaacagcaattcagattctcattggtcttatgttctcagaacagataattttttttttaataggttgccactttgggctaattataagtaaaatatgaacagtctctaaaaatattgccatagatgcttcccctcaacgctgctagtgcctttttctttttcccttgggagtatagttatacgaatgtgtaaaaatgactaatattctttacctcctaaagattttgtctcataatctcattggctggaagcctatttaaaattcttctctggccgggcactgtggctcatgcctgtaatcccagcactttgggaggcagaggcaggcggattgcctgaggtcaggagtttgagactagcctggccaacatggtgaaacccatctctactgaaaatacaaaaattagctaggcgtgatggcacacacctgtagtcccacctacttgggaggctgaggcaggagaatcgcttgaaccagggaggcagaggttgcagtgagccaagatcgcaccactgcactccagcctgggcaacagagcgagactccatctcaaaaaaaaaaaaaaaaaaaacttctctgcattttctggttttcagtttatctttattccctgactctgacttgcaccctgcacatttttaatgtaagaacatttatgaagcctcagactattattgagtttgtagtgatcttttcctccatgaaaaatatcaattagtaaatgtagtatatgcaactggtattttttgtagcttcacatatctcgcatgtcttgcagtagctatcatttgttttaaaatatggcatttatgtaatcccaacactttgggaggctgaggtgggtggatcacctgaggtcaggaatttgtgaccagcctaacatggtgaaacccgtctctactaaataccaaaaaattagctgggtgtagtggtgcatgcctgtaatcccagctacttgggaggctgagacaggagaatcacttgtacctgagaggcagagactacagtgagctgagatcgcacctttgcactccagcctggacaacaacagtgaagagcaaaactatgtcaaaaaaaaaagacattaaaaaaaaaaagagagagataggctattgctttgtcgcccaggctggtgtgcagtggcgcaatcttggcacgctacagccttgaccccctgggctcaagtgatcctcccacttcaacctcctgagtagctgtgaccacaggttgatttttaaaaattttattttgtagactacgaggtctcactgtgttgcccaggaaggtctccaactcccgacctcaagtgatcctgcctccttggcctcccaagtgttgggattataggtgtgagccactgtgcccagctgaatctttctttaataagactacagttctgttacggagttttatcatttctcttaatgacttcaatgtctgaactccccgtaatcattttaacagtagaaatgtgtaggaaattattaaaatagatattttatcttttgactttttcatttgtcacatgaaaaaaacttctgagtcaaggaaattttataattaaactatgttaaaagcaagtggaaaaatcctttttagaaattttcttataagattatgatattaatcttccaagatttgagtatgtgcaaattttaacaaatgaggaaacataaaaattgcagccaggcttggtgactcaggcctgtaatcctagtagtctggggagactgaggtgggaggatcacttgagcccaggagtttgaggccagcctggccaatttaggcggatcccatctctaccaaaaaataagaaataaaaacattagctgggcatggtgttgtactcctgtggtcccagctacttgggaggtggaggtgggaggaactgcttcccagctacttgggaggtggaggtgggaggattacttgggcccaaggggtatggaggctgcagtgagttgtgatcagtactctgaactccagaccctgtctcattcatttattcattcatgttaaataaataaatgcattctaacgatgactttttatgatcatatagatggttaatgtgtttgtcaaattctgatcttagaaaaaaatgtgattaagttgaactttttgtttatattatcttttaccactcaagacagttttacagtttttacaaccagctctaaataatcttcagtaagatgtttattaattgtaccttaaggacttcatctcttaggaatctttatattttagtaggaaaaattttaaagactgaccgacctgttataccctgacttcatcaatagagactggaattttaaataactgaggtagtaggcattgttcagtatccttaatatgtgagccatgacaatcttaggccagatatatatatagtttagaattgataattgacaatattttctactaatagtctttgggaccgacaaactgtaatgcttcagcatctctgtgatgtgacttaaatttagttattaaaaattcttaaaatggtaataaaatagaaatgggctgaaattttaaaaataattaggtatgtcaattcatgtaaggtggcacacccattgaaagctattcaaggagttctaattgttcacttctgtaatagatctataaaagtaaacaagatgatttaatttaatgtcaaaagttgctacatgttagtgtgttttgtttttctatctttggcatggtggaatctgaacagcatttcacaatttgattctagaagaaacttattttacccatgcctatcttgtacttcctactgttagttccattgatcttgtaaaaatgtaactctgaagtcttacaaatataaaccaatagggaagtaaaattagcaagaagtctaagttgtggactctttttaaacaaatacggttttgtcgcttttcagtacttattgtgtgaattaaaccaggaaccttacatgtaataaatgaggcaagcaagccagattaggactatgagtaagttgaccgtggagaccttgtctgtagagagtagctcaaaattagctccttttattgtcatgttagactctgggttcattattgccagatctgagttttcaaaagaggctggaattctcttttgcttttgttgtccttaagtttcttaattttttaatgttaaaaacctactcaaatgtaaaagacagcaaacaaaacacatgtggaccaattttgacttcaagataccaatttgtgatctttggacttgatgaacaatttattgtctgtagggattgagaatttcattaataagtatatactcattgacacttctaaggtgactgaaaatattaagtactttaatcatatattccctcatcttgaatttagctattaatttttggtgaatcatttaatgattgtgcttatttaaattcagctgagttccaattcaaattatcagaaattccaaactgagagagaaggacctgaattagacctcattactttgtataactttttaatgatctttttgataggtgttttttgaatccaaatttgttatatttgttataaaatatccaagacttgactaggcacagtggctcacacctgtaatcccagcattttaagaagccaaggtgggagtatcacttgagctcaggagtttgagaccagcctgggcaagatggtgaaacccggtctctataaaaaatacaaaaattagcttgacgtggtggtgtgtgcctgtagtcccagctacttgggttctgcggcataaggcttgcttgaactcgggaggttgaggctgcagtgagtcatgtgtgtgccactgcactccagcctgggtgaccaagtgagacactgtctcaaaaaaaaaaaaaaattaaaaaaaaaaagagtcttaaagatagattaactgttagtaaccactggtagccaatcaggaggcatttgtctaaaagttcctcgttatgaaacagagctttatcctttgagacgattagaaggatttgaaagaaattgaaaagtaaataaccttatgtgacttaatgttaagaaaatactatataccctttgaaactctgatgaaagcaaatttgaaacccacatcaattctcatatgacaatattgtctccctttttttcatagtggctcatcttaatgtatgcttactgaacaggcaaatgcttactgctgataaccagatactacagtatttgtgctttgagtcaaaatcgacattttactttctgtattaacttttaatgttcttcttgactatcattcagttctcagaattgggttttcatagatggcagcactttccagagcattttcttgacaaaggaaaataccaatattttgagaattactgatcaaagtagaaacgtgaactaaatttttaccttataggtaccaatatggaggaatggacttgaagaattttttttttttttttttttttttttacattttttagagacagggtctcgctatgttgccaggctggtctcttgagctcaaatgatcctcccaccttggcctcccaaagtgctgggattacaagtgtgagccactgtgcctggcccttgaagaatccttctttcttacaaatcatggtttggccatttttaaggaggatggagatttacacatatcatggggtgatacacatgtacttttcattatcagggccagacaaatttgactttagtgctttttcttcccttttctacctcagaattaactccctttttgtcatctctgtaacaatatataaaactatattcacaggaatatttcttattaactctcacaatgaaatatgggtatctaaaactgtttcaatgtattacctctcttagggatttttgccatcaggagaaaaaggtaaaggaatacatttctaccagtagaatttaaacattcctgatgaagtggctttgtgtttgatttttaaacaataaagctgtattttctcagttccttttaaattatagcattgccctgatactatgttttagtgatgaactcaagatgcatcctagtaatcaagtattattataaagaattttatgtattaatatcaatcacctatgtataataataagtagtcttcattgagcatttactgtgtgctagggactattttacatctttcacataaattatttatatccttaagtaatctgtgaagtacaaactattattaatcccattttgcaaataaggaaaatgaaggcatagaatgcagtgctagtgacagagccccagtgttcagactccagatggtttggttcaagagttcaaattcttaaccccagtgctgtatcccctttgcatagaagtactcacagttacgtgtatgtgtgtgtgttcactgtgtgtgtgtgtagagagagatagtatatatatacacacacatttatatatatatacacacacacacacacacacacaggctaattatgtatgtgtgtatagtctaattgtatttattctatatatgtccctatgatgtatatgaatgaatgtggtcagaagtagagtccgtgtaatcatatccatttgaaatctgagtcatccgttatctgacagtcccagattactgggtagtttgatgttatgttgacaaaatatcttaagtatttagagtattaaattatatgtgattatatatgtagaaatagaaaaaaaaatctctaagagataaacttagacatatatagccacacatcctattcattcttttttcattttaaataaaaaagcctgaagtgaggctagaaggaagtcatggtatcagtataattttcactgatgcattttcagatgccctaaaaatgattccctcttttggcaagttatttgaatatctgaattctttcttttgctatatttgccctagttgaataagcagtggtaactttggctcagaccttttgtttttaggggaagaggaaaattatctttgaagatagatgtttgcaatataaatagtgtgttcgttacatttagcctataaatcttgattttagtttcaaggttgacacttaataacatgctttaaatatatgtatatataaccattattggtttatatcatagacatcctttaatatccccacaaagaactggggaaaataaatgaccagattatggagaacagagccaaatatccagcactgacttgttataaggtaaaaagacacttgtttggattatgatttttctgtttgaattgctcctgggctttcactatatgtagttttgtttactttttttgttttgttcataacacaatttagtaaataaggttataccagttttcttgtgaacataaaaagcagccaggtttttatttctaatatattgataagttctatgtaagggacattgacactttttgtttctaccttctcacagtatatcagctacaacaggaagcccctcatcctcgaagaattacctgtacttgcgaggtgggtgtaatgaaactgctaccaaaaaatgtctctcaaccatctgtttcccaaactttcaccttcttcagtggcttggttgtttgtgagattaaccacttaacactaatcgatatgataaaattataacttgaatacatttttcttaatatccttctcatttgatttaacttccactttttagtggactgtttggaacacagtatagaatatgaccatatagttttaagggttgttcgtattcttttcagttaattcatacattgtgttttcattgtttaatattctttttttagaacaaagtttggagccatcattgtaggattattgaattcttttttacattgaaataagtatttagcttatgattttaaaaatgaacaaaagatgtggatagttcaccaaaaaaagatatgatgtatgacaatatatgtaaagatgttcaaatttcattgataataagagaaatgccaattaaaatacagagagatcatttttactttgcagattggcaaaagttaaaagctcagaatatacttacttggcaagcctgtgaggaaacaggcacttacattgcagattggaatgtgacatactataactttatgagaattttgtagtatctaccaaattataccttcacctgcctttgacttaccagtccaaattctaggaatttatcctgatgaaccacctgcacaaatatagaataacatatgctcaaagttttttattgtaggattgttagtaatagcagaaaaaaacctaaatgtctgtccagaggagactgattgaatagaatagaatactaaaataaggaagatttctatgtactgatacggaaagatttccagatataaaatgtatatagatatagtaagtatggtccctctttcatatgaaagaatagaaaataaaaaatatatagtctggtcaggcaaagcagctcatgccagtaatctcaacacttagctaggcacaggtgagaagacagcttgatccaggagttcaagaccagcctgggcaacatagtgagaccttgttctccacaaaaaggaaaagtatatttgtagatatagtttatttttgcaaaagagaaacacagaaaggattaaaccagagactggtaaaataattatgataataattatgataaggagtggatgaagagcaccttatttacataattattatcataataatatgataaggagtggatgaagagcactgtggaggaaatagagatgggagtgagatttttctgagtctgatttttagtctgagttgtgacttttgaaccatgtaaatggtcacgtattgaaacaaaaaaggtaaagaaaaatgatttttaaaaagcaaacccagctgggcatgatggctcatgcctgtaatccaagcactttgggaggctgaggcaggcagatcacgaggtcaagagtttgagaccagcctggccaacatggtgaaacccagtctctactaaaaatacaaaaattagctggttgtggtggcaggtgcctgtaatcccagctactcaggaggctgaggcaggagaatcgcttgaacccgggaggcagaggttgcagtgagctgagatgggaccactgcactccagcctgggcaacagaacaagactccatctcaaaacaaaaacaaaaacaaaaacatgtacacacatacacacacacacacacacacacacacaagcaaaccctaaaattgaatacaaataagaacaaatgaaccttacaaattcacagcataatcaccaaaaaagataacttaaatagcttttatttatttatttacttatttacttaactttttatttttttttttagatagagtcttgctttatctcccaggctagagtccagtggtgtgatctggctcactgcagcctcaacctcctgagctcaagtgatactcctacctctgcctcccaagtagctgggactacaggcatgtgccaccatgtctggctaatttttgtacttttttgtagagatggggtttcgccatgttgcccaagctggtctcaaacgcctaagctcaagggatccacccaccgtggcctcctaaagtgttgggattacagttgtgagccagggcacctggccttttaagttgctttttaaaaaatattttaaattgacacataataattgtgcatatttgtgtagtacagagtgatattttgatacatgtatacactgtaatgattgagggtaattagcatatccattacctcaaatctttgtgttgagacattcacaattctctcttctagctaattgaaaatataaattatttgtaactcttatctaggataattttatatctattaaccaacctctccctatcctttttttcctctacccctcccagcctctagataccactgtcttgctcatcttctgtgagatcaatttatttagctcccacatatgaatgagaatgtgcagtattcatcttttgtgcctttcttatttcatttaacataatgtcttccaggttcatccatgttgctgcaaaatgacaggatttcattctttttaatggctgaatggtattccattgtgtaaataaaccacattttctttatccatttgtctgttgatggacacttaggttgattccatattttggctattgtgaaaaatgctgtaattaacatgagaacacagacacctctttgacatactgatttccttttctttggatataaccccagtaatgagattggtggattatacagtagttctatttttagttttttagtggaacctccataccattttccataatggctgtattaatttgcattcccaccatcagtgtatgaattcccttttctctgcatctttgccagcatttgttttgtctttttgatagtagctgtactaactggggtgacatactaacagtggttttgatttgcatttccctgatctttagtgatactgagcgttttttcatatacttcttggcttaagtaacttttaaacatattattctgactgtacaaactcagaaatattctaaggacaaaaattgcaaaaggcagaggtgaaaagacagcttgagcccagaggttcaagacctgcctggcaacatggtgagatcctgttctccataaaaaagaaaaaaaaatagtttatttttgcaaaagagaagcacagaaggattaaaccagagaccagtaaaacaattatcataaggagtagatgatcaaacgttcaacatgtgaacatttacaaagttcaaaagtcacaactatataaaaacagacttagagaagtcttaactacatgtgtagtaatcttgaaattattttgtttgtaatataggatagagcaaagaaataattttactggattagggggaaccagggttcttaggagatattaatgaattaggagaatgggacacaattagaaagtatactgtggtattagttttgaattggtggcattaatattaacttatagattaaaaaaattttttttctatctcagtccaaggaaagggcctagaagccccagtaagaatgaatatttccagggactagattttgggttccaaatatggtttcccaccaaaaggaggcaatgttttttagagaagttcctgatttcttaatgtggggcaaagaagtcctggaacatattgtgttggaaagcaagaacgtgctcaaaaactgatggaaacatgtcaaaaaggcacaggagcctatttgaaagtttcctaccatcaaaacttgaaacaatttgaacatctaaaagaataatggtaggtatggattataacacattatgtgagagagaatttgtaagtccgtaattatactttaaaattaaaaaaaactcactttgttacaaagagaaaaaatggggaaatatacagttgttctttacagaagaaatgacacttaaaatgtagaaaaaatataaaattacaaaatcactaatttgcactaatgattgactccaggcaaggatcatcagtcattggatgttaaaaccattggaagaaaggctgtaggtgaacaggatatttacatggtctcaaggtatgacaccaccaattatttgttaattgcatagagaaaaatatgcctttaaagtggagagatctggtggtcaaacttagcattacctgtaatgggacaaactgtcatgtgtctcctgaagtgatacagtgaaacacacggtatcacctgtataatatttttgccaaaactgtttaacttaaatctagttataaagtacgaatcagacaaattcagaatgtgtaccttccataagacatctgccctgggtttataaataatgtcattatcataaaaaaaaaacagtggtgggatgatataaaattaaaggagactaaagagacatggccatcagattcaaggaccttgatcgggtcctcaacttatatatatattgtaaagctataaattttgagtacaattggataaatttgagtatggactgtattaggtaatgtggaatcataataactttcctagatgatacattattgaaaaataattactctcggctgggcgtggcggctcacgcctataatctcggcactttgggaggctaaggcgggtggatcacgagatcaggagatcaagactagcctggccaacgtggtgaaacaccatctctactaaaaacaaaaaattagccagccatggtggcatgcgcctttagtcccagctactcaggaggctgaggcaggaaaattgcttaaacccaggaggcggaggttgcagtgagccaagatcacaccactgcactccagcttgggcaacagaggaagactctgtctaaaaataaataaataaataaaataaaataaaagtaataattatttctctattgataaaaatgttaaaatagattttgttattgtgacttctggtttaaaacacaatatagctttgaaagtatataattagttaacaaagagaaccaatttacagaattaggcaggagtttcatgggattgtcttttgaatgtccagttgcagtttagatatatgtagatttccagtctgtgtatatgtaagcatagaattaagtatgaggtacttgattattgcctttcattgctgctcgctgtgatcaaggatgattaaataatttgcatgtaatgggaattttaaaaatgctatttaataaaatgtttcattttgtttcatgttctgttcacacatactttttaattttttaagtatgtgagaaactgaaagtgagaaattggcagtactttggaaagtcctgaagtatttattagtaagactattatctttgttgaaaaatagctatattattcctttcttaaaataatttgagacctcacaaatgaagacataataaaaagaataaagaaaagttgaaggaataaaaacagcaaaatgccagtagattgcagtgctgattgaggctcaatgtagttgtgtgaaaagtgtttcacagttataaagtatatgaaactctgaaggccagtatgatccagttttttcctgaattaaattgttttaaaaaaattcatttggtgtgacattaaggtacgataaatcaatggaactcacttttgaagagctaagctgatgtggtcacagtagatagctttctgatgattcaccttgatgcaaagacacaagatagaataatatactggatgaatagatggatgttagagtctctgaaaataatttccttttatttacctttgctctgtgattgaatgctgccatcccctgaggaactagaccaattatttgtattctctcctttggttaaaagcaggcatgaaagcattgaaaaaccagaaaagcaaattgtacaattgacattttcctacttaaattgagcaatgtattcatcatttccactttgcaatataaaaaatatttattgtattaacttttcacaatattttgtgaaatatttatgtttcacaaaaatatagattttttgtaaatattttatgtttgtttatatttaaaaatatttatatttttttctccaaaaaaatagtcatgttctaatgactaaattggtgggcaaggaatgctgttcagaatgaaaggatttactgtgactggctctccttgtacattgaaactatccttacatattattcacaacttatagtctgttacttattaacagcttatagtcagttccttaagtttgactgtttaataaggattaaatatgtgtgcatacaataaatgtctttactttggaaattagtggtgataatttgtttctatatttgaccgttctctaggttgttcaatgtttttctgtttttcccaggtgataactaaatgacagttactaaacaggcataagtggtcttcctttaaagaaatgaaattcatacataatattattataatgattagatttacaaatagagacatgggaagtatttataagccactaatgctaatggtttgcttattctattaagttaaatatctgtataacaactaagtaacttgaatgtccattagaaatgaaagtaaaggattaaatagtgggatagagttgatctaaaaatacttttcgaaggaagaaagtttcagagttaggcttgatgaaatgattagtgattggtttggaagaactaaagattattgagaatcatgagctgtaaggataaagatgtactcaagtaccatttgatgttcacccttaagtatttaactgtgagccaggtgtggtagtgtggtggtgtgcacctgtaattccagctacttgggaggttgaggcgggaggatcacttgagcctaggagttcttgagcctgtctcttaaaaaaatttttttttaactgaggaattagatttgggctactgtgttagttcattttgtgctgttataaaggaatacctgaggctgggcaatgtattttaaaaagaggtttatttttggcccattgttctgcagaatgtacaagaagaaacacagtgccagcatttgcttctactgaggcttcacgaagctcacagtcatggtggaaggcagagggggagctggcatatcacatggtaactgagggagcaagaaatattaataggatgaggtgccaggctttttagcaatcagatttcatggtaactaagagagtaagaactcactcattactgtgggaagggcaccgagatattcatgaaggatccgctcctgtgactgaaacacctcccaccaggctctgtccccaacattggggatcatatttcaacatgagatttggagggaacaaacacccaaaccacatcagacactgtatgttgtttctccactgaaatgttgagagaaaaagagaaaagttaatacaattgataaggtgatagtttttaaaaagtaataattattatttatgggtgctaattgtaatttttaaaatggatccagtgactttgtctttcggaattatgcttacttacaatgataggaaagggagcactggccctatttgtttgcatgtgcacatttccattccattttcttctaatgatagtattgtatcacagcttacaaattcagtaactatgccaggctcaaagggaacatacatttagtgactagccatgtgtgtgtgacctttcttttgtggtctaccccttgttttggtgatgaattctgtgttctgctcttaggtgaatttctgttagcattttgaaaccaaatgtgtatcaccttatttcaaaacctgaattatcaactattaaaacaatcataaactattagtggcagaactctaaaatgcaaaatatctagcaataataaataatttgacagaaaatcaaattataactaatgcttttttcctaattccagaaaatcttgccagttgctattgtggacactaaaatataaatgatttttttattaaaggttattgttgagatcaattttgaaattcagatataaataatccttcttaaaggaagaagatgaccaggccacaactaattattttaggcaggctttaaaaaccaagcacatacttaaaagcttgaaaattattcttaataatgttgctacatgatacagttgtatcttatgggagagttaattctgaagttagcaagtaaagtgaaagtcttatatagtcagaattacccctggaaattccttatcacccataaagtaatggtacatatttttgtgtatacaactctgtcatttataggtatatataaatatatgatttattcagtgaaatgcagtatataaaaaatgtaaaatatatactattattttctattgtgtaaaaatggttttgtttgttatttcatgttaagcacttggttgaattcaagtaaatgtgtatctatatatgtgtgtgtgtgcatgtatgtatatagagtgactgagtagacacaagtataaattacataggtataagctatatctatttattacataggtataaaatctatctaattcagatagagatatgagagaagctccatatcttttgttcactgatattaatacagtgtatttggcactggaccattattaaacatggaccctcaaagtggacgcacttttccccctgctatccacacagtgggaaatgtagtgatgattttttttaaacatataaagccaaatttctattccctgtgacacatttttcaagttagtgttgcagggagttggatagcatttttgagtacaggtgcacattatagtaacaatgaggttgtctttctctaggctaaatgggtaaagtagactgaggctggacaaaatgtactgaaacacaagtcagtgctattagtgtaatgagaaatgtagataaaattacacaatttacactgttttcaaattctaactacaataccaattagagtaatactgagtatgtattttggtagcacatgttttatttttatttacttttaatatattttttagagacagaatcttgctgtgttgcctgggctggagtgcagtggcccaattttagctcactgtggctttgcattgccaggctcaagtgatccttctacctcagcctcctgagtagctgggactgcatgtgtgcaccgccgtgcctggcttttttgttttgttttgttttcttgtagagataaggtcttactatgttccccaggcttgtcttgaactcctgggctcaagcgatcctcctgcctcagcctcccaaagtgctgggattacaggcgtgagccaccgtgccaggccaacacatgttttaaaaatgtttttctaaagacctacttatagaagtaggaaattgactgtaatcattttactcacctgtctcccccaagcagattatgttcagcacctaggtatgctgactggtgtgtagtataggttgttaaatgcttatagggtggaatgaatgaatgagatatctttgtgtaatttatttttcaatacaatgttcttataatatggcttacaaaatgtgtgcattaatacctatatctgttagagatgctctggttctttctgtcacatgtatgtatttgttcattcagtcagcattcttggaggggctaccatctgccaggccctcaggtttcaagtcaaataaagcaaaatccctctcctgaaggagcttccagtctaggtggggaatggagcggtagctcaacctttacttagtgcagaagcgcagagttggtagtacttaccttgatacatatgtatgcagctcctctggccaagggcagagtacttgtgggagagtggtaaaagataagcccggaaagctaaccaggcattagtaataaagggttctatgtcctaagcttagagtttagactatagaagtgaaagtattttaagcaggagaaaaacgtgattgattaggcttaggaagaacaactggctgcagggaagaggatggatattttagagacaaaaagactggtttaggaggctattacagtagtccttgtgataagtgaaaagaacctacaagacactggttctgagaatagtcaagagggattaggaaaggggaatatttaaagcagtagaattctcaggacttgctgacaagatggtcatgggttgcatgagagggagtctagtagattttcaggaaccagtcaactctcctaatcttctttcatgtcatacttgcttggcaaaactgcaaccctattgctatctctgcctattctgcacattctgccaagtaacagtatggctggaggaaaatgaaatatttcggaatttctgaacttcaagttggtacttaatgctccctgtactgcctttattcatgtcatgccctttctctcttctcaaacctctaatacaggggtccccggcccctgtgccacagactggtaccgtcttgtggcctgttaggaactgggccgcacagcaggaggtgagcagcaggcaggtgagcaagtgaagcttcatctgtgtttatagctactccccattgctcacattactgcctgagctctgcctcctgtcagatcagtagtggcattagattctcataggagtgtgacccctattgtgaactgcccatgcaagggatctaggttgtgcacttcttatgaaaatctaatgcctgatgatctgtcactgtctcccattacccccagatgagactgtctagttgcaagaaaacaagctcagggctcccactgattctacattatggtgagttgtataattatttcattatatattacaatgtaataataatagaaataaagtacacactaaatgtaatgtgcgtgaatcattccaaaaccatcccctcacctctgacccctgtctgtagaaaaattgtaaaattgtctcccacgaaactggtccctggtgccaaaaaggttggggaccactgttctgataccttactccctctcctaattttcagctcataattttgtatcctactttactcctgcttaaagccatcagaagagaacttccacaaacttccactgtcacatccacccaaccatcagtatttgtgtctgtatgttctgcattcttgcttaacctcataggtgatagctagctcttcactacactaaacctcacttcctctctatctgcttaaggacataatcctagcaattttctcctttcctccaccatcaacagcttttccctttctgcaagatcattttcgtcagcccacaaatatcctattatttctcctatcttaaaaagttctcttgaccctgctttctccatttgcctcgctcaatttctttgctttcttttgtagaaaatatttcaaagtgttgtctgtacttgctgtctgcactcagaactttacccactgccactccaagcagaactgctttggtaaggtcagtactgacttccctatacatacaaatctagtagttttttttttcctctcatcatcccattaggagcatctgatacaagtgatgactttctcctccttgatacatttttctcactttgtttccaggatactacattcttttattttttcttttgcccccacagtctatttctctggtgctgcttcaacctgatctcttgattttggggtgcccccaaatcctctcctcttctcttctctacctatatttactttattatgatcttaccagtttcaggttttaatgtaacttacatttctttatatgtccagtcctttctcccaaactcctatatacctatatatatacacacatatatatccagtttcctactctacatcccctctcatatgtctaatagacatctccaacagaaatagcctgttcaaaacagaactgagcttcaccttcctccccaaccttctattaccacagccttccagatctcaattgatggcagttacttaattccagtttcccagaccaaaatcaggaagtcatattgggtctatctttggaatatgtccagaatcctaactgtattagtctgttctcacattgctataaagaaatgcctgagactgggtaatacatagagaaaagaggtgtttaattggctcatagttccacaggctgtacaggaagtatggctcgggaggcctcaggaaacttttattcatggtggaaggcaaagccagagcaggcatcttcacatggccatagcaggaggaagacagagggcaggtgccacacacttaaacaaccaaatctcgtgagaactctattacaaaaacagcaccaaagagggaaatccacccccataatccagtcacctcccaccagtccccacctccaacattggggatttcaattcaacatgacatttgggtggagacacagatctaaaccatatcactaacttttagtggtaacctgtttcatggctaccaagcaaggatgaactgtggaaactgtgagatactcggcaaaatccagtcttcctttctttgaaaacctgggtagcctaaattttcgcagcctcttgtagatacttacgtcaatttgacagttttctctaggggaacagacgttaacttcaatgctagacccattaaaactttttgccaacttaaatcctgcttgcattcagataaaaacatctccacaaggagatggtatatctacaaaatggaggggatatggatgtaggacagttgtcttgccaacttgagtacatatacaggaatgttatataaacgagaaataaacttctgttgtgtctagttattatatattaaggttgatttgtcatagtgacttatcctaccttaacacacagtaatccctcaggagggtaactgagctagttcttaactgatctttccccttatggtctattcccagcacagagtaatctttttgaaaccacagtcagctcatgtcactgttctgctcagaactctccattggctttccctgtcactcagagtaaaagccaaaccttcacagtgccttataaggtcctctctaactcatctcttactgcttccttgcctcctcttccctgcccccattctgcttcagcctgaccagtcttcatgcttctcagatacagcaggtgtgatcctttctcagccctcccgctgacttctctttctggaatgttctctctgatacactcttggctcattcgttcatatgcttcaaatcttcccagcgaggcccattgtgaccactatattaggaattatactttatcatccccccagcattcccagtcttttcctgttctactttgtcttgtcttcacaacacttttcattttgttacatactatatagttcacttatttattattgtttactgctgttttcccttactagaatagaagctctatgcaggtagcaattttggtctgttttgtttatcagtatttcccaggttcctggaacagtgcttgacacttagtaggtgcttaataaagacttgttaattgaatggatgggaggtacaatgttcttgttttattcttagtcctttttagaggacatattctattaggtgggagcattgagtttggcacaggagtgggaggaaaacactctaattgaaattagagtttggccactgcttgcactatgtgctcacacagcctatagtgcaacttttggttccaaaaaaataaagattcacatgctcatatatcttggtgttgtgataatctgttatttaacacttataatatgctttgcagatagaagcattttatatgaatgctgagtgatagctgcgaattattgaaaccaaccatttatttaaaaatcatcctatcactcaaaggctatttttttttttttgccatatatttcttttgaagtggtcttttagtgctatcttttgctcctgtttaaaattcagctataggcctggcgcagtggctcatgcctataatcccagcactttgggaggccgaggcgggcagatcacgaggtcaggagtacgagaccatcctggctaacgtagtgaaaccctgtctctactgaaaatacagaaaaaattagcctggcgtaggtggtgcatgcctgtagtcccagctacttgggaggctgaggcaggagaatggcataaaacccaagaggcagagcttgcggtgagctgagatcgcgccactgcactccagcctgggaggcagagcgagactccgtctcaaaaaaaaaaaaaatcagctatagtaaattcctataattgtttgttacctaggcatccgtcttgaatattaagttggactttttcataccagaaacagggcttagtcacccttgacacagtttctaattcctacctcctgccagtttcttaatgttgccaatccagatatttgccttatgcagactcctttgttgacctccctttgggccagctaggtacaacctacttgacttgccccccaacccccataccctgcatgggctgcccagatatgtctcattgaccacctctgagtgacagcatgactccacggagctcatgcctgctttttgtaagcccaccggtaacaccctgagccgtaataaagtgctttgatctcttcctttctctcttgtgatcccacctgctggttgcatgtgcaagtggcctcacttttctggcattttgaggtgtgctgtcctcttctctgcaataatcaccaagtaatacactgcttctgttatgtcatgcactttgcttttttgtttccttctctgtgtctcacctgacatatccatacctgactctcctcctggtcagggctctcctagaaagtggctatcttgggagaaataaattggacacaggtcagacaagagccacaagtatatctgctggtataaaaaagtttcctgtgacacctcgtcatgggtcagacacttaggcattaggccatcgactggataaaaaagtatcctgttaaagataaactatacgcatccatgaccacttcccctggaaccctgttagggcagggcttgaatttatagccactctccagagagagactccaacactaagaggaaaacacaccatcagagttcacaaacaagtagtaagatatgcactggagtaaaaatctgtaatatcctaatgtagatgcacatttgtaaaactgaagatcacgatgacaattccaaaaggaacttctttaccagttaattattaaataaacagattggtagtttccacaccttaaccactactggttacttgaatctaaggtaggaaaatagtgaatacaaagaagtttgaattatgaaacttatgtattatccttttccaatgcagtctgattttttgaaaactgaaaaccaaaaaactaatcttaagaagctgagtttttcgcaaagggttttctcaaatatttttcctttttttttttgaaatagagtctcactctgtcacccaggctggagtgcagtggcatgatctcagctcactgcaacctccaactcccgagttcaagtgattcttatgcctcagcctcccgagtagctgagactacaggcacttgccaccatgcatggctaatttttgtatttttagtagaggcagggtttcaccatgttggctaggctggtcttgaacttctgacttcaggtgatccgcccaccttggcctcccaaagggctgggactacaggcatcagccaccatgtctggccttcgcaagttattaagtagtatttatagggtattaaaaaacaactttgtaaatattctttattgaattagtaaaatttgatcgtagatagtgagctaacttatttggcatgctgaaggttaatggttttctttgggaaaatgtaaaacaatggaaaacaagctgcatttctagtactggtaactagaatgctgtagcactgggtaggaaggcaggtatctgaaagtttatcttactacaaatggagtaatagaagtaaaacaatctgtgtaagtttcataacatatctgattctcattttcctgatttttttccctgtaagtcacttccaactctatgtaggtcttttataagtattcctccactttgctggtactcagtttttttcttgaagattttgtaagtttaaactttattgatttgttgaagcttagctattaccatattgatattttctatggcttaaagtgcagtgagaaaaataatttagaaaacatagtgaaaatatgtgtttcaatggaaaactgccttgtctacatgcagcacattttctcaggttatctgattctagcctttccttggctttggcctattttaaactctgtaacttgtagataactggtagtaatgcatttatagacatgtatattttgccttgtccagcgaaggttcagtcatatacctctcccatgcataccattgtggaaaaactcattttgcccttatttgcacatacatttcaaaatttctaatctataaatgtgtctgttcttcagattatcttttgaagtggttatatcatctgcctgatcccctcattgattaatgcttacaattaaacttttaacgtgtttatttttatatctgtatgagtcatgattttcatttgtgaattatctttaaacaacggttagatcccttactttgattttttcacttaaatgtaactgtatcttaatatgatgaataatttataagaaacttgtaaagtttgttattcaattctaattttgacttaaaatatgatagcagtgtatatatagaattactatgattattttcctaagccacgaggcagtggcagtggcttctgtttctcttcctccctgcccttcctccttccttactttatagtataagaaattagaatagatccaaagctagagttgaatgctgaccgacttactagcctttaattcggaatatacctctgtagatagcaaatatcaaatgcatattgttctccttttccccttctacttctccagacaactgagccattttgaagtacaatgcagaaccaaatcttcagttgagaatacttattttttaacgtataatctttatatacatattctctagactgttacctgaaaaaaaagtactattttgccagtgtagtcatattattttcatgtatgtaatgtgctagcttttaagaagcatcatatagacttccagactaggtttaaaatgctaaattgcctgcctatgtgtatcatttttcacagggtgaacaaaggagataatgattcctttgacttctgacccaatgactaccactgtaggcaagaacaacgttaaacatttttgaaattttataaatgttttagtggcattacctgcagaattttattgttgtggttttttttggactactgtcttgaactgtagccatggaaaagtttccttactaaaagaaataatcaggaataaaaaaaagaaataacattgttggggagaagagaagggaattaacatttataatacttttcttgcttatttctagtgttttcaaatttcctgtggagagcaaaatacttctacattaaaaaagcttttattgtctttgttgaaaataagatacaagaagtagactttaatttgaaaaaatataatgtagtgaattagattaaaatgtttatgtatgaggaaaataggcccagcatggtggctcatgcctgtaatcataacgctttgggaggccaaggcaagaggattgcctgagcccaggagttcaagaccagtctaggcaatgtggcaaaatcctgtgtaaaccaaaagtatctgagacaggtcttaattaatttagaaagtttattttgacagagttaaggatgcgtgctcgggaggcaggagtctgtgcctttctctaaagatgattgtgagggcatcattatttaaagggtaaagggcagatattggggaaggaggaaggaatttgaaaaaggtgtgggtaggccgggcgcagtggctcacgcctgtaatctcaggactttggaaggctgaggcgggcagatcacgaggtcaggagatcgagactatcctggctaacacggtgaaaccccgtctctactaaaaatacaaaaaaattagctgggcgtggtggcgggcgcctttagtcccagctactcgggaggctgaggcaggagaatggcgtgaacctgggaggcggagcttgcagtgagccgagatcatgccactgcactccaccctgggcaacagagcaagactccgtctaaaaaaaaaaaaaatggtgtgggtagataagagacaaatggttgcattcttgagtctttgatcagactttcaccaaatacacaatttaccttgtgaggggagatagggaaatagtcacttaggcctttgtctagctcagtgaatctgcatttttccatcagaggaagcagtcagatatgcatttgtctcaggttggcacagggttgacttggagttctgtcctttgtccagtacttgtgaaagtgagctatcaatttacaatgccagggtgaaagtcaacagaataaaatgggaggcaggtttgcttgatgcagttctcagcttgacttttccctttggcttagtgatttgggggtcctgataatttatttttctttcacacccatctctacaaaatttaaaaaatcatcagcttgatgtggtggcatgtgcctgtagtcccagctactcaggggcctgaggtaggaggattgcttgagccccagaatttaaggttgcaatgagctgtgatcaccactgcactccagcctgggtgacagagcaagaccttgtctcaaaagaaaaaaaaaaaaaatgaaagtagttcattgtttataaaactgcacagtaaatgttaatttaatgaatttcattgatattttaaacattgcaaaatgattgatctgctgttcagttatttattgaattcctatattgtactatgtattttatgccacattcaataatggtagattaacttaaagtttttttctccagtgaaatagcatataacatttatgcaaaccatgctattgttaacagaaaaaccaaacactgtaaaatatttaaaaattcattctgagccaatatgagtaacaaggcccagagaacattctcaagagcttgtgagaaaatgtgcctgaggcagttgggttagttcagttttatacattttaaggagacagaaattatgggtaaaatcataaatccatacatggaagaacattggttcagcctaaagaggtgttatatcttgaagtgttacagtcataggtggattcagatattttttgattggcaattggttgaaagacttaaactttgcttaaagacttgaagtcggtagaaagaaatgcttgagttaaggtagagggagttgtggagaccaaggttcttgttcttgttatgtagatgaagcctctgggtagcagcctttggagagaaaagatggtaaatgtctcttttagaccttaaaggtgtcacattcttgtttaatcactcctaggtccaggaaagacctagaaagggaaggcctggctatatgaatggaaattctccacagttgcaaattcccccacaagggatggctttgcggggccttttcaaaatatgtcaaagaaatatattttgggataaaatatttgtatctcctttagaatctgctatctgtcatatgatactataccagagttggattggaatttggtatcttattgccacagtctgtgttgtcagccttataatctctatttcaatgttaatgctggtcagttgtgcctaaacaccaaaaggcgggggtatgaggaggcttgtccaacctctcttcccatcatggctaggaattcagtttttcaggtttctttggggccctgttggccaagagggagtccatttagttggtgggagaccttaggatttttgtttgtttgtttatgtggtaaaacattttataggcaccttttattttcagttagaaatcatttttcttctcttcacttctcatttttcctacccattttatggtatcaatgaaaaaatgttaactactaaatacagaaaattggagaaagcaaagcatgtaattcaatacaagtactcattttaaaacatatcttagtcacattgagttcaaccagttttaatctgtaaacagtttcctattattattaatttataaaacttagaaagaagcatataaatgtttgtgtaagcataaagatgtttttcctatagcatgtaacacttgaagttcctcatttgatgtatttgcaagtaaactaatttggggttattaataatcatttttatattacaaattccttaattatccaagtactgttatattgtctctgagtttgaaaagatgattccaaatcaccactgaagtaatcataccttagatctcagcaaaacatctaaatgctattgtagaggaagaaaaacttctctaccctattagattcagtagctgggatttttggactatactgacaaaaggcagattaacaggagaaagggtttatttcacatgcacatggagagggggatctcacagaaaagaagtgaaaacaccaaggaggcagttagacttgggggttatataccattttaacaaagggtgatagagataagagactacacaaagaaaaagggatttgggcttggcagggtggtaagttgtgggaaggaaatatgtgataaataagaatttttagtaagatttgttatgcagactcaggtcatctcaggagataagaattgtctctgcagttggtttcctcttcctagtatggtagaagagtacatctttacatatggaaattttctttacaaatgtaaatttcttttacaaaagggaatttatgctatgtttttagacagaaaggaggagtacagaaagtgtctatgtttgatgtttctaaattgccttcagtttaaaataattcttatgccaatgtagcatgttttagggtagtatattgtgatcccctttactatctagacatgagagaaaaaaaatctcaagttttgattgacatttcaattataaaaatacaggaaagatgaaattggtgtgtgaattttattttcgatatagtgctcattatatataaaaatactcttaattatcagtgcttacctaatttcctttaattcaaaattattttgggtaaagcaaataattatttagtaatgtaagaccataatcaattgttttctgaagatgattacttaggcagttaatggaagcagattatggacttactgtaagactattgaataaataatcagtatttgtcttggattgggaaatgtaatggattgccacaccatttgcagccaccaatctcactactgtcacacttctttatacttgtccaggattttccttgataagtagagtattttaaaaaactctcctttaacctcagtgccatataccttcaactacctgcaaagatctcatgatttgaaggaaaggtcgtgatctcttctcaaaatgttgggggaccccattctaatgtgtctcaagctttgatattaggttacacaaaagctaatcttaatttatattgttggctgggtgcagtggctcacgcctgtaatcccagcactttgggaggccgaggtgggtggatcacaaggccaggagatggagaccatcctggctaacacggtgaaaccccgtctctactaaaaatacaaaaaattagccaggcatggtggcgggcgcctgtagtcccagctactcaggaggctgaggcaggagaatggcgtgaacccaggaggcggagcttgcagtgagccgagatcaagccactgcactctagcttgggtgacagagcgagactccgtctcaaaaagaaaaaaaaaaaaaattatattgttaaaggcgatattaggtatataattaatgtacgaatacatttttctttaagagttatgatattatggtcaagattgaagttccttttatgccttttccttggccccctcaggtctgttctccacccactttccttgaggtaacaatttgaatttggtatgcatacttccagatctctatttatgccataaatacatattacgtgtgtatgtgctttttcctaaacggtgtcattctgtattgttatttcataatttatatttgtattcaatcgtttgtcttaatgattttgccatgttagtctcaatagatctacattattccttcaaactgtgtatattatttacattataaatcaggttagttattgccctattggtgtatatttaaaatatttctttttttttatgtatgtatgagtgaatgaatgaataaatgaatgacagggtcttactctgtcactcaggctgagagtgcagtgatgtgatcatggctcactgcagcctcaacctcctgggctcaggcagtcctctcatctcagcctcctgagtagctaggactacaggcatgtgccaccaccaaaaaaatatttaaaaatattttgtagagataggggtcttgctgtgttgccaggctagacttgagcttatggcctcaagcagttctcctaccttggtctctcaaagtgctgggattacaggtatgagccaccatgcctgactaacccattttaaaaatgactatgaacagtgcatatgagaacattcttattcatgttttcatgtgtacatgtgcatgtatatcttcatttagagtaaatactgagcatttcacatttttagttggaaaggacactactaaatggttcttttgagtaacattttatcatataatgctatagaaaattaattatctaagacttaaacattgaaatttcatcttcgtaagcaaaggtttattctcaagcagttgcctgaccccactctaagctctgtactaaaactagaatagccatcatctgtagctgtaggagccagctgacatattcttagtacactgagttttataagcagagaaattattatggaacaaggccaaatcaggtggaacttacctcgggaagataataaataacctgactacaacctcacagataacagaagattcatgagggataaagtattatttaagtatatgatatggtttggctgtgtcctcacccaaatcttatcttgaattgtggttcccataattcccatttgttgggcgagggacccagtgggaggtaattgaatcatgggagcagttaccttcatggagttctcgtgatagtgagtgagttctcacgagatctgatggttttataaggggcttttccctcttttgcttggcacttctccttgctactgccatgtgaagaaggacctgtttgcttccccttctgccataattgtaagtttcctgaaacctccccagccatgcggaactgtgagttaattaaacctctttcctttataaattacccagtttcatcacgtatgcctttattaacagtgtgaggatggactaataccatataattttaatgaaaagttaaaatcatgactctcctatagacatgaaaatgaacacatattaaaaatttattttactcataaaatatgagagaactaggcagatgttataatcggttgaaaggaaaactccaaaaactcttacatggagtcaaggaatattgagatgaattgcacatggagacaaaactagtttttccactcggagagagggtagggaaaaagtcagttcaaccgccaatatgcaggaaaaaatgtatctattagttacctacaacttaggcagtaccaaaatagctcagacaaaaggcactggcctagaatctgataagccagtagggtatgctatagattaggtgtccccaatccccaggccatggaccagtaccactctgtggcctgttaggaaccaggctgcacagcaggaggtgaatggtaggtgagccagcgaagcttcaactacagccgctccccattgcccacattattgcctgagctctgcctcctctcagatcagcggccatattagactcatgggaacgcgaaccctattgtgaactgcacatgcgagggacctaggttgcatgccccttatgagaatccaatgcttgatgatctgtcactgtctcccatcacccccagatggggccgtctagttgcaggaaaacaagctcagggctcctactgattctacattatggtgagtatataataataatagaaataaagtacacagtaagtgcaatgtgcttgaatcatcctgaaaccatacccccgctcctgccctggtccatggaaaaattgtcttccacaaaaccagtccctggtgccaaaaatgttggggatcaccgctatagatgatgcataattttttattgaagcacaaaagtttttctatgctgtgagtaactatatcaagtttgctgaaaacagtatcagacttgatattggcactcaagctgtatgcagaactaagggagaagatcactgaaaagataggctttgagttgctttgggaactgccatatttaaccaaattcaaatgagtcagtgtcaaatagacagagggctttttccctttttgccatttttgagtaagaatcctaattgtgccttgagccccaccacttgaacaagtaaccttgaataagttacgtaatctctccgacgctcagtttctccactaccatgattctgcaatctcactagttggtgtatacccaaaggaaatgaaattaatatgttgatgaaatatctgcactcccatgttccttgcagcattattcatagtattcaagatatggaaccaacctaagtgttcatcagtgaatgaatggataaaaaaaatgtggtgtatatatacataatggaatactgtatattccatttcagtatacaatggaatactgtttatttcaaattgaataccaaaggaagtcctgtcatttgcaacaacacggatgaacttagaggaccttatgttaagtgaaacaaagcaggcccagaaagacaaatactgcatgatctcacttgtggaatctaaacatgttgaattcgtagtagcaagaagtagaatagtggttatcggggcagagggaaggagaaggaaagaacgtggttggggtgggaattcaggagatattggttaaaggatacaaaatttcattaggttggaggaatatgttcaaaagagctgttgtacaacttagtgactatagttaataacaatgtattatatacttgaaaattgctgagggtaaattttatgtgttctaaccacaaaaaaaaaaaagtatgtgaagtaatgtgtgtgttaattagcttattttagccattccacaatatatacaaatatcaaaacatcatgccatataccataatacattcacacaccccttttatttgttagttataagtacatttgaaagaaaaggtgaattttgcccagaaaaataaagtgaggatgataatactgtttcataaagacaaagtagaataattcctattttattttgaggattcagtgatctttaaatgtaactaaaacacatagtaaatagcaagagctcaataacatagtacatggtgtcatcaaagtacctactagggaaaagcttttttgctgttcctatgaacagtcggagttggcatcttgtcattcaggactcactttaaatgtcatctcagagagagctttgctaaccacccagcttaataagtacctcagcttaataagtacctcactagtcttcccttttgttacccactcctattttcattatagtacttactcttactttctattttctttttaaagcttctttattgtctgtctgtcactattagaatgtaagttccaaaagaattttggtcttatacagtaatgtgtccctgcaggtagaacaatgcctgtcacatatttgctgttcagtgagtgtattttgaatgctgtctatcttcctgtgaaaattcctgggcatttatcttgctgggacttttcttagctatagccaacacacatgccctgataagctgtggtgagggaagagatgatgggacaacagaagggtaagagtatatggaaatgctaactgaatggagagtctggagcaagaaggagaggaatagcaggggaggatgggggagaaagctgcaattgagtgtgtcacaattgtggctatatgttttggggtgttgtattttactcttgaataaagtgaaatttttttcagctcgttaaattctagaaactaaagatagtttagtccaactacatacatagcattttataaataagaaataggtctggagagatgaagtgaccagtccaaatggcacaggtaacctgctggtagaactgggactccatactctgttatttgaattctttttttaatatatgctttactttgtcacatgcacaaaatgttgagttatgttctgcacatttgcatttttacaaatatgcctgtttttttgctttcccaataggtggaaaacagaccaaagtattatggaagagagtaagtatggattattagaaaacgttttatagattggcatatgtaagacagacagggtaaatggatgcttttaaatgaaagcaagatgaagtattcaagtttggtggagttgcatttatttcttaaaaatttcaaatgtgatctaattggtgaacaatatagacaataaagacaagtataaataagaaaatagcatgggaaaatgtacatgcaataatgttaaggatgcaaaccgtacaagtaagtagtcttagatgtatatgaggaaaatgtacatatttgtgtttttgtgtacatatatattaggtatatagatacgtatatacacacacatgtatgtacagtgggatgtgggtgatttattctatatatttttatttttcagattttcttaaatagtatgtattatctttattatgagaaaaatataataattcatgctactcagaaacaactaatgttaacaatttgaagtattaatatctgaagaaatgttttcctaatggatttgaaccaaattgagatattatacatatcattttatagcctgattgttccatttaaaattgacaatgagcatttttctgttttgtgaaaaatgcaatgatttttaaagtccttaatttttcaggttattgaaaaacagaaatgtagcactttggggaaaagaataaaaatcactcataatctcatcattcctcaaaattgtttgttttttctgactggagatcatatcagataaaagtatacattataaatatttttaaattatttaaaattctttatgttttcaagacttagaaatggattacagatgcacacctatgagttgaggaaagggtgatttcaaagttaaggttgtattgtaatttatatagtcattctgcttttggtataatagattgcttttaaaccatactattggaagtaacaccatatcatatgaaacatctcagtacgtgcggtcttgggggttagaaatttttgatcaacttgtgcaaataattttaaaattctttaaatatattgtcaagttttgtttcagaatttgttttctttagtttgattttcttttaagttaattgaattttttttttttaagatggagtttcgcttttgtcgcccaggctggagtgcaatggtgcgatctcggttcactataacctccacctcccgggttcaagcgattctcctgcctcagcctcccaggtaactgggattacaggtgcccgccactatgcctcgttaattttttgtatttttaggacagacggggtttcaccatgttggtcaggctggtcttgaactcttgacctcaggtgatccacccgtctcagcttcccaaagtgttgggattataggcgtgagccaccgcacctggactgcaatgaggttttaaaaattacaaaacctcctgggttcaggcagttctcccacctcagcctcccgagtagctgggactacaggcaactgccaccacatccagctaattctttgtgtttttagtggagatggggtttcaccatgttggccaggctagtctctaactcctgacctcagttgatccacccacctcggctttccaaagtgctggcattacaggcgtgagctactgcgcccagccagttaattgaatttttaaacagatagataactatattttaccaactgtattatttgatattatgtaaagttaaaatatataccaacgtgctaaatagcaagggataggttaccatctccttgcctgcagcagattcaaagcattagcctttggacctagttctcaaagactgggaaatttatggagataagaaattcaggagcccattgtaaacctagctgtcatgatttgaacatgcctactgtgaactgtttgaagagttaaattgagagactgaaccatccctatcaggaaaaactccagaaaatttcctcttgcccctagtaatgttcctgaattattaaggtgccatttcaacgccttttaaatgtatcattccaaattcaagtgactattgtttctttagtaccagtaaaagctgcaaaatttcttttgagcaatgagtcattgcagttattgtaggggaggaaagactttccctctaccctcctatgtttgagagctgggtctatgaaataaacaataggcagattaacaggagagaaggtatacaaatttgttaatttttaatactacttgcacaggggcatcacagaaaaaaataaagtgaatcccactccaaaaagtgagatttgagagtttgtataccatcataacaggggaatgggagggaagtttctggccatttacgggaaggtaaatgatagtttgtgaaagagtttgtatgaatgtgttgtcgacttttagtcttctctcctccgtaagagtcagtcttccccggttgctgaaactcatgggaggacattggtaacagttgagttccttttggatgatctatctttaggtagatagggagagtcagagaaagcctgtgtctgcatttgatgtttttgaagtgcctttagctcaaaatactcgatacagcaaagtggcatattttggggtgacatgtcctgaattccttcattatctttgagttatagaaggacatataggttctttgtaaattgtaaatcgctataaaaatgtgtaaggtggctttttatttttaatatgtgtcacaactgacatttttttcagtgttttatgccagattgttataggttcatctgtgtttgtgtaaagagcatgttatttgtgtttattttttctctatttttctatgttaatcaaagataaggttttagcagggaatgaaaacaagtattatagttgtttgctttggacttgagtgttcagtaatgcagattatgcacattattgggcaatcatgccaattaaggacaacccagggtcctggaaaattgccaacatagactcagccaaaattttggagcagtgctactaatgggaagaaaggaaaataggatacattttctgcgtttttttttttttcttttctttagcaagccatatggttaaatggatacgtaagaaaggaattgtcctcttgagagaggtggttgatcttcccttagatggatgtgaattttgattccatggttgttaactggattgggtagtactttggtgctgttcttatcaccacagagaagctggctgggggccaggtccagagaaacacaagcatagttaaacccaagtgcttcccttccattatgtggcagtactttgtcttgaaaacaacaagagaaggtggtggtggtgggacgttgttttatcttgttttattgaaaaatgtagaaagcacagtttctgaatagactttgtttcttaggtttcatggcatgatctccagagaagcagccgaccagctcttgattgtggctgaggggagctacctcatccgggagagccagcggcagccagggacctacactttggctttaaggttggtcatgggcctgcaattactactgtgctttatttaaaactctcttaatatagggctttaaattttaaaagcattcagcatgtaattgaattggttcttgttttcttgggatctaattaccattttaatagctttgagaccctttaaaaattcctcgtgaatggtaacactcagtaattaagaatagaaaaactttttttttttttttttttgaatggaatctcactgtgttgccaggctggagtgcagtggcacgatctcggctcactgcaaccccctctgcttccgggttcaagctattctcctgcctcagcctcccgagtagctgggattatagacgtgtgccactacgcccagctaatttttgcatttttagtagagacggggtttcaccatgttggccaggatggtctcgatctcttgacttcgtgtcacccactttggcctcccaaagtgctgggattataggcgtgaaccaccacacccggcctgaaaagcttttaaagcattttgcggtagctgcttccttccattccatcttaccccttctttcctgtttgtctagcttgtcggcttccgtcaatttcttgaataaggaaagagatcaagagaaaagatattcataactcataaagctaaagtcagtgccatttctcttaggttggcttttggttggaacagtttttcttgggagctcttggctcttccctatcagctgagcttcacttagtgttttggcttacagtacagtgcccagaaacaaatactcctgctaaccctgcaataataacccaacttgtaagaacaataatacaagagcatacttatccactggacttaccttatgccaggcctctaacctcatttaatcctcgcaacaactctatgtattgttattacccccattttacagatgaggaaacagaagacctggatggagattgagtaacttgatgaaggtcacacatttaataacttgtgctgctgctatttgaacccagattgtctgacttcggagtctttgctcttaatcattctacattgctgcctcaccaaaggcttggaatatttatccgttgtctttgttcatccctttatttgttcattcatatatacattcatctatttggaaaagacttaaaagcagagacttctgaagacagaggtcaaatatatgaaatttcttttggtagtcacaaatagaggatagaaagttgatgttaatgtttaggactaacatgtctaattccttctccaatcacttatacctgtgtgagcgagcagggcctgctctgattcctgtccacaagatttgatattaatctttctattaaatagaatgaatacaattcagtattatttcatactgaatgctgaaataattgaatacttggagaatagagcttgtcacaggagttcatggaaatttgctttttatggtaaattataaagtgtaaattccacttcaattacttaattatactgtttttttcaggtttaaattgtggtatacaggaaaaaaattctggtatggcaattcaaatacctattcaatttaccattaattgaattagaagactgatttggggcaaatcacagaatttcttgaagttggtttcttcatctttctactcctaacatattataattctagaattcttcaccaccttatttccaaatagtctggtcatctgattatctatggtaaacagccttgatgtaaatggtccagaataaggaaggaagaaggtgaggtaaaatgagaaacagaagcctctctttctttccttttggttgccatttcccctgcatttctccaggatcacttggaagttataaaactttaatttgaactcagtttttcctaactacaaaattcaagtactttcaccacattaccacattgcctgtcatcttatatctgtcacacagttttcaccagctgataccagcaaatacttgaaggctaaggatttagtttggagaaaagtagcacccagaccttcatatctctttctcattcctgccttcttgcactctcccattctactcatggctttacatttataatcacttcccatccactttggcccagtaaatcttgatggaaatgtttcaaattaatatctctggggtaacttacagtctttcttttgttactgaaaattgccataaaatcattacttggaaaagaaaaaatagtgagtaaaaaggggctgtaatggtcatagatagaggaattttactcacaatatacattgagtaatttatgtgcccaaatatgattgacattttccttgttttaaacttgatgtatggctaggaagtgttaagcaaagtctgaaatagaagttgcaccgatatatgtattattcttatctgatactcccatttcaactggtgattctcccagttcacatcaatttgtttttaacatacacgtaatccattaaggggtagccagtttgtctattttatacccatcagtgttatttatgcatttactgtgtcaactaggggctctaaaattaggaataagtccttgaacttgattcctcataggcacctcaatctcagtatatctcaaactgaactcaacacttttctcccaaatgtgctgtgatatctatatttcctttattagctggtcacattattattcagtcaattccataagacagaaactaagaaattattttcagtttttcttttaggtgtattttattgtatttgtaaggcctggcactattcatccagaggcccctaccttacattatactacacactatacttcgtatcaaatacatattttctgctgtgaaaattgtgtaaggattttatgtaaattgcttttgaaattaactttagttttataattttctttttttgtgttttggagccatacctttcttttcatatttcgtattttttatatttccgtatttttcacttttcttggaccctggcaagccctgggtgctgtacctgtatgataatgattaagaggactttttctttgttgctcatctcacacagccgaaaccaacgatcttatttcttaagtatttctcaaaattacctctccttttcaactctaagccactttctggactagttaagtaactgcctaagaaatgtctgtgggtccagccttatccttcccagtactataaatgatctgcctgaaaatctgatggtgtgatcagcaaggttgtaaggtttaagtagggcacagagtttcaaagaacacgcctccctcatgcattggcatctctcctgcacttaaaggagactagccctccactgaggatcctaatgaatgctatgaggtgctgtttaggggagtgtgtattgtatgtgtgctgtcacactaccaactttctgcagtcagaaaagaagttttcaccatgtggcatgacaggttttctatgggtgagatattttttgctcttcatttgcatcttcttccatgccccatctcagcctaaattttaggctgagccttgtctggcttttctacctatgctccatctcttgacttaggaaaaatgatttttactcagtgaaagtttgtcacacaagggaagcatatagacagacatttgcgtgttcagagtgtgtagttgaaaagaagatgctagccaggcacttggttatgactcatgaagtgtttcaaagtgattctcggattttctgtatgctgattttgacaacatttgtattcgttgtagtttaatgagatatggcgaatatcagttacaagtaacctaaaataatttaagaggtttgattgaaaacacatggctttcatcattttagaactaattatttaaaagatatgttttataagacactctagtttttctcactaaaagaaaaaaatactaggttgagtttggacattttctatgggccatttttctggtttactattcctgacttctgctgtttgtgatctgctgttagacccattcgttgagtttttaatgtcaaatactatgttatttagttccaaaattttcatttgatttttggaaatagtgaaatttaagaaggtgaaaaaccttgtggagagctaatatgagtgaatatatgaaatgatcttttaaatatttgatatctactttctctttttttttttttttttttttttttgagacggagtctcgttctgtcgcccaggcgggagtgctgtggcgcgatctccgctcactgcaagctccgcctcctgggttcacaccattctcctgcctcagcctcccgagtagctgggactacaggcgcccgccactgcgcccggctaattttgatatctactttctcattgtcaccactgtcctggataaaaacccaaacaatttatgggtataaatgcaatcataacccattcagaactaatttttttcttgctatttttatctaaacattttatttttggggggattgccataaatgccaaaaggcctttactaactcaacaaatttgtatcatttttatcctaatggctgtttacttttcctgccttaacaaaaataatgcaaataggtgaactatagcctaaaattaggatcttactattatttctcctaagtcatccatgtattgcagagtacatttgtttagactctgtccaagagttttcttggaaattaaaaaaaaaaaattctttatcaacgttggacatttaatatggcataagactaaagttatgcattaactttgacttattagtgggctgtctgtcaatgttggttccctttgacataaaatacttctttttcacaatgacttaacctgctaaatttgttcacttttactaagaaaaataaacattgtatgtatttcactaaaactatagaagaaaactggaaaaagaaacatttaaaatgttaacaacttaaacaggaacactttctatgtaatgtatagattgaaagaatagaggaaaatcagagagaataaggaattaagatttaaaaagaaaactctcagaaaataattgcagttacccattctcactgttagaactttggaaatgaagttgtagtatagactttagaattagacaaacctgagttctagtttcctgccttattttgtatatttaaccttttcaagctttagtttcctatttataaaacagggataataatcccagtatatcgcaaaagggaccctttaaaattctgttattagcagcatcccactttcaagaatcatattctttatccattgagatgctttcagccacaagtattacctgacattcaaaataagcaaactctactcacttagacataagttatttaaggtaatatctcacatactaagttcagaaatgtaataatagcatggatggtcagtattctagtgatgttatgaaggacttgtgatctttctatttgtattcatggctagtcacagcatcagcttcagtctaaggttggttttccttgtgtcaaaagatggctgccagtgcaatcagaattgtaagatttcttgtttatgcccagcaggagagtgtaagggaacctctcttctctcttgcagtatgcatcctttccttcaggttgatagggctaacatgagtctgcctttcccattcttggaccagtaacatctcggggaaatgcatgtactgattgcttgtctaacctagcatctgctcctagaacagggaaatgggtcagcttgttctggaaggtaaggctttggaaggaagaatgaatgaccaaacaaaatctggttttcttttcttgttttaagtgaaggaagaaggttggaggaagggagggaacgtgtataccagttagatagttaactatagctaagtacaggctgtacttagaaagcagtttctttattaggcagatcaacccatggtgtaatttttcaaatattttagctctggtcaatctcttactaaagttgtatgtctaattttagctttagtaaatactgtagtaagaaaaccaggtgtgagttccaaagacagttttgtgtgagggcaggtgtcaaagagttttgtaaaatatgttttgataatgttcttttgcctataatattgtagaaatttgatttgaaatgttttccaaactgactttaggtcagcattttaaaggtgatatggaaaacctaattatattaataattttagcataatgaaacccatagattttttattaatatccaaaaatatttatccctggtatgtcactaatatgtgtcaaggcattttcatggaaattggaggggcttgctcttcactgttaaattggacaattgaaataattctccagattctgaattattaaaaagagcagcatttattgagcttctatatcgtgccagatactattcaagtgggtcaagaaagaagacattgaagctagctcttaaaggtagactggcttaccaagtaaaagggtagaatatgatgaaaaacaagtattttgcgaagaagaaatggtgccggaatgtagaacagcatggagcatttcgtgtatggcagtctgctgagggactgggagtatgggaaattttagcacttagtgtgccaggagagcctagaatttcatgcttaagaatttgggctttatctgtaggaaatgggagtcattgaaggcttttagtagaagacaatagggttacatttatgatttagaaagatcattgctggaggaattagaatgctgagtggaaagggtggtaggaactatgttttaccagaattatttggataattaatttagtaagcagtttttctttgactatggagaactgatatttaaaagggcttctgtatccttacagattttaaagggttcactttgaagagaacttgttaactccaaatttggcaactccagagacatttctgttaatctgactcattttagcttctctaaattgggagaagaacaaagtgacatgtgcaagagtcttgataatccccaaaccctgtatctggatatttcagggcatatttggacatattccagagaatgccttatacctacaatacttggcactttcctgttgattttatgctgacaataacgtaagaactatttggaaaaattttagtaattgagaacaaatgataaacactgaaaaaacatgatgtttgggaaaattatattttcttttaaaaatatgtcacatttcataaattcagaaacataaaacttttatcaatctgaaaaataaaatttattatacagaatagtatgtatagtatcatactacttatataaaatttcgtacctatgggtacttaaatagaaaggtgtctaaaagaatgatcaccaaaatgtttggtgtttatctcttagtgactaacttaaacatgattgttacttctttgtattttttgagttacctgattttttttttacagtgcacatgtatcattttacaaacagaaaaaaaaaaaaaaaaccaaaagagctatttttattttgagaagaaatgaagacattagttgcaatgttgggtcaaaacaaaagataatacctcctaaatctccaaagatttgacactaaacagaatgtaacaatttatttaaataattccttggaagaaggattggtcagccctggggcaatagaaagaaaagtcatagaggcctctgttccatccaaggtctatacgggaggggagtcttgaccagcattggcagtgctgtctctggcatggagaggagaaaggagccacatgggtctgtctgccattaaacataatcaattgaattttttttccagcagtagttcccagagcctatgagtattgttaataacaaactcatttgatcatgagacccccttttcatggactttctcagtggaacacactttgagaaatgttccattcaacaattgatccctcatttcctcttgctctggacctcatgctcaccaagcagccttctgattaatgtcttcccgtgttgtctgtctacagagtgagaaaacttaaaatatataggctgagtgttcagagcctttgagttattatttctcattttcaattaacaaattaagattaaatgctgggactaccaggaggaaaagacggaagaaaatctacaaggtttcttctgtttggtaaattcagataaacatgcactccccagtcctcattttttccccccttttaaaaagacacccgtttttgatcaatgaacctaaaatgactgcttgctaaagtgttaacttgatagagaaaaaaatgttaagggttaattgcctcaccgattctttttcttcctgttttctcatttttttcctggaccaaaaaagactgccttctattcaaacagtgttatgaaacatctactgaaggcaaccaagcactgtttctatgtattataaaattgcatcttttttttcttactctgtttgcaagcatggcttttgcatgttctcatatcttacttttttaaaactgtttcttcagttatatagcatagcaattcacctgtttcaagtgtacagttcagtggtttttggtacattcacaaaattatgacataatcaattttagaacatttaatgcccctgaaaagaacctctacatctatttgccctcactttctgtttctcagctctcccagccctaggcaaccactaatctacttttgtctctattgatgtaaacaacctagacatttcatataaatgacattatatatgttcgtgactgacatttttcccttagcataatgttttcaaggtttatccatgttgtggcatgtataagtactttgttcctttttactaatgaataatattagaaaaatattccagtagttgatggacatttgagttgtttctactttttggctattatgaataatactgctgtaaataatgttattatgaataaaattgtgtgcaagtttttgtataaacatatgtttttatttcttttgggtatatacctaggagtgaagttgctgggtcgtattgtaactcaaaagtaaccttttgaggaatcatggaatggttttccaaagtggttatatcattatagtcccaccagcagtgtatgaagtttccagtttcttcacatccttttcaacacttgttatatctctttgaatatagacatcctagtatatgtgaagtgctatctcattaaagattgatttgcaccttactcttgaatggtatttcatttaaaaacatttttatctggctgggcgcggtggctcacacctgtaatcccagcactttgggaggccgaagcgggtagatcacgaggtcaggagatcgagaccatcctggctaacacggtgaaaccctgtctctactaaaaaaatacaaaaattagccgggcatggtagctgtagtcccagcttctcaggaggctgaggcaggagaatggcatgaacccgggaggtggagtttgcagtgagcctagatttcgccactgcactccagcctgggcaacagagcgagactccgtctcagagaaaaaaaaaaaaatttttttttatcctcagcatggtttttattcactagtattctgtctattcaaacttcaattctctctcaaaagtatgcatacataacagtggatttaaagtagaaggtagagaaagccaaaaagctgatttcaagatatttttggcttttgtatttttaaggcattgtataaagcaaattttattatttcatttaagggtagagttgagtttcaagtacattttggggctaatagaaacttgtacataaagaggatgactgtctctctagttatctactttgcaaagaagaactagaatctcaggtgtgtatctgctttaaggtacagtggaagacatgctagattctctttaagatctgttttttagtaactagatacagtcctagcctatgttgataatgtgattccttttctgtgaatgatttggagtcaccaaattttttttaatggacttaacagttttataaatataatattagctaacatttccaaatctttactcttccaggcattatggtaaatatgtgaattatcttttagataacccaaactttttctggcacccatacaaggtgataatgtgtggtacgttaaggtaaatgcatgagattgatcatggcccagtgtgactggctcaaggacttcaatgtatcagacactctttggcctctgaaagggctgggcaggtttgctgtcttgtaacccgtaacctctgttcttggcaacaggttggaaaattaagttttatctataaaataagaccatgtggtagatactatttttcccccattttacagaagagaaaaccaaggcttaacttgctcaagaacaaacagcaataaaactgagaaatataacttgtttaaaaacaatatctggctgggcacggtggctcatgcctgtaatcgcagcactttaggaggccaaggtgggcagatcacctgaggttgggagtttgagaccagcccgactgacatggagaaaccccgtctctactaaaagtacaaaattagccaggtgtggtggtgcatgcctgtaatcccagctacttgggaggctgaggcaggagaatcacttgaacctgggaggtggaggttgtggtgagccgagatcgcaccattgcactcaagcctgggcaatgagtgaaactccatctcaaacaaacaaacaaacaaacaaaaaattcaaaaacagtcataaaacatgcagcactttatctaagttgacaagaggtatgacacaggagtaaactcttagtttttatttttttaatttattttttattatttatttatttattttttgagacggagttttgctcttgttgctcaggctggagtgcaatggcacaatctcgtgccacaacctccacctcccgggttcaagcgattctcctgcctcagcctcccgagtagctgggactacaggcatgcaccaccatgcccagctaattttgtattttttagtagagacggggtttctccatgttggtcaggctggtctcgaactcccaaccacaggtgatccacctgcctcagcctccaaaagtgccgggattacaggcatgagccaccgtgcccagcctactcttagtttttaaatcaatgccattttagtaattaagattttaaagttatcaacacattactatttttataaacagatatacctttgtttaaagcctttaaagataaggtttattccaacttattctcaagggttaactttccacccccgtagtctcaaaagaaaaaagccaaattaagtgcatttgaagtttaataatttaaacaaaaatcccattatacgatcacttggtaattatttgtacttataaaaataattttatagtaaccttgtataacttatcaaagtaaaacagcaataattctttataaaaataagcgtatttgcatctgtgtaatttattatatttctgttataaaagcagcacatagatatggttaaaaaattttgaaataaaagtgtttagaatgataaattatagtactttcccaccgtgacatacttctagttccactccctagagataacaccattcacaattactttctatccttccagaaactggtcatgcataaaatatacttctgtttttatggcatatgtgcatattgtgttttattttaaatgaaaatcattaaggagtggctaactgtaacagcaaagatgatctctagtctttgcagaggtttgccctattgtctgcctgactatatagttgtgcaataaacagctaatgcctgacaaaagccatcattaccttgtgtatttagttttagctaattggtagtttaagatcatgttgagccagattctgtgagtttagcttcagtgcctatgaggaggttgatgatcagtgatagaatggacaacgagatagtcaaaaaggactcatctgtgttctgtaaatgtagttgttatttaatttattgtggctttgagtttagaatactgataaaattctattaagcaagggatttctgtgagagggtaatacaatctttacagttctgaagattttgtgtgaagaaactattgctgctatcttagaaaatgataaaatgcactgaagtaaaaaatgtaattttgctaatgattgaaaacacccaacaattcctaattgaatctcaaaacattaggttgacttataaagtgagcttggccaaagagttcctgagtaaagccagagaatcatagtagatactgataaaggggcttttgcagttttaaaatatgaaaattggttgaaagcatttttcatgttaaagaagaaggatcaaaaggaactggggaaggattatgctgctagtaggcgttgacgtgtaatgtactgtgtgttcttttgatctgatagctcatgataggttcagttggttaccatggtttcattccatttcctgcaaaccttcttgttgtgctatttggaataagtgaaaaataatgttctgtagaacatttttcaaaactgtttttctcctcttagtttagattatgaatcattttatgggaaaattttaagatataagagtaagtgataacacatgatgacagtaacatttagttctgcagtattagaaaattaatattgatgaaggggatagcacaatttatttaaaatataatatattatcagtgctaaaaagctttttaaaaacattgatataataattccagtttatgtgaggtacccttgctcaggtgttctttaataaaacaaaccatagaaagtaattgatgtgacacagtaggaaatggctagtttaacataaggcatcccttacttgaaaaaattgatgtgttcctgaaaatgtgttgcaaattgaactgtattgtaaaagcacaagaggagatagctgttcaaaaagattagcattttttccctgacaaatatacaatacaaaaaatattttaaaatgtaggaaaacacaaaggcaaaaagcaccccaattctactatccagaaataatcactgttaaaactgtgttgtatgaaattctagcattttcccgagttatacagaaatgactttatacaaggtacactatattatggtatgctttttttcagttagctgtgtattatgaatattttccatgttgataaatatatgagaagtttgctatttgaattaattcttcgtaaggttaagtttcacctcccctttttaaaaattctgattttcacttacatttacttatttaaatgtaggtctatcagtaactttgtttttattaccacgtgtactatatataaaatgcagaaaagtaggaaaaggaaaatattacctataatctcatggccctcaaagacaaacattattttttggcatttattaaatgtatttttgttgttctccctgttgctttgtttttagaaaattgcaatatccttctaggtgctggagatacaaggaaaaacaaaacagtcaagatccctggccttatggagcttaacagtttattaggtagagagaggattagactttaatgaattgtcccacaaatgccaagctaaaaactgaggcaaatgctgtggaaggaaagcaagggagatacgagtgcataaaggaggatctgatctaaacccagagtctcactctaaatctaaattgcaatcagggaaggcttttctgagaaaggaaagtctgatttgagaactgaagcgttgtgagagtgatctaaggaaagagagtgagtgagagggcaaagagaaagaacctagaagcccgaccagcatgtccatgcaagggctgcagtgcacatctctgaactgaaagaagagggtggccgggagcacagtgagttggagagggaagaagtgaggctgcacatctgcttcttgtaggcccggttaagaattttgctctttattctaagagctgggctgtgacataacccaagcttgaatttccttttggtttctgaagaataaacagctgaagtagatcaatagtggatgcacacaagaaagttacttgttaccttttctcttagtaacctcttcatgtccattgccctatatattttgtgtatagtatttatgcaaccatttattatatttaccatgcaagctttctctatttttgttggtctttgacataatttaatttttcctggttacacttcagtgaatctttttctaagtgaaaattttattttataaaatttattccatttttctttgccctagatagcacacctccacaagatatttgatagttactttttttttttttgagatggagtttcgctctttttgcccaggctggggtgcaatggcgcaatctcagctcactgcaacctctgcttcctgggttcaagcgattctcctgcctcaccctcccgtgtagctgggcatacaggcacctgtcaccacgcccggctaattttgtatttttagtagagacgcagtttcaccatgttggccaggttggtctcgaactcctgacctcaggtgatccacccgccttggcctcccaaagtactgggattacaggcgtgagccactgcgcctggccttgatggttacgttttaaaaatttttatgagacagggtcttgctctgttgtctagcctggagtatgatcatagctcactgtagcctggaactcctcagctgaagtgatcctcctgcctcagcctcccaagtagctaggcctacaggcacatatcaccgcacctggctaattttttcatttttatgtagagacagggtgccaccaggctggtcttgaactcctagccttctcctgaactcctggcccgagaagcaatcctcccttctccgggtcccagagtgctgtgattgtagttgtgagtcactgcccctggccttggtagttacatttactttcttctagatttcatggtgtgttaacatgtaacttgtttatccaccaataatttattttgatattcgataaatattttcccaactgtattgtatttaatactttcttcaaaatattaataggtacacagaagtaaagtagaatatatttggggattgttgcatactgtatccctgtcctggtgatatttctaaagactctgagaagttctgcagtgaaacaaaatgaacatacatatacacataaaaactgacagtttgttatttccctaacttttttgaaaacagataacactaatgcctcacagaataccatatggtataattcttaagatttgtttgctaatggctaagcagtggttccaattcaatctgggtgacctttccacccctcttcccaattttggggaattattcttaacatcttattgatgtcaactctactttggaatttgacaagctcctcaaaattgaggttacatttatttttcctgtccttaattttagtcaaaaagacatggctaagcacatagatcaggtgttggcaaactttttctgtaaaggatcctatagtaaatattttaggcattgcaggccaattgagaatattatgttatatagatgcttgtgtagccatttaaaaggtaaccactgaaaaatttaaaaccaatgtttagcttgttggtgatacaataataggcagtggcctagatttggctctagagctaaagtttggcaacccctgtctgttactgctaccatctttggcaaatctttgacctctttacacaatctagagttgacatatatactgagtcacagacacagggacaagaagatattcacaggatgtaagtgtttttattttcactttgcttttgttgttcacatgtaattgctactatttttattgctgatttttaaacttacctatactgtgactctttctaattcatatgtatcgtgtctgtcttctcctgagtgccctccttttcagttaccaaagtttttcttagactaggcttcttacagcactttttcattcaaaaagaatctactggtataaatgtatataaaaaaggaactgagaaggtaacaaggctgtgtgggggtctaggaaccaaaggagcccgtcctactgacagccaaggagttttaaagctctgtgactccctcaggattttcttggaattttctaagcaagcccaatctccataaaaataactaaaattgtactctttatttttcctatatcattgtaacagacaaacaaaagcatattttggggtggcaatactaggtaatcgggaatattttagggacttcctgtttatacatttttttagtttattaattttgttattatggtagaattcttagacaagaattttctgccactgttggggagaaagttaacataggatcaccttttaaaaaatttatagtattgtgcccagatagacatgatcttgtagaaaaaaaatcttaaaataatgaaattattctatctttgcagtagggaatgagaactggaattaggtttgactacaagtaaccggataagaagcgacaatttctttgtttttttgagacggagtctcgctctgtcgcccaggctggagtgcagtggcgcgatcttgggtcactggaacctctgcttcccgggttcaagtgattctcctgcctcagcctcctaagtagctgggactacaggtgtgcgccaccaagcccagctatttttttttttttttttcagtagagacgggatttcaccatgttggccaggatggtctcaatctcctgacctcgtgatccgcccgccttggcttcccaaagttctgggattacaggcgtgagccactgcgcctggccagaagtgacaatttcttacccaaaatagttgtttgtttttctcccatgttcaaagtattgggagtgacttcaaggctggtgtggctctccacaaggtgagaggccctgactagttccattttgttgcttttcctgtgtgtggcacccaaatttatctcgtggtagctgcaaggcaccagactttatatgcacattccagctaatgagacggcagaggggtgaagataccatttggatttattctcatttgtcactcctaccagtaaggtaaaagaagctgagaaatgtagtagttagtctagggagccatgttcatacctgaaaatcaggatgctatcactgaggaaaaagagagaaatggatattgggaggctgtcagcagtctctgcggcagaaataaaagatttctgtcagatttaggagcaagtcactcagttggagaaatactttaagtgggttctttccttctccctgcctctttttttcaccacaggcctttttttattaatagtcccagaagagaatagattgtaaatcagttctaaggaacctattctttctgtgttgtctgaactgtcttgcttagccagctttcattttcattgtgtttatttttgtgttttctatcaagttatgagtttgcttgttttcaaaataaaagtacatacatatatgggtagcttaactagctactagacgggctgatgaaactctacactgtttttttgatctactacaggaggcggggggaatactttattacatggagctaaactttggggtattttgattttttttttttttaactatcctgccaatagaacaaacacgtctaagacctatctgaaaatatatatgtttatatatacgtatatacacacacacacacacacacaagcacacagagatttattttatctgttgataattctgttgtgatcttaaggcaaatgttgatcttttgtcgtttatgctgacagccgttcaaggacaggcttctgctctgccaaaatacaaaagaataaatgcatttctcttacattataatgtgccaaacaataaaaattcagtaagtgtacacaataagatattgcttaattcaggaataatcatcttttcagtctttaaaatcagtacatttcagaaactggaacatccattttgaataagaaagagcataaggttgcaaatggttatccagcattttatacccaaattttgccagaacacacagagaatacaccaattttagaatttgccagaatctatcaatagaaggtgggaggggaaatccctttcttcctttgcttccctcctctctgtgctctttcacatttaattataagctatttcactaaatttatatatatgatttgagtgttgatatatttacagtataggtaaaaaggtaatttatatcattagataatagatgtatattatatacatatggtggtgatattcattaaccaacaaatacaaattttgaggatttgttgataaacagaattaagtacagtggtgttggaaacaggaaaactagaagcaccaacacccataaccattgaaggttaaatgttaaatgtagtcattaactgaatttactcatttactttgcagattaagaggatgaatatgatatatacaaaatgtgggcttctgtgtagtgctgtctgtgtgtctttctaaaaattgtgtaaaagcatgatgtgacaaactgagttggactgacatcatgattttcagcacaaatacatgtattggttactaaaatactttcattgaaagatatatattaagttcatatagttatctacccaattaaactgtcctctctatcccagccaaatgtcaccatatgctttttagaaaaccgtgatttaattgtgtttagattttaagaaattagcaaagctcaggaagcagtgacaggctggtaacatgccttgaaaacagtatgagataaaataggaacttgattaagaagagggaggagaatacagataaagatgtgaagcaaagaggtttgtgttttctcttttataagtgtaatctttagcatatctaatacatagagaagttaatgcgttatgtagcagtattcagttctacctcaggaatacaaaccaggctctttatactatactggggcttataatgaacatatgtagatcttatatataaaggagttttttttttaattttagatttggcctttgtgacttctcattttccaactcctataatttaaaaaaattgaagcccaaaattattaagaactttataaatgtcatataagcaaacatagatgtggatttagagtcagtataggtgttttgggtgttcttaattaattggtccaaagtcactttcctcttttatcagaaatgtttcaatgtcttgattttaatcacattcatttctctcctctgctcactgaaactgctgatgaaccttcaactctctgtgaacagttttttgtgagttgagctgaggagaaaatggaaactttccatgtataattaatacttatagtagaatctgaagggattgagatttcagaaacctactttgctatgaatagcataatttttcggatggcccattcagtttttagattaagggtaataattacttctgttgtcttgcatgaagagatatgtttggatttacagagggaagggcagttattaacttgtctcaatggattatctttttggttctgtacccctgtttttctgaacttgcttatttatcttttttaacttaataatttttaagtgcaattacagtattgttaactctatgcacattgttgtacaacagctctccagaactttttcctcttgtgtgactgaaaatctgtacccattgaacaactccccatttcccttcctcctaccccatagcagccaccattctactttttgtttgcatgattttgactgctctagatatccgtataagtggatcctttttatgattggcttattttgcttaacataatgtcctcacggttcatccgtgttgtagcatatgaaaggatttccttcattttaaaagctgaataatactccattgtgtgtgtgtgtgtgtgtgtgtgtgtatatatatatatatacacacacacacatatatatactcctatatataaccacatatgtatacacagtagtcctctcttatctgcagtgtatacattcaagaccccagtggatacctgaaactgtggatagtactaaaccctttgtgtgtgtgtgtgtgtgtgtgcgcgcgtgtgtgtgtgtatatactatgtttttccagctgataatgagctactaagtgactaacaggtgggtagcttatacaaaatggatatgctggataaagggacagttcatgtcctgggagagacagagagtgaaggggcaagatttcatcacgctattcagaatggcacgcaatgtaagacgtgtattatttatttctaaattttccatttaatattttcagaccgtggttgaccataggtaactgaaaccacagaaaacgaaaccatgtatgaggtggactactgtaccacattttctttatccactcatccatcaatagacgtcttggttgctttcacatcttggctattgtgaacaatgctgcagcgaatatgggtgtgcaagtatcttcaagatcctgttttctatccttttgaatagatatgcggaagtcggattgctgggtcataataatagttctatttttaattttgtgaggaacctccatactgtttttcatagtgtttttcaccgttttccagtctcaccaactgtacacaagcattccatttgttccacatcctcaccatttgttattttctggtttttttggtagtggtcattttaatgggcatggagtgatatctcattatggttttgatttgcatttccctgatgattagtgatgttggacatcttttcatatgcttgtttgtcatttgtatatcttctttggagaaatgtctgttcctttggccagtttttaattgggttattactactttttggttattgagttataggggttctttatatattttatatattctggatattagccccatatctgataatatggcttataaatatttcctcccattccctaggttaccttttcactctgttgattgttgccttcattgtgcagaagttttttgtgctgtcgtgccatttgtctgtttttgctcttgttacttgtgcttttggtgtcatatccaagaaattactgcccattccaatgtcatgatgtttttcccctatgttttcttctaggagttgtgttgtttcaggtcttctatttaggtctttaatccattttgagttgatgtttgtacatggtgtatacagatgattcctttgcatatagatatctagatttcccaacactgtttgttgaagagactatccttttcctgttgtgtagtcttggtactcttgttaaagatcatttgaccatacacatgacagtttatatctgagctctctgttctctttcattggtctatgtccaaaaccatacaactttgattactgtagctttgtagctttgttatatgctttgaaatgaggatatttgaggcatccagccttgtttgtctttcccaagatcgttttggccatttgtggtcttttgagatttcatatgaatttcagaatcttttttctacttctgcaaaaattctatggaggttttagtagggattgctttagtgtctagattgctttagtgtctagattgctttggatagtatggacatttttaacagtattaagttttctaacctgtaaacatgagtatcttcgcatttatttgtgtcttcttcaatttctttcagtaatgttttgtagtttttagtatacaagtcttttgccttttaagtttatttctaagtattttattctttttgatactcttgtaaatggagttgtcttcttagttaccctttcggattgttcattgttactacatagaaatatagctgatttttccatgttgatgtttgtatcctgcagttttactaaattcatttattggttctgatagttttcttgtggagtctttaaggttttctacataagagatgatgtcatctgtgaacagaggtaattttacttgttcctttgcaatttggatgcttttaatttctttttcttgcctaattgctctgccaagaacttccagtactaggttgaacagaagtggtgagagtggccatccttgccttgttcctgatcttagaggaagagctttcagtttttcagcattaaatttgatataaggtgagggctttttatctataacccttttatactgaggtaatttccttctattcccagtttgttgagtggtgttttttgttttttaaatgcaagggtgctgaatttagttagatacttttcctgcatcaattgaggtgatcatgtggtttttgcccttcattttgtcaatgtagtgtattacatttatattttgtatagtgactcattcttgcatccccggggtaaatttcacgtggtcatgttatgtatgtaattcttttaatgtgctgtttaatttggttcactaggttggtgaggatttctgtttcaatattcatcaaggatattggtctatagttttcttgtagtaatctttgtctggctttggtatcacagtaatgctagcatcataaaatgagtttggaaatattccttcctgtcttagtctgtttgtgctgctgtaacaaaatacagcagactgggtaatatatagacaattgatgtttatttctcatactactggcatctggtaaatccaagaccacggtgttagcacatttagtgtctggtgagggcccagactgtgcttccaagatggcagtctgaacactgtgttctcacattgtgaaaggaacagaagggaaaaagggccaaaccctgggtgaagcctcttttataaaggctttaattccatttacaaagtgattgtttcataaaggccccacctcttaataccactgcattggagattaagtttcaacattaattttgcaggggacacaaacattcaaataataacacttcctcttcaaatttttagaagagtttgagaaggaatggcaattattcttttttaaatgtttggtagagtttttcactgaagccatctggtcctgtccttttctttattgggaagctgttgactgctgattcgatgtccttgctagttacaggtctgttcagattttctgtttctttataattcagtcttggtaggttatatgtttatgtgaattaattcatttttaggttatccagtttgttgacatataattattcatagtaatttcttttactttttatttttgtggcatcagttgtaatatttcttgtttcacttctgattttagtctttgctatatttttcttaatggcttgtcaattttgttgatctttttaaaaaactaactcatagttggttttttttcctctgttgtttttctagtgtctattttgtttatttcagctctaatcactgctattaccttccttttgctaactttgagttttattggtcctttttttcccctagttccttgaggtgcaaaattatttgattgagatctttcttttttcatgtaggtatttaccactataaactgcctcttagttctgctcttgctgcatcccaaaagtacgttgtgtttttcttttcttttttttctttttttttttttgagatggagtctcgctctgtcacccaggctggaatgcaatggcatgatctcggctcactgcaacttccacctcccgggtttgagcaattctgtacctcagcctcctgagtagctgggattacaagtgcccaccaccaagcccagctaatttttgtatttttagtagagacagggtttcaccatcttggccaggctggtcttgaactccggacctcatgatccacccatctcagcctcccaaagtgctgggattacaggcatgagccaccgctcccggcctattttcatttgtctcaagatattttctagttttccttgtgatttcttctttgacccatagtttttccaagagtatattatttgatttccacatatttgtgaattttttagtttttcttttttctttttttttttttttttttttttttgagatggagtcttgctctgtcgcccaagctggagtgcagtggcactatctcggctcactgcaagctctgcctcccaggttcgcaccattctcctgcctcagcctcccaagtagctgggaccacaggcgcccactaccacacccggctaatttttttttttgtatttttagtagagacagggtttcaccgtgttagccctaccgtgttagtttttctactgctattgatatctggtttcacttcattgtgatcagaaaagatacttggtatgatttaagccttcttaaattttttaagacttgttttgaggcctaacacatgatctaacctggagaatattccatgtatatgtgagaagaatgtgcattcttctgctgtttggtggagtgttctgtatgtgcctattaggttcagttggggtataatgctgtttaagtcctcctattccttgttgattgtctatctggtttttctactcattattaaagtagggtattgaaatttcctgctattatgttactatgaatttctcctttcaattctgtcagtgttagctttgtatatttgggtgctctaataggtgcgtatatattttttcttcttcttcttctttttaaagatggtcttgctgtattgcccatgctggtcccgaacttctgggcttaaatgatgcttctgcctcagcctcttgagtagctgggactagggcaggtacatgctactgtagctggctaagtgcctatagccttatatttatacttactatatcttcctggtgaattgacccttttattatcatgtaatgtccttctttgcctcttgtaacagctttttacttagtaaaagtctattttccatgatacaagtatggtcacctgccttcctttggttaccatttgcatggtgtatctttgtccaccctttcactcttggcttgtgtgtttttacatctaaggtgagtcttttgtagacagtgtatagttgcattttgcttgtatatttattcagccactctctatctttcaactggagagtttaatccatttacatttaaactaattatggataatggaggacttactattgccattttgttaattgttttttgcttatcttatagctattgtctctcttctctggttgctttcatttttgtttcattgtttttttattgatatggtttgattcccttctcattttcttttgtgtatttcatatatatacatacacacacgcgtgcacacacacacacacacacatatttatttattctggttagaattcttcaagcttcttaaatttggatttctatttcatttcctcaaacttgggatatttcttcaaattagctctgctgctttttctctttctggaattcccataatgcatatattgatacactttgtagtatcccataagtcccttaggatttcttcactttttttggttcatttttctctttattctttgaggtcaataatttcaaatgacctgtctttaagtttgctgattctttcttctgctttataaagtctgctgttgaatccctttttaatccatttattgtattcttcagctatagaatttattggtttcttttttatagtttctgtgtctttgttgattttattttgtcatgcatttttttccttgatattgttcagttgcttatctgtgctgtcttgtagatcattgaatttcttttagacacttattttgaattctttttcagatatttcatagatatccatttatttgggtttagtttcaggagattaattttgttccattgattgtgctatttccttgtttcttcatatgcttataagttcattcttgtttttagctgagtgtgtttgaaaaaaaaaccaccttttccagcctttatggactggtttcatacaggagaaaacctttatgaattaacctgtgtagagattctaggggcctctaaaaccttttaggggagatgtgttttctctgggcttgtgtgtgtaatttcccagttagagagatttgctggtttctttttcaggagcttttaatctcttgctccctctggtatctgtgagtagttttgcaggttcttggtctacagcagcaagctgtcccactctcccctgaatcaagtgagacgttagtcccttgaatagcttcctgaaaagttggaacaccatattcatactccactcttctccctcccaccttttgtggattcacaccgggctgcactggcttctctgtggcaccataagacctcttttgctgctgcaaaccatccttacattaccagttccattagtgctttgagtgagtgccctgaggcaagaggaaaaacaatccttcaagaaaccctctaaaaagccaacattgcatgcatgttccactcttctccccactgctctcccccatcacccagaagctgcaagaagagcttagctgtgcagcttggggaagaggttattgtggataaagtgaaatggctcttcttacctttcaatgcacctccttctgggctttgcatttacctggagtactgcaacttcttaactggtttctgaagttctcttaaaggtattttgatttgttgatatattacccttatcttattaaatgcactgaatgtttgttttgatttgtctcccctcaaaaccccatattgccctttcttccttgagtatagtagaacagatctatgaatgcttcatgttatccccaggctacaatcgccgccttatggttcttgtcatccttccgagtgagtgtttctccctcctcttgttccccatctgctcttatttcagacaattgtgtaggttttggctcagcttctgctctcaattgtggtcattctccaagatgcagattgacctttcctgctaggactttcaaaattttgccaagggttccaataactgtttgctgccaggtttttaggttcactagaaaaagaaaaaatgtatttatgactcaagtgttttgatttttagagatggtacctaatgtacaaggttatatatttgagtctctattgaacatgtttttttcctggtgcttttgatcatatagttattaatttattttctgaaaatatcttcacatattctataaatatacctaagtgcaggcactacctatagtaaatatttataagtctatctgtctttaaaaatgaactaaggtcctccagggcagaaatgaagtcttgtacatcttggtttccttaaaccttttgcagtggttggcatatactgggcttatttagtagaattgcattgaataataaattgtcagacttagaacgcttttctgtgatacagttctttgcataaataggaaactgcagaaatctatttttcattccgtttacgactcttgtcttaggatctcttaagtagacagatattcatgatttctttgttatgttgctctaaaagatacatagcctaattatggggcttttgataatctttttggccctgtgattttaaataaatataggtggttgattattcagaaaatgccttgcagtcagacagtcctggatgcaaattcttttttacattttctatatgactttaggcaagttactttatctccctaagtttcagtttccttatctataagatgaggatgtaataatagtaatacctcctagagacactggagggattatttgagttaatacatacatagtgcctaggatataacactcaaaaagtattagatagtattattaaaataaacacagaaatacattctgtattacattttaagccttttgcttattagccattacaaatcaacaagtggtaactattgttatgttgataattctttttttcatctaataggttgattatatctgatgcctaatatcttcattagagagaaaaagctaattaaccccagaaactaagtagcaaatacaaatatggtttattgcttttccatagtcagaaatcctagtctagttgtatttaaagtctgataagaagaatcgccatcagcttaatgtaattttttatcttaaaaacttagctatccaagcacaaaagaatacatgttatgtaattccatttatataaaatagaaaattatagtaacagaagtaacagaaaacagattaagtggttaaataggacaacgccaaactgcaaaagggcatgaggaagccattggaggtattggaaatgttctgcatcttgaccatgataataatatatgccaaaactcattgaattgtgcacttgcaatggaagcagtttattctatgtaaattatacattaataaactgatttttttagtaagacatttttttctgagaaaaatgtgatactttgctgattgttaatgaacactaagtcctaaacctaaggcatgtacttgaccaaatttaggcctgtgtctgctcatttatagtagcatcctgcccatatggaaaccagactgttggcagcatcagacctccaaaacatggtcctgaagctggaaataaatgggaaatgcctaaatacccatcacaaaacccatgcctttattgcaaaagagtgctcaataatcccaatcagagtctatttaagacagttttatataaaacttaataaatccttttgtcttgtttccaagcttacagtggataaaaagcgaattggaaggagaacacagttaataacctgcaaggaggatttagaaatataaaactagatctaagaactagaagtttaataattggggtcaatttaggtaagagaaaggcaactcaatacactacaatagtctttgggatatttctgtattcaaacactaatatgttaataaacttgagtcaccaagaaaaatgttaaattgtattccacatatgatacttaggatggtgtaatttatatggaaatgattaaataaaagcattgtattgtttaacagaattaaatagggatctgaaaaacctgcatatgaatttgtgggtttgtgtttatacacacactcacacttatacatgtatagaactctataagcactcacactcatgttttactctgtgcttttgtagacttctgtcatggtgtgactttttatcctgacatagtagtaacctcatttataataagatttcaattagcttttaatgggactgatcaccaactcttgaatatgccaagtctattattcaaacatgttgattatttctaggcctactctagtttttaaatgattggaatgcatgtaaaatacttttctgtaagtacaaatataaatttatgtagtagtgggacacagtatttagtattggtcctgtggtttagtagtaaaatgaaacatagtaggtagcacaagttactataattggctcactaaattagaaaagttgtttgtaggccaggctcacgaatgtaatcccagcacttttggaggctgaggcaggcaggtcacacgaagccaggagttcaagaccagcctggccaacatggcaaaaccccaactctactaaatattagctgggcttggtggtgcacgtctgtaatcccagctactcgggattacttgaatcagggaggtggaggttgcagtgagccaagattatgccactgcactccagcctgaggtcagggagactctgtctcagaaaaaaaagaaaaattgtatatcacttatttactcccaaatgtcaatagaaaaagcagcttcatattatataggtcatcacactaagaccattatggctctgtaaatggcaaacactctatcatggtaattatcactttttaaattatgtccagcaaaactacggtaacctgattatattttggcagttatatgtaatttctctctctctatatatatatatttttttttcttttttttgagaccgagtctcgctctgtcgcccaagctggagtgcagtggcgtgatcttgactcactgcaacctctgcctcccgggttcaagcgattctcctgtctcgtcctcctgagtagctgggactacgggcgcctggctgattttttttttttttagtagagatggggtttcaccatgttagccaggatggtcttgatctcctgacctcgtgatccgcccaccttggcctcccaaagtgctgggattacaggcatgagccaccgcgcccggctaatttctgtgtattttcaaaaattctttttattgttacatatagctagctaacttaggggaaactatttatgaagtctttactaattctattccacttacttaggaggcatgatatatgccaagtactatgccagtctctggtgctttaaagtaagtaaaactaataaccgattcttaaggactcataggcaatagtgaaccattaacaattttcaagagggaaaaatcatgtgataggatccctcaaatgcataatattaattatcacagtatgtgtcccgtaattttttctgttttactggatacttaatgtgggtttggccatttatggatgttgctgccagatgtatatatatgctggtacatataatcacacacattgtctaggatattacctaggagtaggatttatatgttgtagggtatgtatatattcaactttagtaaataatacaaaacccctttgttaaacaatattgcaggtactggttatattaactgctctgtatccttgctggtacttagtattgttaggcttgttaaattttgccagtctgaggatttatttgcaattactggactattttgtgagcaccagttcttggtgtaggtctgttttcatccattgtgtaaatgtgtgttcttccattataataaaattttttgagttatcgctttgattcctttcccttccattttgtctcttctctctttctataaatgttagactttcaggccgggctcggtggctcacgcctgtaatcccagcactttgggagaccgaggtgggtggatcacgaggtcaggagatcgagaccatcctggttaacatggtgaaaccccgtctctactaaaaaaatacaaaaaaattaggcaggcatggtggcgggtgcctgtagctcccagctactcgggaggctgaggcaggagaatggcgtgaacctgggaggcggagcttgcagtgagctgagattgcaccactgcaccccagcctgggcgacagagcgagactacgtctaaaaaaaaaaaaaaaaaaaaagaagttagactttctggattgattctctatcttaattattttctctccttttttttatctttttgtctttttgttctttaaaattttctcaacttttttaaaaaaactttcatttatgctatattcctttttctacttatttttctatatattctatattccttttttttacaggattctaatgttttttggttaaattctattcaagaataggaacaggaaacatcttattttgggttttttgagcatattttcattcccatgcatgattttgtttcctctaacttgctttgattctgtttgtttatcatagtctttgtctttcatgaggggagttttcctcagatgtcaggtggcccttggctgactgctcatattgaagcatatgggaccctaaaaggctggctagtagttctgagagcttggaggaagcctgacaattataggatgatggtctctactcttaagtctttttttgttgagttgatcagatttccaagagtagaatctttcagtctcctatcaggaaaggtacaagccttccgatagcctcatggtgaagagaaatggaggtatcagtttctttagtatttaaattttgggtatttaaaactttcacttagttttcaagatgatacctctgcttgtattccctcagttcactatctccctgttttatcctgcctagaaaacagaacttaagtcttctgccatggtggtgaagggataacaatagggacaggattagggagggcaggaggaatatctaactgctttttaaacggacttcgagttaatccttctatatcagttctaccttccagagctatgtgagttccactgttcagaagatggcttctttggaagtttagttaggcaaattggatttcttcttcactgaaaatgatttatttggccaaggaaatatcattatgtgttgacataatttaatacttttctccataatccaaaattgtatagcaagatagacaaaagtcatagcctgacaaagttttggatgggatatcattttaatgttgtatataactatgctctctcttccatagccttccttagttcatagaattcatctaaatttattttgtagtacttaatcgaatgcatcatcatattttatttctgttttaaattttcttccaagagtatcttatgattgaatgaatgtatatttatatttcaccattagattagcttttttgactctggtaaacaacagacaaatatatatttatgataaataaaactgtttttgtatgttggttgctggaaatacttctaacattttattgtaagcttagacgagtgtgttgtatatgttttgttttctgtttgttaacacaaaacatctgttagcttggagctttcctttgaagagatcctttcaaatcactttggcctcaaattagaattaattcttggttttgcataaagtaaagtaaaattccgaaagctattctgtatatattttgtcatcattttttcttctagactgaattttttgtcgatatgatttatttgctgaaaaatagaaaagatggtatattaaggattttgtttatttttaaaaagatgttagaattgtatatcttgaaatgcatctgaatgcatctgggcacagcattaaacagctttttaaaataggaaacccgaaacctggaatcactggagaaagatattctttctagaaagtggcattatgtacaacagtagcagttaaaagcctttcttttctatttgtttactatagtaacactctggagaaaatgaattttcatcttgctgaactctacctaggtgagagttgggcctatgcagcttcaagtatgttcaccaaggaataaacagctattaagcaagggcagagtcagataataaaaggaaaagatgaaaagaaaattatcttataaaagtcaaagggaaatgatttagcctcaacagtttttacaaatcaatgctctgtagtctagggttcagtagctgtcactaggtccacttaatatgtcccgctttcaatatatgtaaatctctcagctttctcctttgaattcagaggcctcattcccaggacacagtggaaagaccttctttgcttgctcctcctacccgatttgcactctgttgtcttcccactctatttaaccaagtggcaaatacaaacttattcagagacatccaggagaaaatttcacaaagagctcctccttgccttttgttaactgtaaagtaaatcagtgcagagatgttcctgtacagccagtgttgccagttatttatttagccatcttccatgcatatctattgaatatttttgctgttttactttagtgttggtaactcattctgtcattctctgcaggggcctaagctaacagagaaggagaaagggaactaccactcgagcctactatatatatttagctttgacttaaatatcttcatgtaatcctcacagccatctggggtagggtgatgttattcctattttttagatgcagaatctgacgaatgatttccccaaagtcacccagctaggaagtggcagatccaggatttaaacttacaactgtctgatgccaaagcctaaggttttctcttaaacatataggacccacatttgccttcccttggccaaaccatatttcaagactacaggagaagactgcaaggatgcttttgtacttggacataagcagtagctctgagatcttatgtaagcctaattgttgtgctctgttttactaggcagtgagtttcttggttttatggtatgagggagatactggattcacttggttttgtgaatcactttacagaatctttctacataagagcaagattctatatgtatatagttattaaaatagatcaatctgaagacggacttttttttttttttttgagatggagtttcactcttgttgcccaggctggagtgcaatggtgcaatcttggctcaccacaacctccacctcccagattcaagcaattctcctgcctcagcctccggagtagctaggattacaggcatgcgctaccacgcccagctaattttgtatttttagtagagacaggtttctccatgttggttaggctggtctcaaactcccgacctcaggtgatccgcccgcctcagcctcccaaagtgctgttattacaggcgtgagccaccgcacccggcaagatagacttttttaaatttagcactttgtgtatttgtattgacctgttttatctttttaccactggggttaccaagcgataggaactctattgtgaaccacctaatacttgacagtaaagtacctggatgttttgttaactatttgttgaataaatgacagtctgcaagcagtgaacttcaaggaaagagtctttctttgaccttagatttggaatctccccctttatggctcttcttatgtagaatgggcacatccattcccacctttctcaaagattttctgtcttctttctcttcttctaatcccacaaagcacaatatgcctttcagataaagaaagtggagaaatctttgacagtctgtgctgtggtgctgttcctaggtaacttcccaagtaaaagagagtagttcagagtaggccaggaaagcttggcagttctcttagtaaaatataatgcagtttttctttaaaaagatcaatcataattccaaaatggaaattttttatttttaccctttgaagcaaagttttaatcaaaccatgttataagttttttggttatgtgatcatctccctttagactgaaagttttattggattggaagcctggagctgaagtacaggcggagcaggaattggaaattgtgggcagggtctcctgaaatcactgagttgagaaagagaaaaggataaatagggttttttgcacagctccttacaggtagccaggcctcttcttggatgaattaggcatcgtccattggaaagaactaggaagttaactctagacttcctagttcctagtcaatcaaaccattcccagtgcagccatcttcccttcatgccctgtgccccccatacttctcagatttcaaaaggcaattgagtactaaatgactgacaccattgcttggattgtttttaagttctgtatccactgtagaaatgcccactgtaaaatcgtaagtcccagcaggagtaaaatggtctgagccctcattgaaatgtgtctgatacaaccgaaatataaagggactcaatgctatgtgtgtttattattgtaggagtcttataaaagctatggagttgctttccatgttgcagataatgtatattagaaaaaaaggaaatgatgaaagcagtatattaaactgaaaaacttttatatttaactttggtgtagaaatttcacctgtctaattttttaggctttataatgaaaatatacttgggagaaatgtgtctttaacattagaggaaaatggagaacaagaaagtgtaattatatggatagttcacttaagtgtaaatcaaaatttgattgttactaaaggatggataaattatgctttagaagggccaacatggatagtacgttggattctagattaaattgttattaaagtctaatttgaactacagaaacagacatcgtctggctattattttaaaaaatattttatttcctttccatactttatttccacattaagatgttcctaactcctattcatttggaatataacctataccagaacaattttgttatataacaagtttatagtcccatttaacgctttacttaaacagcgtttattttagtattttagttcatccctgttctgttgtacttttaacaatgaaattaaatatatcctttgtgacttgtttagtttttaattagtctcactcggggttaccttcaggagaccattacactggcagctcttgttgccttgttgccttttgacatctgctttcattaaagtcagtgcattttcttgcctgtgtcttcctgcaaggacactgatgttaatcatgccaaattggatccatttctgaggtctgctgcaggaagcaaaatactgaaattatcataaaagtaaaccattattcttcagttgttagagcacatcatcagaacataaaattgaaaacagaatttctatagtccaatagcttatgacttttgtgccgtatgtatttcaaacatttcttgcacagacctaaccagcagacagaataatgactctttaaaaacgaaagaataagtccttggcctgtggccagaagtagcgaaagtgtgtttctgtgccatcctgccctgcatggctcaggtttctggagtcagctctactttaagtgattgctggcatcatattctggttagccctaaatggagctttcctattaaaatacatgactgctgaggtctaaagtacattgaatattcttattgatcaacttgaagaaaaaatgttagtatagaaatgtcatctattatggagttggccaattgaatattgactatgttttaatgtggtgtgaggtttattttctcccattttttccacaggtataataaagtggtttaaaaagataaataaaaaaaattatttctatggtaggcatgcttttgactagttgtccctaattattgcaagctcattctttgtgttcaaaggtttaattttatatattccagacgattcagagagattagccacagcttatttaaacaaagaagacacacacaaaacaaagcgatagtttttttttgtttttgtttttttttcagaaagaattcagttgcttacttttcttaaaaacatctttcccatttcattgaggcagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaagggtaagctactatgaaaccacactttatctttttctgtttggggttcttttaagaaagccattattgccagaagagattgatttatccacagtgctttggaaagtatattcatttttcttaatgtctagtttctgtgatgctgagctttgcatataactaattcttgttctattaaaatatgttaggtaaatttttatattcctggttgttttctgttttatcagtttcacaattttaaaactatgttggaaaaatggcccctaataaaaaatagttcaggggattggtcagaagcataactcctggtcaagaaaagatagctactattacgtaagtaattgagggggttgcattatctctcaaaattacttttttgttttccttaaagataatttactttataaatagttgtgttcttagcaagattttatgtgtgtgtgtatattatgtgtgtgtgtatgtatacacacacattttgggagtcagtcattcttgaataggaggaggatttatctctttataatctgttaagaagtaattgaatgagtaagattcacttttacttttccttaattataaaagacaattaattctaaaagacaatttaagttttttagctgtcatattttagttgtgatatatttcaggttaacataaaagttttaatttcttggcattaagattattttacttttgaaaattgccaccagcctcctcctcacccccaagaaaaaagtaagagattttcctgatgttttatagtgtgtgacatttagttgggggcattttaggtattgtaattggaactgtgtcaattcatttttatgtttttaagaatcttcaattgctaaaccaaagaaatgcaataggtcttgagctcggattctatgcaagatttgtgtgcaagttgtaatacctaatttgtctgtgcttttgattgtcttatttgtaaaattgtaataatggtcaaattgctgtgaggagtgagtgagatagcaagcgtaaaatgctccatcagcacttggcacatgtagacactcaatgtagtttggtggtaatgttattatatagcagccatctgacctcaaggcagcatcctcaaataacttcccattaccttagagtatttgggtacagaatggaaataagaaagtttgtgtccagctcaaattttagtttttggcagatcttacattggcattttgttgctacggagaaaacaacatttaaaaggataagctgtagaaaatgtataaaaattgtttttttatatattcatattgttaggaaccacaaatcttgtttggaagtagccagaacttaaaatccttaatacctgctgtatttaatattcttttcatggtctagttcccattttctgactattggttgattttccatttatggcattttttagtaatgcttgtatttgaataatactgacattatattctttgcagatttgctagaacattctaagtcagcatttgtgaaatgtttaaaaatgtgtacatgtgagtctttcaaaattgatcagcctagtgaaaacctttgttaatgcattctgaacgtgctttccaacaccaagggactttagctaaagacacttagctgtttaacattaggcaagtcatttgacttcaccaggccttggttgtcccccagtcaaagtggaactgatattcacagagatagtaagctgaggtagatacctagaacacccttgtagctccaggagtcatgattccctgtgtattctagcaactttctgtactgaattccctggtcttgttttgtgctggtggacagcgatagctactgagagtgaaattgctggcactgggaagtatctctctgcggcagtacataattaagaatcatttttaaaattactctttgctttaaaccgcatgcatcttaaatctagctggcttaaaatctactcactcaaaaatagatttattttatttacaggtgtcatccaacaggacagggttgatgacctgttcaacagcttgaaacgttgattccctgtcacaatggatgacatttgtaagtaaagacaatcatgtttaattgatttaaggtatctattgacactagtatggtttaataaatatttaatgggcccttaatagctaaaacccctcttgtctgtgaattctttacctcagaggccaaaagtgttggctttgcaggaattagcatgctgttgtggaaagatactagtgttggaattaagagctatgttctagttctacaagaatgaattttatatgtcactttgggcaaactgctttacttttctgaaactgtatttccctagctttctgggaaggctttggactaggtggtctccaagatgtggttcttctagtctgtgatcctttaaggagtgtaggtattgtagaagaaggacaacaatagtaccaaaaggaatacctgatatggtcctgagaagtgaggtctgcttttagtttattcaccaactaattgtatgaccttgggacagtcatctcacctgtctggacttcagtttcttcatatgagataaggcattttctacaaaacaataattatacaggattttaataaatactgcagaaagggttctatgctcaaataggtttgatgaaaatttaagtttttttaaaagtttgatcctggccgggcatggtggctcacgcctgtaatcccagcacattgggaggccaaggtggggcggatcacctgaggtcaggcattcaagacctgcctggccaacatggtgaaacctcgtctctactaaaaatacaaaaattagccgggcgtggtggcacttgcttgaaatcccagctactaggaaggctgaggcaggagaatcacctgaacccaggaggcggaggttgcaatgagcagaagtcgtgccactgcacaccagcctgggcaacaagagtgaaacttcgtctcaaaaaaaaaaaaaaaaaagaataaataaaaaataaataaaagtctgatcctttctataggccttctctgcgttattcatgacttaatatgattatgactctataagagtgctctcatacttatttgatcaccctgccattattaagaacatttttgaaaaataatgtttcatgaaacccacttcgggaaattttgaaccagataatttcctaaggtctttctttgttttaaaatagaaagatgagaattccaagtgtttttatttttttgttgcagtcctaaaggtgtaagttgtgcatctgagctttcgggaaaggcttggcaggatggtttcatggccatgaaggtttttaccatgaggagtgaatcctgaagattcttacttgtccctaggatctggtgtgaaaaatattttttttccaagtgatagctatgtcatttttctcattaactatttcagttgcttcctcagcctgaaatatcaattggaaaacactgaaatagataaaaatatttaatcatgaaattgcagcatcttgagaagccagactttcttcccttctaaaatggcttaagttagcagtccagactggccaagagcccaacttttattagttacttctttctatttatcttggaactgtatttgaatagtttggtattccaagtagtgaatacaatatgtttatgtcaacagatactggaccaatggctgaatgcaatagttttaatgataattttacacttaataatataatttcaatttccccaaaccatactttcgaaatgtctcacataattgttaataatataagctatcaaacaaatgatataatttgcatttctgaagccatactgtgagccagatctctgaatctaggcaggatgtctttactttgggattttgttatctaagatctaaatctgtcccacatgtaaggatgcctgagacatcaagggtgtacaaaatgaatttttttattttatggaactttgacacactaaataacctatgtgtgtctgtgtgtgtattttttttcttcccctctaagcttggaatgaatgcagtgcttggcacattgtcatattaatttatttttaaggaatttctttaacatttaagttccatttttgaagaattcttttgggatctccagactgtgtgttgtattgaaaagccttgtgaaattttaagttgaaatgtaattgggtccttgcccaaaactgccataactacttgaattctttggatacctccacagaatgataggagtctttgttccctggaatagcaaaaggggcatggtcagtctgctttgttaattggcttagtctctcacaaggcaagtcttctaaatgtttttactttgcttcaaatataggccattacctgtatccatgtaatctcagtgtagaaatcagcagtaaggtgatacttaatcacgaataaaggtaacagtaccagaggagtgcatggcacaaagaagtttgcagaaaactgttgatttcttaattttgtgccttcccagtcttttgggccttttttgtcattccttgttcatgctcaagctatgcttctgtttttgttcttctccctcttaaccctgccttttaaaatccacttctcgctctcccccaagtttacatgcctaagtctccaatgtggcttgttcaaggttaagatcagttgttctgggatgaacaggctcttagagattgccagttatgcccagggttactgatttgcattaaaaagccagtttagtaatttatgaggaagactacaatttctgcacagaacttctcatagtgtgtttatcctgtataaacagcctccttaagaaatcaagtaaagtcaaaaaaaaaaaaagtatatattagtctgtgtggtcttgaacaagtccttaacctccttaagtctcaagttgccccagtctctaaaatggggattatggataccattactctggtgaacaggagtattgcaaagattttgtaatgtggccttcctagtaaatgtgaagcattgcatgaagaattattgctttctgggatcagagtagtccccaaccaggtgcccattcctgggtcttagtactgtccccctagcttttgctaggaatagcatgttcagatttctctttaagatccatcttttgagtgcttgaactgctctttaagttcacaagattgttatcttgtgttaggagcaaagggctcctaattgctttatgaagaaagcagtttctcttttaataatatggtgatagctctatctctaatcaggaaacgtatgcctttgtccaataattctctaatgacttttaaggccaaaatatattattttcctgtggtatttgcattttagtatcgaacagtattttaactctcctttgcctgaatgtaagacaagtcaagctttctgcttctatgcctctcagtgaacttttattaaacctgcactccatcttgagcccattaagatctttcagattttctgtaagtctgtttaatatctttacatttcattttctaaatagtctttcatgagccatctacacaatttcttcttgatattcagaagttatgttggatccttttttgtttgaggtggggtctcacttcatcacccagacaggagtgcattgatgcaaacatggctcactgcagccttgacctcctgggctcaagcgatcctcctgccttagcctcccaaatagctgggactacaagctgtgcattaccatacctggctaatttttgtatttttttgtagagatgaggtttctccatgttgcccaagctggtctcaaactcttgagctcaagtgatctacccacctccgcctcctgaagtgctgggattacagacgtgagccacagtgcctggccttatgttggaatttaaacaagttaagagcaaggcaggaatattatctccatttcttcttcagtctcctgaactaacttatctcctatcaaaattaattgcacttaattcagcatttattgtatgcctcccatttgcaaggaaacaggctagggtctggaggaaataaaagatgttgaagatttaagccctgtctcaaagaacttacattttaatgtttcattatttctccctatttaataacacttaggcatcttgaaagcaggagacaagcttcctttatcatctgtatattatcacaggcattaaataaatactaagttggactcactttgatttgagtttgcctttatcatagcccagcagaccacagaaaacacctttgtagatgagaaaactgatttttcagaatcacgaataagaaattaatatgagattctggcattccaccgcagtttcaaggcttttttcccccagtattgtttcatttgtgactcgacaccttgagttttatatgaacagttgttgactgactacataaatgactttttaaaaatgagttcagccaaatccaaggtcctaatggaaatcactcctgagactgagaaagaaaaacagtcattcagtttgatttgctactacgtatttttcccttaaagaattcagaatccttagaatatccttgggaggtggagagggtcattcttcattctatggttaaagcatcagaggtagaaaacaattgtcttttgtgacatgaaatagttcgtgagggtggtggctagatgctcctctttagggctatgttcaaagcagccaagatggtaagtgaccaagctcatggccatcaattttgtgttgggaccatctacaccttaccagagaatcccatgctgtaatgattaaagaaaactcaaatggggcccaggaaattatttgtgtgaatctcatccatccttccatcttatcacccacagaaaagatcagtaattgaaggccattagggaaaaccagatggaaagaggaagatggaagataaacatcagttccccagttccaaagaaccaggccaacagaagaccaaattgtaattttccaagccagctgcagttttggaaggtttctgtatctgggccaactaaacaaataaaatcacttaaattactgatttaagggttagaaaagaaagctattagaaattctttcacgattgctacttcaaagtctttattttggtgaggaaataatcattgatgtcaaaatctttattcatcaaacttttcaaaaggaatcaactctggtagcttatagaagagtaacaccatttggggtacaaagcaagatgagactatcaagcagttaatctggtcttggccatgttgctcacaccctaactttgcgggcagttctaaaagaatctgctttccagttgtaaatcctcactttagaccacatactctggatctgtaattttcatcttatgcgttttgctccatcgtattttccttttttatttggaatcatttctcctttctcctagtatttgcacctctcagagattggaaaacaatagccatgcctctgagcctttacttaagttatgaaaacacatgtttttaatatggcctcataaattagtccctaactctttgggggcctctttcaaattactacaactggtcaaaaatgcttaaacgtagacattatattgcagtaacgggattctttcaacaggaaattataggcagctataatggctactaatcttatccttgtctttatgtcccttttaaagtatgctgcattattttcactgtggtttgtcagtaacttgaaggaatcagccttattatccttcatttcgttagcttctaacaccattcagtgaacattcactaaatgctgtaggtttgctgatggcttcgtttacattcttaaattttacatcttatccagtgtaaacattttagttaataatatctacattacttcatcttatacttatttactaacagtgtttagtgaaaggtcatctttactgtaaaatttccctccaaaaacaggggcttttatgcaagctgcagattgtttagcaccttcttaagagattttacacccctgttcctttcacccactaaacaggaagggatctctgttctgggtatagtttgcttattaactttagaatggctttgggctgctgcctaagttcatagtgagaaaaaagctgtagtcctcatcccttgagaaagttctgtttttatttataatgtggaaactctacaaatgagcccatgtctccatgtttccaagaatttttaaaaagataactttttaaggtataatttacatacagtaaaatgtgcacagttccatgtacagtttgatgagttttgacaactgtatgcacctgtataaccaaccctacaatcaatatatagaaactccagaaaattctctcatgccctcttgtagaaaatcttacccccacccagaccccaggatttctattaggacaagaaaaattttaaattgttgacctaacaggtgacatcttatttttagtttcttatatttgaagtactcctttctttgtttttcctctttttatttattataagcatatcatctaattatctttaatatctaccttccttaactccaattttggaatgtaaactttctcaggtcatttttcttagggaaatatgagcagcaaaggaattagaggtgtatagtagtgattacaaggcagtgtaacttgttgaagttcagtcgtatcattagggagtcttcaccttttaatcagtaataaatgcttcagtaaatttgagtacacaacaagggaggattcctgggtgcagggagaagagcctctgctctgttgggatcttggacctgagccagattcactcagccagccctcctttaatcattgactatacctttgctcttcctctctggcctgaacaggtcccccagcaggtgatactcatgatcacagttgatgggaaagtagagcatcccctgctctctgagtgtgaactctacctcatggtaccaggtaccacagtgagaaaaactatcatttctgcatttccctctcacagtctaactcaaatgggaaaattatggcagttgtatgatttcagagtttcctatggaacaccactacaacatttagatttctctccttatgctccttgaaactatgtaggtgcagcccactcaactgtcctgtagaatggagttctcctttacccattcccaggtgaagaatgacattctcttgtgtagcagcctcccatgggtggattgcgggttgtgtaaaattcctggagaaatgattataacttttctcctgttgcctttaggaaaacctattggaatgtaattgtttgaggaatgttactataggcagaaccttgacttcattctaatttcttttaaaaagattaaattatttgcatattagtttagtaactgatttcaatgcacgttgactggagtgggccctccagtgatctggacttgctctctaaggaagcagccattaggggctcagcagtctcttcttgtgacctatctttagaactctgcatggtttattggccatattctagaggtgtagtgtttcttaaggctgggagcaccgggaatctattgcagagaggagggtaccagagtaccaaagtagtagaaaattgtagaaatatttcatttgcactgactaactcatcatgttatgccaacatgtgtaggtgatatttgtgagcaagtccaattatattatctaaaactgttcttaactttcaaaacaaatcatgttgatatatctaattaataaatttaagatatttttccaagtattaaagaaatacaagctcttcataaaaaattagaaagatatgaaaaacaaagaaagaaggaaggggcttacttatagctccaccattcaaagccaactttatgttaacattttgatgagtttccttttagtctgtcttcctacgcatagattaatgtacacttttatatttttattttaagtaacccatgttcattgcttacacaaataataaaactatgagaaacaataagaatataaaaattaacccaggtcacactattgacagataatataactaataatattctgctgtttgtccttccagagttgggggcaaggaatgtttcttctatataaactactttgtaatttgctttatcgaccattaggctatgaacaatctttccatgtgaatgtatatatatatctgctttatgttttaaatgtctatattatattactttataagcagggaatttagctagtcctttaatttttttattcattcattctttcaatattcattatgtaatgaacaagaccatcatggctctgttcataaagttaatttttgtcattcacacccagaatacaaaaaaagaaacttaaatattatttgcatcatttttaaagatgaggaaattggagtagaaagagagaaactcttcttgccaggacattttgttatttagtgattggtaaccagtactctttttccctatactgtctatgtttaacaataaatcttcctgaagtaatctttttttttttttgagacagagtctcgctctgtcacctgtgcgggagtgcagtttgacacaatctcggctcactgcaacctccatctcccgagttcaggtgattctcatgcctcaagcctcccgaatagctgggactataggcgtgcaccaccacgctcagctaatttttttgtatttttagtaaagatagagtttcaccacgttgcccaggctggtctccaactcctgagttcaactgatccgcctgccttggcctcccaaagtgctaggattacaggcatgagccactgctcctggcccttaagtaatctttaaaaaaaaaaaaaaaaattaagtaaaaaaaagttgtcattttaacagtctttgtaagtttagaattttgtttagtcttgcaaaatggctttttcatttgtttccagaatatttaatgcgctaaaaagcagcatttatttataaataaggataactaataaaaatttaaatttataaattaatttctttcggagataattaaaaacgtgcaaattgtttttcttggaatagtctgtatctttaaaattataaaactatatgagagaaacatttttctgaatttgctgaatatagaaagtttgtactttagcttcatatgtaatcatagtcaagcttgtctacactttagagttgcccagttctaaattcacaaagtattttgagaggaaaggatttccataatttccatctgcagtgtgcatagaagggcttagctgaaattgttatttaaaccagaactattttgctatcttgtggctatagcattctaattaccaagtatttcaatgtgaatagtgaattccctttgtcaccttacagaaaaaacccccacaaaatgcctttccctaactaatgaatatgaaaatgcttttttttggaagcagtgttactgcaaggggatgggttttttctgtgttttatttttaaaaatcatacagacattgattataaatgtttttaatattacatcacttttgattttatacaaaaatattttaaacttttaagctcatttatttttctttagaaaaaggtacttaaacagtaatggatctttaatgttttatctggtgttaagattcctaaaagaatttctatagtcctatatgctaagtgtttggtcatagcttggagtgatccacagtatctggttctttttctgctattcttttcctcccttaatttcttaactttttgagatttgttttacataaagatccacatttactctttaaatagaaacacttcaaaagcagctttatcacatgttatgtcctgtttatccagcaattccctcacacacagaaaaataaccaactttttaatggggcatctactttgaagaagagatctggatcctagtctgtcactttagctaatgatttttgctttgagcatgtcttaataacctctctgggcctcaatagtaaaatgaaggactcagcttcatagatgaccacaaggtcccttctagctgccataattttctacccatatgttctttttgttaacctttaagaggtttttccgattaaagattctgtacttctgacaacttattccaagaggtagaataggctgaacacatacaggtttaagtatagacgtgaatacttaaatctgctactgactaggattataaatctttgagccaatcaaaccattccctttggccttagaacattgaaagtctgttctagctccctactatacatttctaaggattgtaaagcttagaattataacagaaataactaacatttattgagcatggtgtttcagaagctgtgcgaagtacttcaccaggttatctcctttaatctttaatgcagtcttttagggataggtattaacatggagatctttgggggtgataggtttatggtgaattatcaagatattctagggggctgtcttaatagtgcatcctctatttttgggagtgacatcatagaggacagccagacccttccacacaatgccccttagtatcattgtagagacttaatgttggactgaataaagactaagtagatcactatcttttaagtagttagtttaccaaaagggagtagtacctctagagctgcccaaaggaagttgaagcatggttcagatgggccattaaagaatgtcactctagaattgcaactcttatgttccgttttttaaataaactcttaccaaatgctgaaggaacgaagattccaattcattgaataagaaaacctatgatatcgaatttttaatgtagaaaaataaaatatcctttcttaaagtgtagcttagttctctcttagttgcttatgtcaaatgctgtcctctcttcatgaagtatcacacagatgtacaaattcaaataatcttgttcctttcataggaacaacaacaataaataaataaaggatttagacttagtggttgtgtaaattacacataagattgcactaattcaacaagtgcattttattttatttttatttatttatttagagacagggtctccatctgtcaacccaggctggactacagtagtgcgaccttggctcactgtagcctcaataactcctggactaaagcaatcctcctacctgagcctctgaagtactggtactacaggcatgcaccaccatgcctagctaatttttttgtagcgatggggttttgccatagtgcccaggctggtctcgaacttctgggctcaagcagtctgcccgcctcagcctcccaaagtgctgggattacaagcatgagccactgtgcccagccagaacatgtgaattttaaatagcagtatacttagtagaatgagatacaggtaaatttttaaataattgagccatattaaatgattaacctaatttatttgcatattaatgaaatctgataactaagatttataatataaggcatattgcatttattatattttagataaatcagcatacatttacgtcttcaacagttgacttaaactcagtttgacagttttaggttttcatcatttcagtcttcaaagtgcttattagcatttcattgtcaaagttgaagcatccctagctctttgaaactgacaaaagacctctgagttgacagtcacctcccaaataaacaagatttttaagatagttgaagtgctttccaaatcaatactctagagtctatatgtaacacttactgtagagagtttattattatttagaagttaaaaaaaagaaaaagaaaacagaagcaaacaaacagaaaccctctcaggtctttaacacagtttgtcagtttatcattttctatgttatctctcagaagaagagaaatcagtaacactgaaagattagcatttcataactataagaaaaaaattaaagatggtcttactaatgctagtacttatgagaaataaaataagtagaataaaactttaaatttgggggaagttctgaaacatgcagtgataaataattttttattaaagtgctgacgatcagtgttctcaccaatgaagctttctataaaattgagatatctgcagaaattttgattcagtataatcaacatggagcctaaacatctgtattaatgtatttatctttctatctacacatctatatcacatgtgtgattctgttgctcagtaaaagttacaactgatagattagatatgcggttctgaagctttttggagtcaggacccctttacactttaaaaattactgcagactttgaagagcttttgtttatgtgggttatatctgttgatatttactatattggaaattaaaatatattttataaaatatctttaagaaacaataaaaattacatgttaacaatattattaaataaccaatttttgaaacaaaaaaatttagaagagtagcagtgttttacatttctgtgaatctcttaaatgtatggcttaattttaaggaaatgaaactgggttctcataaatgcttctgtgttcagtctgtggtgataccaaactggacaagtagtaatttcttaaaggttacttgcaatgtggagtctgaaaccttattaatagccattttttactctgttacactgaaacccattggtctattgaacttcaaatggatctttcaactgtgcatgattttgaaacatcatgcattgatcacttgtaaaatattggttcactgagttacgtaggtcttccaaatgttgacatattttatacaatatcaaaaagtcacatttgttagtatcatcattgatcttaccagataactcattgaagtagtaggaagctgtcaagtttagggtggcagatacaaattttccaaaattctaattttacctgaaagttttaattttatcattgactgtcagttgtttccttgaggtagccagagcacttcattcattttatagaaaatgccaaacacccaaggctgaacaaccaaaatttgttttactcattctttcatgtaaaaaaatggtacttctgtggggaagagtgctagctcagcttactactaaaacaaagaatacttttcctcaagacaaccatctctaaagggaacccagaaatacctttcatatcttgtgatgtgaacctaactttctcttttggagaggttttcaaatgtggaagtgtaaaactctaaatttaatgtaagctacaggagaagagacaatgaaaacaaacaaaaagcctacagtaactaatttaatatgctattgttcattaaaaacagtatcatggccaggcgcagtggctcacgccagtaatcccagcactttgggaggccgaggcaggtggatcacgaggttaggagattgagaccatcctgaccaacatggtaaaaccccatctctactaaaaatacaaaaattagctgggtgtggtggcgtgtgcctgcagtcccagctactcgggaagctgaggcaggagaattgcttgaacccgggaggcggaggttgcagtgagccaagattgcgccactgtactccagcctggcgacagagcaagactccgtctcaaaaaaaaaaaaaaagtatcgttggtataacgtaatgtattaaattctatacctagtatctcaaaaaccctgaaaaatgaaaccaacaaagaaacattattcaactgaggacatggtttgatattttggcagtgaaaacaacaaaggcataccctttaagaacctttctacagctgatcctgcaggaggagatattttaggcaagttttttttaaaacaatatacttcttattttcatgtctctattagtaagacatgcattttaaaataatgaaaataattttgtaattttatagcaagttatgggtttgagttcataggaggaaaagtgatcagactttaggcttactaatgatagatactgcctaaattcccttttccttctaatattttcttggaatttattgcagagggtttttatttatccaaaaatgttcatggcactttacattattcctccagtaatagttgttttggtcctgcagattagtttaaaccacagtgattcaacaacctgtggaatagaaaactacagttcatgaatcctaaacatccttcttatttcaggtggcacatgttctctcagcacaacaattgttttcaattcaatgtctcctttagtcagctatgttgctaagatacctatgttatcaaaattttctctctaacatgtttttagttcatattctgcatacattttgactgccaaatgaagaaacaatatttaaaatgctattcttgttagcacctctgacctgccattactttttgaataacctagataaaagacaaaacatttatacatttctttgtattaaatctattctgacagtataagggcaggagactgaaatcattcagacaggcactcgtctatgagtctgaagaattcagagaggcttacgaatgtgccatgaattttgctcattcttttaacatttatttagcatctactttgtcccaagccttgtgttaagctataagactgatgctaatgatgataacagtatcaatatcagcatcaccacatagtctttgagagttttgagagctctctgcatgctgggtactaaaaatatatgccttatgtatattccatacattctacctatattatctcatccttccagtccccatgaagtataggtactatcttcattccagttttacaaataaactgagacttatctaagatcccataactagtaaatggagctaagattcttttacagctagtttttactcaagagccaagcttttaaccacttaacactgaattttaaaaattttaaatttttaaatttaaaacaatttaattttttaaatgctttatggaaggagggattaggcagattgaggaggagagtttataaactgcagctccctgtctgtattatttctgataaaaggaccgtatgagatggtcacaaactaccctgtggtttggacttcagagggctttaaaagcacatccatattggaaagagcgagaaatctgggatggagagaggtgtagaagtcatctgtgagagtgtcagaaagcccatgaggggagggagcagtttggaaggagggcatggtcatagatttcacggacaaattcaacttttgttagaaaatgtgattatgggacaaaaatacggtgcaaaaatacattattcatgcagcacttatctcaattacaatttatttattaaatatgtatttaatatttggtccttgtaaaatagtataccaccctagtctctggtatgaagctacagtttcattagtgcctagcatataatagatactcaataaaatgtatgctgagtgaaaactatttatgagcacttagtattgtacatatatactttgagcatttcagtagtttcattaaatgaatttgtgggttttatgaagtttttacactttggccatatgtctagcacccaaaaatttatttttttacattatattcttttaaagataaaatacatcctaattatataattactcactgaattaccaatctgcagtctctgttataaatttaagacttgtttaattgttttacccatgagattgaaatggctttccaccttgtaaattatgtatgtctatttggtggattttaatggaaagcttaattagctatttctaaaaacagtttaattagttgctcaagagactacgctctcatttcattggtttggaggtagttttattgatttgtttttatttaaagatcaggaaaagccagtgcaaaattaacaaaaacaaaaaggcatgctactcagtaactctgtttgaagccctgatatattatctgacaaaaaactgcatgtatctaaatgagatcaacatatcactttacctcctatcccccaccatcaaaataatggaaaagtttttttttaatgccgaggttaatcaccaaggctgaccttacttctctgtatgttgtaaaccaattgtcaggcttagaactgaattaagagtggtcattttcagttgtgagtgtttctgtttgctgatgattctgggtctttgtgacagctgagccttacttagggttaagagtcagcctgttatatccctaggtctcaggcaagcacagtagagtagagagaggatagggaagtcagaaggcctggtttccatcttggctgctttgcttactatctgccctgaacaaacaccttaacatcagtgaatttgccttttgaaaaacaagaataggaagttacaatgaaatagtatatatgacatatcactttgtggaatgtaaagctctaagtgctactgatttggggacagtgtaaaagtgtgcctggatttctttttagccgggttggcagaagactacagtaattaaaattattgtgaagtagaattagtaccggattattaaaccagttacctcacagattacttcttgatatgccacctggttatagaatcaggcctaggcctggaagaggtttctgagtcctcccttgggcacccaagcctgttctcctgaaactatgttttccctgctagttgtcaaggatatgctaaacctaaaggtgaatatgacatatcttcctagagcgttagttttactcagtagtaatggactgaaaatatttttgtattaaataagcttaggtacattctgaggagcttggagagccactcctggatctatgcacatccctagtcactgttggttgctattaggggcattttagtggacaaggtagtaatgtaccagtctcagctggccagatagcctcaaataacatttgagcttatcaacctaaaatcttcaattgctatcttactttaacctttgtttttgtttgtttggttttgtgtgtgtgtgtgtgtgtgtgtgtgtgtgtgtgtagaggaggaaatcagcatggtagatttttctcagtccattaaaatgtcactgaaagatattaatcatcctttaatcttttcttcttcctcacaagtgccacttgttgcagtctgactttctgtgtcttcctttctaacatactgaccacatgtggaccttgtacagatgcctcaaatcactcttaagatactgagttccatatgggacacagtctgtataaaaataagaacctaatgactatctcttatatgaagagcatataagttaggggttgttaagttttctattagttttattaggatcctttgaactaacaggaatttcataaatgaaatgctatggacatgatataaaaagtttgttttagaaaatgcccaaaagcaagctacttttacttttcaaacatcattatcttataaaacgtgcaataagtatagcagagtcattacaaagaaaattaaatgtatggcaggacagtggacaattaacacatctgtgatttatgcccatgcttgtacttcttcccagggtaattgtttataaacgttaaatcttttgtcttcaggccactgttgccattttcaaaataaaagcaaattttcaaaagtatgtttgaagatcacaaatctgctttataccatgaatcaatatatatctctattgaggcttaaaatgaatattttaaataaattacaattgatatattctaatcaaactgtggtttatttttgccatagaaaggaaattagcttttctaactgaagtttaaagaagtctgtaacaggccctttttaaaataaccaaatcacttaggcttcatcccagcctaatcaacagaagtcactaaaggaatgagaaaactaaaaatacaacctttagcttttgttttgatatactagattgcctccattaaattagtgagtatagagtgtttgctgagatgcaataacttgaaataacctcatatagcagtttaaaatctgaaaacactcctaataatatcaatctgagtctgccttttagttgtattttttatatgtatattatatccaaaagctttttgaaaaagtgaaaatgtttatgattcaagaattttgcactagatttaaagttccttattgttgacaaagtgttagaccttctctgatttcaccttctctattgccacagaacaataatagtgtttctttaagtcttgcaggtaataggtgtcaaaaattgggtaaaaattgacaaaaataaaaatgtaatggcacatttccccaagtatcccctcagattcatgggggttggggggaagatcaagaggaccttctcatgaagcccagtttcagcttttgattaggaagagcctaggaagaatgttgttatacaaccatcattcctggtaaccaaacattagatagtgttagattagaacattttattcttatataatttcgtttatatttatatattgttgcataattcagaataaggacatgttccgtttatagtataggttgttaccaatacatcaggaccacaatctgccaccctccaagaatttataagtgaaaaaataagactgtatcttatgaattaactttaagatcacctaagatatctgagcaatgatatgtaaaatcataaagaaataacttaaagaggggactgaaataggtagaagttgattatgccaattcaagcacagacctaaagtgaggggagacccacgaaatggacgctgagtattctagtccatcagcaaggccatcctaattgtaaaggttgttctaactctacacattaagtattcaatttatctcactctacttgctccaattccattcccaccaacttcctaattattttttgtttgcagtgtaggtgtgctaccaaaaagagcatgttggtcactactttatgatattaataactgtatctcattatattttgttataaactagacaagtgccattctgatttacctatgagtttcatgagcttggtattttttgtctccgcttaaggaatagtgctgacaaactccatttctgagcctacttgattgggtaccagccaaaagcccattgtaaatttgccagagctaccttctgaagacccacttgatacagccagcaggcctttccctcataaacatccccaaatctttcagcacatacttgtgtgctaaatgagtatgaaccttttctttccttttgcatttctattaaaaatatagagaagaccatagagctcatttagtccccaggcctgagacttagaaaagctaagtggcttgtcgaatagcagtaagaacaaggcttggaagccaggctgtgtgccattccaccccctcctccttgggcatagtgttcttcacgtagtgtgaaaaagctcccttcacagctggtgcttggagaatttctcatatttctattgtttcttgaaagaggaatgcaagggctatccttttttgtttgcattgttttcagatgtcttatgtttaaatattattgcatgtgaatcgatcagggagcaggtgaattggtcagagtatacaacatttggtagtggcagtgttagtatagtgtgatttaaatttattatatacggagatggatgcactgatgtgccttattgttatctgtttagatggatattatgttaatgctagaggagctatgtaatgaagactgagttaggaattatgatgtgattgctgccagtagcataaaaattgagtcctagcataatgttgagttttctgtgtaatataaaaatttatttatcccaacataatttaaggaatttatagagttctgatacagaagtctctaatgttagacttaaaatacatttgaaaattttgcttgattgttgaatctggtagtcaccagattcaaatacagcagtattcaaattcaaatacagcagtagtaaaaggcctagtgatctgagcggcactggaatataaatgctccagaaatttattcaaatggcaacctttcaaaatggcatgttaataacagataatatgagaggcaggatagtctagaggagagacaatttgaagtcaaatagacatggattcaagtcttactttcatcatgtactagttaggtgaccttcagcaagatacttaatttatcagagcttttgtttcttcatctataatagtgtttctttaagtctttaaagtatacaattcttaaaagtctttaagtctaagtatacaattctcatctataaaatgagaattgtaataactaccttactggttgtttgacaactaaactttatcatacatgtaaagcatttactagtaccgtgttatgcaattgtcagttaattaatggaagctgacatattattgttaagtaccttggaatatattccactcttggctctaatggagaaaaaataggttacatattataattcagggtatgcaagtaagaataatctgtgtatctaagttgagttgaatttgcttgaatccataaatgtttatgttataacttgattttggaggtttcaggaaagctgtgttgtttgtgcctcaattttaacattttatagaaattgcaggatttcactaaacctgaatgagaaactcatattacccaagagttaatccagttactcagcaccttcccaatcgtaagggtcctgccagctagaacattcctctgtggtgctttttggatggattgttgacttagctttgataactggagcattgtgctaatgattctatggtatcaccttgatgttacaaaggaggtggctttttatgttacatgaggtccttccagtgtcctagagaacattctgactataaataagtcctgacatttattagttagagaattatttctttggcttaagtctcaatcccacattaaaaactaggtatttgtggaaaagagtataattggtcatttgtactttagtgtgaattgataagaccctttcctataagcaggatttgatgggattactgagtatgagcatggatgttcttttaattataaaattgccagaaataaggtaaagtaaaaattgcataacagtgatgcttataatgtgtccctaaattattggttataatttgacctgagctcacattgcatagaacaatggccgtaggtctttaatccatatcatagtcacaaattatgctaactctgatcttggaaatgtaggtcctttgacacaaggaaagagaggcaaacttccatttattgatttcctttctgtgccagaagtaatgcaaaaatgcttcccacatagtatctcatttgattcctaataattctataccataagtattttcaattcattttacatataaagaaacaaagacagaaataaatcagttacttgaccaaggaggtgccatagccaataaatgacagagttaaggttagcacttttgtctggccccagagcccttgagtttcctattttaccacacttggtgaaaatgagacgctagctcaatgcaaatccagtatttgtggatttttgcttattggaaaaatgacagggtagtaagatcagtgggaatttatttgaaaaacagtgaatgtgttcctattcaaggtcacctatttcaccttctatttcttattcctcacactgctcctctaccccaccccttaccttttttttttcttttcagtgacataggcaatgtacattgtggcttaaaatccatgtctcttcacaaacaggtgaaaagtggttctcagtttggcactgagtaaaattgatcatagtaattataataacaaaacagtattaaaatgagaaaaatagaatatagtattttaaacactttattgtaaaatgcaaagatctgctatgaaaatttgatcatattttttgaagtattaacatagtactttacatttttatttattttttcactcaactttaattgtggatacagggcgtacatgtgcaggtttgtgacatgggtatattgcactcaggtagcgaacatagtacccaataggtagtttttagatgcatcccaccctctcccttctagtagctcacagtatctattgttcccaagtttatgttcgtgcatgctcagcatttaacttctgcatgtaagtgagaacatgcattatttgggtttctgttcctgcattcatctgtttaggattatggcctccagctctgtccatgttgctgcaaaggacatgatgttttttaatggctgcatagtataccatagtgtgtatgtaccacattttctttatccagtccaccattgatgggcacctgggttgattccgtctcttttctattgtgaatagtgttgtgatgaacatggaagtgcatgtgtctttttggtataatgatctgttttcctttgggtatatacctagtagtgggattgctgggtcgaatggtagttctgttttaaattatttgggaaatccccaaactgctttccacagtggctgagctaatttatattcccaccaacattgtataagtgttctcttttctccacagcctcatcagcatctgttgttttctgactttttaaataatagcatttctgactggtgtgagatggtatctcattttggttctgatttgcatttctctgatgattagtgatgataagcattttttcatatgtttgtcagccatttatatgtcttcctttgagaagtgtttgttcatgtcctttgcccattttttattggggttgttttttgcttgttgatttaagtttgttatagattgttatagacttcagttattcgacctttgccgggtgcatagtttgcaaatatttttcccattctgtaaattgtctgcttactctattgatagtttcttttgctgtgcacaagctcttcggttgaattaggcccacttgtccatttttgtttttgttgcagttgcttttagggattacacaaaaattctttcccaaagttgatacgaaaaagggtatttcctaggttctcctctaggatttttatagtttgagatctttaaatctttaatccatgttaagttttgtatatggtgaaaggtaaggatccaattttcattcttctgcatatgactagccagttatcccagcactatttattgaatccttttcccattacttgtttcttagggagtcctttctccattacttatttttgtcagccttgtcgaagatcagattgttttaagtgtgaggctttatttcttggtattctgctctcttccattggtctgtgtgtctgtttttgtaccagtaccttgctgtcttggttactataacgttataacttagtttgaagtcaggtagtgtgatacctccagctttgttctttttgcttaggattgctttgtctagccaggctctttttttggtttcatatgaattttagaataggtttttctaattctgtaaagaatgatgttggtaatctgacaggaatagtgttgaatctataaattgctttgggcattatggccatttttatgaattgattcttccaatctatgagcatgtgatatttttccatttatttgtgtcatctttgatttctttcagcaatgttttgtagttctccttgtagagatctttcacctccttggttagccatatccccaggtattttattttctttgtggctactttaaatgggattatgttttcgttaccggttttgtttgtttttttgagacagaatctctgtcacccaagctggagtcctgtggtgcaatctcggctcactgcaaccactgcctcccaggttcacgtgattctcctgcctcagcctcctaagtagctgaggttacaggtgcctgccaccacacccggctaatttttgtatttttttttttaatagaggaaaaaaaggggtttcatcatgttggccaggctggtctcaaactcctgacctcaagtgatcctcccacctcagccttccaaagtgctgggattacaggtgtgagccactgtgcccagatgggattatgttcttgatttgactctcagcatggacattattggtgtatagaaatgctactgatttttgtacattgattttgtaaactgaaaccttcgtaaaatcatttatcagttctggtagccttttgccagagtctaatttaaggtttcctaagtatagaatcatattgtcaatgaagagaaatagtttgacttcttcttttcctatttggattccttttatttctcttgtctgattgttctggctaggacttcctccttaccgtttttatagtcctcctctctatattgcagatagtatggacaaaggtagaaacagaggattgtggaatctgcccgttccccatcccattttccaggcctcattcagatgaacctacagaattgatatctgtgtcaagatgggcaggatcactgggtgcgatggctcacgcctataatcccagcactttgggaggctgaggccagtgaatcacttgagcccaggagttccagaccagcctgggcaacatggagaaactccatctctagaaaaaaaatacaagaattatctgggtgtagtggcatgtgcctctagtccctgctactcaggaggctgaggtgggaggatcaatggagcccaggaggttgaggctgcagtgagctctggtcacaccactgcactccagtctgggcaatagagtgagaccttgtctcaaaaaaaaggatgggcaggatcaggtcccacaacaggtcaaggattcccagtcaaaataacaaggtagatactgttaatgtttctatcaagaatgaccttgtaagatatgtgcccaaccagtttaggctcccacccagttaaactatttcttctgttttatagagccagaatatgagaggtgctatatgcttaacaccttatgtttatatactactctcataaggtagcagaaagagctgtcaggctttgaagacaaaagatggggattctgagctcagacctccacatcctgactgtgtgaccttgagcaactcactctgtgagccccagtttcctcatctataaagtgaccattatgcaacatgcttcccaggatggctgtgggtacaatagataagacagccttgggaagcatcaagcagtgttcctggatccttaacaatactgagtatctccttttcttgccactttccacttctctcctaatctgcttcctcagctggcatacatgtcattatatgccattatatgccttttaaaaattaggattagatccagagtatgggtaattgggtagagacaaaacacaatgggaagggcagtgtttccaggcatgcttatgtggtatagacctaaagcagattacagactccttgagggcagggacctgtgtcttatacttacactatatacctacagctaatattgggctcagcacccctgtaatcctgtcatttattggttactccctgcagataatcttttttgtatgtcatttctttaaacttcccagtaacctgtgagacaggtattattattcatattatgtagatgaggtaaccaagaaacaaagcagaactcccaaggtcagtattcaaacttcagtttctctgattttaaatcatattttcttcattataccacactgccccccaataaaaatagctgccttcatttggttttattttttaaccaaatatatattgaacctttttttgtgtaagctgctatgctagattcaaggtgtgtagaaatacacataaagcctaattctatttaaacagctacacagataactgatatgaggtagcatgtggcagtcccataactaatgaaccagtgaaagactgtgaggttcacaagtggatgatatcacttctaattggtgcagattatcaaagccatcacgtaggagggggtgtttgaattgagccttgaagtctgcatttcctactacatgctaaacttgagatcataagatcttggttactacatttttcttaccatccattgataattactgctagtctgtcttaccatctattcctactcctcaaaattgaaagaaggtaactagagaaaccaccttgaatagaatcagagagaagactccatggtttcctctcattttctcacctgggtggatatagtgtagtgtttatgagcccagcccccccacctactagctgtgcaactttgggaagtaaactgtaggcctcagccctctcaactataaaattaagataatttatgcctcatagggtttatctgtggattcagtgggattctatgtataaagtgcttagttgggtgtctggaatatatgtactcaataactaataagtgataaccgtaattaatagattctatatatgagtagatggctatctactagatattgtaagcatgagtgatacacatttgtctagaatgtcagactattgattatattggttctgaattttagagttatcaatttttgttatttacaagttcttcaccaaaattaatgcagaagtgcagttactgccatgttgaaggcataatagtgaccaaacccttagccatttgagagtagccaacgctgttttcatcctaagctgttgttttctatctccttactgccctaggtagctgctcagattgcagttaatccagaatttcttgactaaatagaacattactcaggaaatacagtacaatctgcagagtctacagtagaccttacctctgaatgacaaaatgtttacttttacctagctataaattttctgggtaactatcatgaatatttttatgcttgaattttagtaactatagctgtagaaccaggaatgatctataaaataggatgttgatcaaaaatactcaagaaaaagatgctactttggttacatgtgtgattgttttaacttagtaacttgatatcaaatattgttgaagaaaaaattttactgttcaacttgtgtttggagctgtttttttctggttcctactgagaattggttaaacttcactttaggctgtacatgtctaaagagtcggttggccgttatatttttagtcatcatgtgacaaaataggtccaatctgaaaagcaatttaggctaggcaaggagactttttccattgcatttcttcttgcagtgggagcattttatgtctcatattaattatctaagtatataaactcatgaaattgaaactcctatgtaaataaattttgccttttatttacttagacataattttagaaaaataaaagggactaaagactgaagtaaacaaaaataatttagggatgtttagaaaatcagtcatttgttatttttaatgtctagcatagcttaagaaccacttcatgccctaattaaagtagaatatgcactgggcacatacctcctgtagattatgaaatctgagattaaagtatttacactacaaatatactgaatccatttaaatacatagaattttagatgctttaaatacagtgtaacattggcataattggtttaacttaattattatagcatgagaaacagatgataggacgtacttagggaaccaaaatgggaaatgtaagcatcctgtagcaccttagtgaaaaaatgtaggtattgctcctaagtcaagttgtgctaagtctctcacctagccaccccgtttctacaccagcaaacaaaaagtatatgggtcctataagtagttacactataattgagatctgtgcaaataaggaattattcccaactggcttccactatgacctggcctcaagctctctgaataaaaaaaatgttgagactagagaattaaaataatggtttcttctatgtaagtgtagcccacaacaaaactactcataatacaaagacaaaactgaccactgcaagctgttagcaatgtgatgtgcatgctccttgttctgcatgaaaatagtatgatacctagttaaacttcttttatctttcatcaaaatactcaccagtttttccttgtctttaataaaattgggttttggttagctaacctcagtccataatgagcaaaggatacagattagcctttcataatttacctggcagtggtgctgcattatttttaaaacctagtgctgtatgtatgttaattttcctctgcttttaataggttaaaaaaattccattttgcaataatgcatgactcattcatttctcattaccttcccactgattttttttttttttttttttttttttttgccttgagccagcaagaaacttacttacatgagaggagggagaaacagagacagagtgagtttaggaatacagtacttaaatactgttgcttgattttcattggttatctcctttcttacggtggccaatctaatgcagccttccttgtgaaatccctcccttccccccaccttccctgctaggggcttcatagggtgtctgttgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtaagaatatttgcttttagtcttttaagaaatgcatattacttgaaatatataatattaaaggaatatcttatgtctttttaaaactaggatgacttgactaaaatgttcttgctatttaaggagtgagatgttttcagcctgattttacttgaggaatagctgaataaggctaatagaaatccaaccctgtttttctctaatgctgttctaatattgttttatcaatgtgtactcactggtaaaagtcttgactgatatttaaaaggtctcagttaatgatgattttggcattgtttttatttgtgatacaaatgtgtctgaatacctctgttggagattttatgagaggattagatctgtgtttctggtaaaaagctttggatataagaggcatgtgctgttgcatctggattgagcagatggtttgcatttctcatagtttctgtcttttctcccctgttaatgaattgaccatgatgaaaggaggatggctaccatgggactgttgatgctgctgacactagcagcttctcctcactttttgagtatttgctttcaccatgtatgcgtatgtgtagtttttaattattgtgttaatgtggtttatcaactgtacttgaattttctttcaaggtgatatgtgtgttgattcaagctgtatgtagatctagtctgtatttatagcatgatataaggccttgaatttctgtcctttgcaatctaattcagagattaaacaacgtgaggtggtgcataagtagacccagttacatttaataggtagatgcactggcatttctatagtaacttcccaatagttagacaactttgtgatgcggttcttgagacatgaatgttcttagtttagacaaagtatcattaggttttattttagaaagggaataatttggtttcaaaatgtgataaagctggaaatcatgatctttcatttatttatttattcaacatttattcagcacctataatgcaccaggctctgaaatagataatttcattccacatttgcaatttattctgatttttaacaccagtatttattttactcaaacactaaataccaacacccccccccccacccatatgctctgcattttccatagtgaggaataggtttttgtgatcttcagatcattttgggatgaaggagaaattacctaataaaattatgtttcttaaatatgtgggctatgtaaaaattgctaatattttaaaataaactaaataacgttttcttcttcctctttaaacatattaaggaccttacctttcaaccaatatcttgatttaaaatgaaatagaggcaacttagtagattaaataccggatagaaaagaggtatcatatgtgtatctagcattcactacatctttcatttaggaacctaagcaatacattcaggcttctaggcctcagtttctttttgcatgatatacaacctgatctaacaggatttttatcaggaaaatgaccccaaataaatccttttgccaatatgaagttatgtcaaaaaagaagtctttgggttactaataaagaggaaattgtatgtacactgtttagaaatagctgagatcttaaatatatctccaaagatgtactctgatttgttcagcaaaaacagcaaaaacctactaagaatgccatttgagtgctaggtcaagttcattatacatgctttttatcaatattgattaagagcaactaggaggtctattcaagaatttgcataaacaaactctttttgtgtttgtatcttccagttgtttctcaattttaacacatggctttaatgaataaattctacacagctggaaagttctgactctgccatcaactgtaactcttaccttggtatctaaactgctttaaagatacttgggtgttttttttaagccttaaaaaatggaaagcttcttccttctctggagctgaaaaataatgaaaaccagcttggacttgttcttagagtatttatgctcaagaaagagttcattttagacaatgagttgcattacatattatttagagttgctaataaggtcagaaatctcggaattgactctttccattgaagttactctctgttatttaaaaatgtttctgtggggtggcactataaaaaataagaaaggaggaaagtcatacttgacttccaagaacatcccagactctgtggcaggtgcagttctctcccacacagacgctcgcttagaaggtcactgattgtgatatacacatctatgtatgtacagttcagaaatttgtgtggggaaaaaccgtagcatttccatgacgataatcattcatgtatccttgtcattatggtggtaaaagtgtattctgtataaccacgggcccactcaccaaagcctcatttcaaggtggttttcttttttgcttcttgaactgccttgttatgtaatactgctctgtggaatcgaacagctgtcaaaccttatttcagggagtgaagccaagaatgccttctacctttggtgaaagcactcactgaggtgaaagccaaataaaccaactggacctaacttcagcctacagacaggcgtttgtttttggggtttggggtttttttagtagaataaaacaggaaggcttcccttttgctatgttatgtaacatggtctctttttttttttttctattgttacttataaggatttgagaaagcatctatcacaagaaggatagttatatcccttagggaggttattttacagataaatgcaccaaatcctctaaaaactattacactataagttatctaaatcaattagaaaataattgtaattgtcccctggatcaacctcttattttaagagctacctcatcctaatacaacatacaacacacacacacacacacagagaaagagagagaacaaaacaaactctaacattaaaaataaaactcaggcacccttccagcaatgattgtgccatgcattctgaggctttctgggtaaaatgataaataagatccagcctttgccctcaggagcttgcttattatatgcaccaccttgggtcaattgcttaatctctctctacatcggaaaaattgagttcccagtacatgtagatacatggtagccactatttttgttactacaaatacccctaagtgggtttttttttttttctgaatctatactgacatttatttatacttaagggttcatctgaatcctcttattcctgtccagttgcagagattatgatgtgattgaaaaccttagcatgatcgtggggactgtgcctagttgtcaggcagagttagatgttgcataagaatagctacatttggccaggcacagtggctcatgcctgtaatcccagcactttgggaggccgaggtgggcagatcgaaaggtcaggagattgagaacatcttagccaatatggggaaaccctgtctctactaaaaatacaaaattagccgggtgtggtggcacgtgactgtagtcccagctcctctggaggctgaggcaggacaatcgcttgaacccaggaggcagaggttgcagtgagccgagatcacatcactgaactccagcctgggcaacaacagcaaaactccgtctcaaaaataaataaataaataaataaataataaaagctacatttttcatgcactacagaatgcagtgaaatcctctatatttattttactcttttcaaattaaactgttaaatgtttcatctggtttgttgcttaattcagatagctctataaaataaaatcaagagcagatacaatattataataacgacagaagctaggctacttaggcaaattaagtaattaaaagaaaacaacattaagaattatagggagtagatactaaaaatatgagtttaattttttaaggtagtcttgaattagttgttgattttcatttcaggtacttgcagtctgcatgtaaatgaaagatataagatattgtattaatagatttagtgttgccaagataacaggcaaacagtgaatcctgaaatgtgaattgatattgcaattaaaataacactgtaacatgaaccttataatagttaataaaattactgattcaagacctactaggaaaaagagatcatactgaacccagcaatcctagccaacagactggacactgtgctgtctggtgaactgaagggcggcagtggccgacactcttgctgagggtagtctttcctttcctcccgaggacgtgggcaaatccaagccccctttggtcttcatttggttcacatttataataaaattaatacaaaatgaatgaacaaataataattttaatataaactgtgaagttttaaaccacatggtctaagggttctcttacagctctaaaattctcggacttaattatagtgtattgtgaaccattagatttattacaagtattccatttttcattaaaattttattgaagttcctatggagacaaattttcaatacgttgatttgaaaaggaactaaaattaactatatatgaaagaatatttaaaactttatattaacagcagtgaaatgtcgtattcagaaacagtgtctatcacctctttcatattatccccaccaaccctcacaccaccaccttgcctccctccattcttccttgccctttcccgatgtctagtaaaatgcctgtaactagcagatgctcaagaagcatttgataaatgactaaatgagtacacagtgtgacatgcgggggacctttggttgttgttacttgaaaacctcttctcatgacagcaggaaattaacacaaaaatagagtcttctattggtcttaagatctgtattgttacaatgttttcttttaattagatttatgtgagttttcaaaatgaaataaaacccaagataccatcatgttatctgatattgactagagaatctgtgtacatattttaaatgctcaggaatttgaatagtgttttgaattaatggtattgtaaatgaaggtaaatgcaatattacaaaagggaaatgacaatctagaatgcttcattatgcttctgcaataatgtctctcatcattgcctcttctgtggatatgaacaaggagtgtccaacataaacattttaaaggaataatgtgaattattcctttaaataattttacttggaaatttaaataattttaaataatttcttacttggaatttctccaagaaagaaattaagtggaattatatgtatttctgttgtacacatgcacacacacacactctttccccagttctcaatgtgggccacttgcaagagaagacaaaaatagcgcagatcagtatgtagcataggttctgtctgcctaaggcaatcggacatgtagaggactgatgaagagaaactaggaaattggtcagaatcatctttaaagtccctgtaaacattgtatttctgttgctgcctattatagtacatatctgatgctgcagaagccaaaaatgacagccactgctctgctttccacttctgccaatgctgctggtgaggaggaccacagaacctgtgcactgcccctcagcacggtggccctctcaacctcaccctgcctggccttatggtttgtcatgctggctggggaactggtatgacaccccgagtacaagtcattcagatccttaaggttatcagaaaggttactacctgccactaataatccgaaaagaaacatttcacaaagttcttgttggtttgcacatagttgcatatacttctttgtagctatcttatgggactagagaatttaaattgctatacttcagagaaacccatattattctcacagaccatggccctttattctggagatgttttataatctgtctttattccccaagttccaaatttggcatctctgtattatactgcctcgctgacacaaattacttatcagtatgttttttgtctcttccattcaagctttctactatatcttttttaaatgttttaaatgaggaagacatgttttgtcttcctcattcctttctagcctcttgttccatgtccatgtgggcccctgaaaagattggctctttcaatatatgtatgaaaaattgctgttgaacatactaactcaatcttttcaaagaaaaatcccttaacagtgtcgaaacatcttgcccacagtattctctaacctaaaataaaactctccaggctttcctagctccgtttcctccttgctcatccctcaagtatttatcaagcagctgttgtgtgcagaccactctgttagacatgggaggagacacagtaatatgtaatgtacggtccttgactgctggatatatgcaaactgactgaaaagaaagcaaatgtcaatataatgagaatgatgagaaggtcataggaagggtttggggccaggcacagtggctcatgcctgtaatccctacactttgggaggccaagtcaggaggattgcttgagcccaggagtttaagaccagcctgggcaacatagagagaccttgtctttacaaaaaatttaaaacattagctgggtatgatattgtgcacctgtggtttcagctacttaggaggctgaggtgagatcacttgagccaggagatagaggttgcagtgagctgtgaacacaccactgcactccagcctgggagacagagcaggaccccatctcaaaaaaaaaaaaaaaaaaaaaaaaagaatggttttatgcataaacactggcaaaatacctttaattttatgtgccacatatgtataataatgccatattcctcatggttcaatatttcatatacaaatacaaatgacatctctgcctgaaacagaatgacagtcagaagtgagtatgcagagtaaaattcgacagagggtagtttaaactttggagagagatttttttttgtgtgtgataagaacatgtcacatgagatctaccctcttaaatatttaagtaaggccaggtgcagtggcttatgcctataatcccagcactttgagaggctgagataggcagatcacttgagcctaggagtttgagaccagcttaggcaacatggcaaaactctgtttctatcaaaaatacaaaacttagctgggcgtggtggcacatgcctgtagtcctagctactcaaaaggctgaggtgagaggatcactggggcccaggaaatcgaggctgctgtgagctgtgattgtgccactgcaatatggcctggacgatagagcaagaccctatgtcaaaaaaaaaaaaaaaaatctttaagtgcacaacacagtattgttaagtaaaggcatcgtgttgctcacaagtttctagaagatactcaatctattataactgaaactttatatgcattgaacagcagccactcttctattctgagtttgattattatagatacctcatataagtggaatcatgcaatatttgtccttctgtgactgacttatttcacttaacatcatgtcctccaggttcatctcatggtgtcatatacggcaggatttcctttattaaggctgaataaatattctattgtatatatataccatactttctttaaggatataaacgcataggaaaaacacgcaatttttaaaagtcacctcttacagttaataacaatgtataagaatacattgagaataaaatctctctgagagtagattttaagtgttctcactacaaaaaatatgtgaggtaatgcttacattaattagctcaatttagccatttcacaatgtatttgcatttcaaaacatgttgtacacagtaaatataatttttatttatcaattaaaaatgaaataattgtcacttcttctaaatttttttttttttttaagacagagtctcactctgtcgccgaggctggagtgcagtggcacaatctcagctcactgcaacttccgcctcctgggttcaagctattctcctgtctcagcctccctagtagctgggattacaggtgcccaccaccaaacacacaccacatttttgtgtttttaatagagatggggtttcgccatgttggtcaggctggtcttgaactcctgacctcaggtgatctgcccacctcagcctcccaaagtgctgggattacaggcatgaaccactgcacctggcctgtaaaattcttaatatttcagtttacatgttcatacaacagtccaaccttcaggagttggtttttcccccgtttgagacatgttggtactctaaagccccttctcgtaatctcttctatcttatattcactcaccccttccagatttaactgaggattgggtcttaattctcttttgcttattttgtaagttaataggagaaataccatatgtaatatttcatgtctctgtgtttcaagccttgtttaactgacaaaatgtgctatcatacttcatcttttttgtgacccactgtgtcaacattccctataggacaaagtcttattaagagtgaggtttggctgggcgcagtggctcattcctgtaatcccagcactttgggaggccgaggtgggtggatcacctgaggtcaggagttcaagaccagcctgaccaacatggagaaaccttgtctctactaaaaatacaaaattagccgggcgtgatggtgcatgcctgtaatcccagctacttgggaggctgaggcagaagaattgcttaaacctgggaggcggaggttgcaatgagccaagatcgtgccattgcactccagcctgggcaacaagagcaaactccatctcaaaaaagaaaaaaaaaagagtgaggtttaccatgactgttagtaggacggttaaagcatgtacctaaagaatacgtacatgtcttatcatcttgcttcaattattgtctatgttgtcaagtactccatatctcagtaaacttagtatcattagttggtgttcatcatttgttatgtaatagtgcatgacacaaaaatattgttgcctccatcaaatagcccaaaggatagaaagtagaaaaagagatgtgtatatacaccaaaggaagtggaatataggttaaaaaataaatgaaaacgtgacaagcaatggtttttctttttaaatatttttactacacaaaaacttctggtagctgaaaaccactgtaaattatttttttgacaagcaacatactaatagatttttttttccagttttctaatccctcttcttaaattatcttgagattcttctggttacaaaataggaaaactataaaggaaaaggccagtagcccaacagttgaagaaccaccatatcatcagctgcttattttctatatttttatgttctttggggagcaaaaatagaactggcgtgttttgtaaggtattatccagacttaaaaattaaaagaacacatctatttttaggtcatggtagtcagaggcttgttgtcacattaggtgatatcctccagtcttttgtattagaggtgacgttttggctatccatgtgaatggatttgcccaaatcaggcctaaaatatcatattctctgtttctctttttagaactacctttgtttggagcttcacctcttgcatgtgacacaaccctgatctctgcttgtgctctgcctggtacacatgcccttgttcttaaagagaagtccatctctagggggtgtgctaatttgctttgatggttgctgttacagctcattactccgcaattgtattacttcagtgtgtttttcttaatctgttaccatgaatatatttactatttgatggaacagttgagagacttttactgcaagtgtcagaaaacccagcccacactggactaagaaaaaagggaatttgttgtgtcacatagtagaaaaagtccagcattaattgaaggtatcctttgacttaggggcttaaaatgccaccagaaccctgtttcccaactctttcttcatttttaggctccctctggtgacaagatgactgtcaaagtcttcagctctgtatcctcccagattctagtcagcctcaaagacagactgtttgaaaaaaggttctgggcatggcagtcattgaccaattatatcatatgctcatctctgcaccagtagctccagtcaggagaagggaatgtactggcttagatccaggtcttcccctggagctggggaagaggtcagctctatacgattcacatggattgggagcttttatgaaaaataagaacttgttctgtgtactgaaaaataagcagtgccctctacaagattaaatgtcaaatgaaatcacctattgcaagatcttagtgaacagcctactgaatatgacagtgttaatgtaacactttgctgggtgagatgtgctcatgaaacatggatgacaaaagaatcctgaagcagttcagtctgtataaagggggttgaaaattactgattaagttaatcttattttacatgtgtagaaactgaagcctattaaagtcactggttggtgttcacatgaacgaatcagtagaaccaataatataaactaaatttctacttttggtcatgatggaagaactacatttaccttcccatcttaaacaactagcaaaccagaaaaagtatataaaaaccacagccagacattgatcaataggtagtatagaactgtgacaactgaaagaaggaacacaaacaaaatgattcttaagatcactcttactgcttggaggcagtttccaggccacagcacatggagggggagtccaagcagagtcttgtggtctaccccagtgaaggacaaagagattagggtggggtcgtgggggaggtgcaaagcagctcaaatgtatggggcagagactgcctgaggagacagagctgcacacaaaaggcattctggagatctgccgaggagccttcttgagtcttttactgatgacttatctgcatatatgtgggaagaaactattgggaaaccaccagaaagcaataggctaaacaatggctgaaactcactgaagactcattctgcccactagtagaaacagaaagaagtcacaacacatggagcattggttaagactcttcaagagggtatcatcttagtactgtgaccaaaattaacagtagactaaaggttgtagtgaggaaagaaatggaagctgtctttaaaaatccaaattgaatctctagaggtgaaaagtatatctgaaatgaaaaatacactggattatattaacagcatattagataccacagaagaaaagattggtaaaccagaaaatacaatacaaaatatccaagatgaagaacagagaattaaaaaaaaaaaaaaaatgaacacaacatcagtgaccagtgggacaatagcaagcagtcttaacataagtgtaatttgggtcacagaaggaacagtgatgggaaaccaggagacagagcaattatttaaagctatagtgaccaaaaattgtataaatttgatgaaaagtcacagatccaaaaatgcagtgaacactaaacactaaacagaaaaaaatatggtgaaagcaacatcaaggcatatcataaattgctgaaaaccagtgttaaggagaaaattgtaaaagcagccagagagagtgagaaaatttggggaaagaacagttttcactgtaaagtgataccgaaggcccctggcttacaatggctcagcttatgatttttgaccttatgatggtctgaaagcaatattcattcagtacagtcctggatttaggattggattacatctggataaattcatcataaattgaaaatatcaaaagtagaaaccccactctcaacttatgatattttcaacttatggtgggtttattgacatgtaaccccatcataagtcaaggagaatccatactttgcctcagcctaagaattgaggttgttcatcccacacgtaatgtacagaggatgtctctcagatctagaaattatacatacgtttggtttctcttaagttttattttcacatttcagcttcataatgtgtttatagttttgtggttttatagaatcttaaatgtgcatactcacactcaagaatacaatgcacatttgtttaaaagaatataaattatttttatactactatcttctctgttaatatcttcgaggattattttagttaggacagatatgtcaactttgaggaaacaaattattttcctttttcactggtactcacacatcttacaaagttttttttaaaagcagttggggggatgcacattacataaaaatgaataaagaatggcagcaaaattctcatcaaaaactatgcaagacaatggagtgacatcttcaaaggactgaaggaaaagaaatctattaaccttgaatcctatatttagcaaatatatctttcagagatgaagagaaaatatttatttttttaaacaaacaaaagctgagtgaattcatccctaggagactggtactacaagaatattacagtaactttttaagaaagaaaatgataccaggtggaaatttagaactacacaaaggaataaagaacactagaagtaatagtaagcatgggtaactttaaaagatatttttcctgacttagtatctttaaaagatagttgactctttaaggcaaaaatggtaatatattatgtagtttatacaagcaaaatgtatgacaacagtaatgtagagtagaggatgggggaagtggaagtatattcatgtataggattcttgggcattacataaagtggtatactatttggaggtagactgtaagttaaaggtgtatattgtagactgggcatggtggctcacgcctgtaattccagcactctggaaggctgaggcaggaggacagtttgagccctggggtttgagactagcctgaggcacgtggcaagactccatctctatttagaaaagaaaagagaaagagacaaaattagctgggtgtggtggcacatgcctgtggttcccactgcgtaagaggctgaggtgagaggatcacttgagtccaggagtgtgaggctgcagtgagctatgattgtgccactgcactccaacctgggtgacagagtgagaccctgtcaaaaaaaaaaaaaaaagatgtgtatgttctagaccttagaataaaactaaaattgacatagttaaactaacagtggagataaatggagtcataagaaatatgcagttaattcagagtataaaacataaaaaaaggaataaaggacaaatggaatgcatagaaaacaggttgatagttacattaaatgaaaatgactcaaacacaccattaaaaggcagagattgtcaggttggacaaaaaagcaagatccagtgatatgctgtgtacaggaaacccacattaaatataaagggcacagagagaagtgaaagaaaaagcaaaattctcatcagaaattatgcaagacagtggagcgacatcttcaaagaactgaaggaaaagaaacattaacctagaattctatatctagcaaataatatgtatatgtagacaataattcaaagaaaattggagtgactgtacttttttaaacacaatttttgaacaaggaatattattgggaatgaagaatgtaaaattaatcaagaagatataacagtttaaaatttatatgtacctaataacaggtgcaaaatacataaagcagcaactgaggtgagggtgaaatagacagaatatacagaaaattagtaagagtatagaagacttgaagaacagtatcaaccaatttgacctaactgatatttatagagtactccactcaacaacagcaggatacacatacttttcaagtgaactggaagattcaccaagatacataatattctggaccataagacaaatataaccatgtgtcatataactgtttcagtcaacaactgaccacagttatgacagtggtcccataagagtataataccttatttttaccctgtcttttctatgtttagatacatttagatacacaaataccatggtgttaatgttacatattcagtacagtaacatgctgtacaggtttgtagcctaggatctataggctagaccattaggtctagtacataataggttttaccatgtagattttgtgtaagtacactctataatgttcacctaatgaagcatttctcagagagtgtccctatcattaagtgacacatgactgtatcaataaatgtagaagggttaaagtcatacaaagcatatcctccaaccacaacagaattaaatttgaaatcactaacagatatctgaaaaatttcccacatacttataaattaaataacatactgctaaataactcatgggttgaagaagaaatcacaagatacattagaaaatattttgaactgattgaaaagaaaaataaaacatatcaaaattcatagaatgtggctaaagtagtacttatcaggaaatttatatcattaaatgcttatatttagaaagggagaaaaaaggtcttaagtcaaagagctaagcttccatcttaagaaactagaaaaagaagaatcaattaaaccaagtacttaaggaaaggcagtattaaaggtaagagcagcaatcagtgaaaaagaagaaaaacagaattttttaaatcccagaatttactgggattttaaaaagggttttaactacatacttttaataacttcctgtgcattttagtcagatctttttcttagtataggaatacttgcattcatattgtaatatatgttaacagtacttcttcagatgacacttttataaccaagtcaaaaagaaattgaaacctggttgtgtggaaataatatattaatgcagacttagcttcaaagaattgtggatcacaagacattgtagactggtctgagggttttccgtatgtcagtgttcagttacctatctataatgtaggtatagagattttctgtcactcagctatggaatgtaagtggtttttattgcacaaccatttacttatttattttcctattgtacctacataatataaccttaggggactggtatttcaaagtgttgatttttactaatatttgaatacgaactcattcatctcagtaatgaagcttactttctaagtagaagtgttttaggtgatggcatttaacatttttgaaccttgagcatgattcagtttggaggcaaaactatcaggggaaaagaaatcaaaaagaaattgtcttctgaaacttaaaagaagcctaaacattaaaattatatattttataatactctaaatactcatattttgaaatggaaaatgtctttgaattaatggttatatttattgtttcatcattattatacaatctgtaccttgtagcatataataatcaaaggattgctttgagaactttgatatttccacatccagattcttgggtttcagattgatggttctgtgtaaggggccactatttcagctcagcacagaacatcaacaccagaaattgtgtttgtgttctagcattaatatggttgtttatgattctaagcaagttctgtgcaacctttgcattcattttgtaattttagatatacttctccctcaaaaacatagcggtgattgggaatgtatggatcataaaggaaaccataaaagaatttaagctctgttaataaggccaatattgaattgtggtaaatgtatttttatgagaataatttattttttctgcacatatttaaaatattgttttgtataccaattaacataaaccatttttataatattcatatgggagcagaactaaattactgtattgccctggtgactgtcctaatagtcatattgttatagtatgatcatattttaccagcttttccctgtagttattgctcacagttaaagttacatcatttatttgtggtatggtcaatgtatgtctagtaggcttttatggtatttctctcaattttgaacagttttcttactcttaaaattaggtcaccaattttctgtcatttgtcattctctttgaagcggtgcttccgtgttaactacttgtgtggttaagtatgtggcgcagaaagaccctgcaaattctcccgtgtggccacctctatagcagctggttatacaggccattagcacctgcgccccttccccagccgcctagtgcctccctcactcctgtctgctgctggccagtgggcatgcctttctattccaggtacttagccttggccagtgcttaaagctatgtttcagcaagtgcctggtgcatttcttctgcctttcctgccatggtcatcaattacacatccatttgatcaggacaagaagactaggaatggccagcatagtgtcagtgcttaactgacattatcgtggtgcttaactgaaccaaaacctcgctctttgttaatacattattactccagagttatagggtggttagtagttttgactagacgtaacttaacaacaaggcaagaaggtattgccttgatactaaagatactcctatagtaagtattcctcctaatttaagtactcttgtatgtatttcttgctaatgatcatagccagtgttatgtattctcttttcacggcataataatataaatcaaagtactttaaactgaagtggtaaaattagggtatgatttttttattttttatttttttttgagacagagtcttgctctgtagcccaggctggagtgcagtggcacgatctcggctcactgcaagctccgcctcctgggttcatgccattctcctgcctcagcctcccgagtagctgggactacaggtgcccgccaccacacctggctattcttttgtatttttagtagagatggggtttcaccgttgttagccaagatagtctcgatctcttgacctcgtgagccaccgcgcccggccaaattagggtttgatttctaaattccatatcatatggaccaaaaagtttaagaccatcttggtgagacaaacattggtcacctaaaagagtgcattctagttaccctaaacataaaaatgagggaagaaaaaactttcctgaccagctgcctgcctacctacattcctttcgttttgattttgttcatctgttctctcccctcatcacccaacactgtgctggagaactgactcatcacagtcccaaatgagaagctgcagctgaaatgtcattgccaccttcccaagcaaaattttatttcccgtaatgttcatatcatctccaacgtggcttacatttgcagcaagctttgcaggcatgctccttggctatttgcattcatgcttatttctaaagggaatgttttgacttgaaaggaacaatgaagattaatggtgaatttttctttatcttcctatatcatggatttctttttcagtttctgttactggctttcaaactggagatatgaatgctgtaaacatgatgagaagcagggtgtttgtttccttttataagccaggattttagtctgaataatggcaggcccaactgagaatgacttcagtttttatctaagtcattgcccaggagacacatgacacttggcctgtgccatatgggcccctcaatagcccaccctttcccaccctgtcctttgcagcctgcttctgaccaatgccttcactgataagactgtactggggatccgttaattaatccagtctttcatctctgttttaacagagaagttaatgtgaaaggagttgttcacaggttaaaagcaatcacaaatgtcatggtaataaaatggtcttttttttccagttgcacaagagggctttgaaactagttcgttttgccctttattcattaaagtgtaattcatgccttatactctgtcactttcatttgtcgagatggaccaaaagctttggaggtggcctagaaaaaatatctgtggcccacttacaaggttgcttttcttgggaccatttttgacttcgctaataatgtaatagggtgaagctgattgttcttttgaattatgtcttatcaggaaccatacccagaggaatgggttgcagatttctagggggtgtggcaattctaggcaaaagtcactctctgttgtgatctagagcttcaggcccaagcccttgcaccccttgtgaacccttccaggcctcctttcccgcatatcccacctagttcttccttagcatcctgcaacacacaaatagtcttcaagatgcaacttatggctttttaattatattttgaatgttcattgtattcagatttcatcatttttaaaacaggtaattaaaatacaacaacgtctagtaaacaaaattgtctgcagatgtcagtgcctgtagaattatctataggaaacagcacctattagtattgtgctagatggagcagcacaactgaaaagctattctaagttgtacaatttgtgcaattgattttttaaagatacctttttctgagttggcaaagtatgtgacgtaaacatcaccgataatgtaaaactgcatataaagtgaaacatttagataaagcataacgacgcacgtaaaaagaaaatattcatcactttttgtttaatgtgcttgacactggctggtatagtacgattttataatgtgtcacccaaaaaggaaacttgctttcaagtccagtggcccttctctgaattcctggccagttttagctccagttcctattccccactttgccaaaactcctcatttgctccataactgaacttccttcctgatgctcagagactatagactgccaggcatgaattcctgtaactttctgaccctaggtcccaccaccagtcctgcacagccagcctctctcctcttaccctcttccctcccaactcagggaaggggaaagtgattttccttgtattcagagctaattgctctgccctggattctgtctccaacatttgacttctccagagccttgctccatcagtgaccctctctttcttatgagtcagccttccccttcccttccacagtcctccccacctcacttctaaaccagtttctctacttttgtacctctgttaatgtcattcttccccagtcaccagaccttaaacccttaacagaccagtttctttccctctccgttgcctctgtttcaattagttaccaagcgctgttgattctgcctcctaaataactccagtttgtccctttttctcagtcaccactgcccgagttcagctccatatcgtctgttgtctgggtgactgccatagcaccaccctacctagtctgtcttccttcagccttgcccccttgaccgtgtcactccccttaacaatcctcagtggctctgcattgttcactggacagaatacaaatttgtaggcattgaaaaggccctgtctgcctctcctatctcctgccaggccagtcgtttccactccacccagactgaacttccttgcagttctctaaacaccacattgtttctctcatgcctcgtgtctttgattttcaactcaggacttagctcatgggttgcgtctcttcccagcttctctcacactttgcaaatattttgattagaatattttcacactgtgtttagtaggagaaacccctttttatttttgtatagatcatcatttaataaatgtttatgaatgaataaaaatgactaattaatgaaaatcagtatttgttttgatgacctttagaggaataaaagactcaaaggctacagtaatcaaccttttacaaatataataaagtgtcatagagtcatagaggttacagaacaaaggaaacttgagatatatggattttagatataaaaattcaagtgagttttagatataaaaattcaaaagggaatccagttaaaccctgttagacaaatagttttgtaagctgctggttctgcaaggcctatttctagaacattttcatggagagctacataagctaccttctaaacgatttaaaaaacaaaaaaaaacaacccagcctcaaatggctcaggatgccttcattaaaaaagctgcccaagaatgaactgtaaataaataacaatatcctaaagattgctttctgagatacatgtgtaaccctttaattggagaacatggggtctgctcggacagttaaaatcctctcttcagcatatctaatataaagaaatatcccaggctttttgaaatgccacattcactgctactttcaggaaggtggggaaaggattggttctattaaaacagctcagtagccagtgctgtttcccaaatgcctatttgtttaacagcaaacaaaacaccttctactctttttgctctccctgtttaactttcagatgctttaccatgagataactgatcggcacaaaataattcctgagacttccttcatactttcattgcatctttagtcaccttaccaagtaaatgatactgattatcctgaggtttggcaacctataagtgagtttgcatcccaaagactttctctaaaagtagcttcacaattctgttgctgtttcatgattatataactctctttctgaatcagcactgcctacttcactcattcccataagaataaagcacgattgcatgctttatccagttttattcactctgaagaacacagggacattacagagtatctggatgttgatcttgggctctacttcagcaactccaggaaatactttgagtttacaggctctgaacatcattaacaatccagaggctaccgtgcctgcattcctgaccctcctccataaaacacatagaagggattatggcctccttttcaaaatcaacataaaattttgtactcagactcagttggcaacagcaaagagttacaagcacatacctgctttgaatgaacccagggttatcccttgcagctttatatggatatttgggccaatgtagtattttgaattctgatattctgtttcattgattcttatatgcatattttattttccattttaatgtctctgaatttgggatttgtcagacaaccaatggcttgtcatgatttaattggcatggtttttctaaattgaacacataatggtatgtcttacatttatggtattttcatttgaagaaataagtttcatatcttaaaaatcacttacttggtttctaagacttagtcaatacgttagtacagcaattgtaaaaatgacaatcttagctgtgaattttattatgtatggtagtggttttggcagatatgttggaatcaattgtaatgtactgataatattgaaatttttattattttttaatgttcagagtttggattcattgcttctgcaaaatattctaccaatatttttttgtctgagttaacctagaatgccttctctttcctgtttgtaaaagggataggtatcttaacatttgaatcctttcttctttggggattcctttctttttaaggaaaagaaatcaaatacagtagaaagaacctttatgagctggaatggttagtgaataattactgtactcaaacgaggttcctgataaactgtagtttctgcagtttctaaaatacatttattctccttgctaacataataaatatcaaatgttttaaacagaaattgggcctttttgatgattctgatgtgacccatcaataagtatctcctttaatgtctgtgatcctactcatagtcacagaaggtaaattatctgcaaaattcctaacaggacccaagacatactctatatgggcactcatgccttttcatgtcatagtactgtagaaatagcatagtacatagaaatgccagtatttgtatagattagggtgcctgcacctgaggggacattggaaaactccattatatagttttcgaaagtaagttacagaatattggtctgatttatcattcctaaaacaaagaagaaatcaagctctgaaaaaaatgttaactgcttgtcagtttcactcaaccaaggttcttttaaatgcagccatgttggcgcttcattactaaccatgggctgggtgcagtggctcacacctgtaatcccagcactttgggaggccaaggcaggcagatgcttgagctcagaagttcaagactagcctgagcaacatggtaaaaccctgtctctacaaaaaatacaaaaattatctgggtgtggtcgtgtgtgcctgtagtcccagctactcaggaggctgaggtgggaggatcacttgagggaggcctcagtgagctgtgatacaccactgcactccagcctgggcaacagtgagaccccatttctctttctctcatatatatatatatatagaatatgtggcttgtatattagtgctttgatatgaagcagtcttctcatccgtgtgtttcccctttcctgactttgcccctctttttttttttcaggtgcatacattcagagggccacactggtgtgaatactgtgccaactttatgtggggtctcattgctcagggagtgaaatgtgcaggtaagagctcttgtcttgtctctggattgagtcagttgtgaagttataagaggtgaggtagaaggagacttgttgttatgcatatccagtaggctggatcctggtttggtcttatgcacatgcagtaggccagattctcaggcagccactttggaaatttgatattttatctgctcttaaccttctggcacttgatggacagcacactagggatctggcattagtccactgaaaagagagaagtcagcttgttcaaaaagtctgataaaaggagataaaagtaaggcagttatatttaatacttgcctttgatgttgcagtaactaaatttataaaaatgatttttttaaagcaatgtacagggacctatgattgttgccttggaaactgaattttaaagataacttgttaagctggattgtccttactaaatttttgtgaaatcaaattgaagctttaaaaatctgtgaattcatcttcaaagatggttaccaaattctgaaaaaccacttagtcactaatattttctgtgtgatgttttgaaatcaaatacatcaaatactttttgtaaaatatgaccatgaatatttagatacaaatttagaaaccaaaagatttacacatacagaaatagccaacacaaggatgtatttgagatactttgtgaaataaagtacttatgtatatcacgtgaaatccatttgtatagagcaactatactgaatactggccatttatccaaactactttaaattctttttttttttttctgagacagagtctcactctgtctcccaggctggagtgcagtagcgcgatctcggctcactgcaagctccgcctcccaggttcaggccattctcctgcctcagcctcccgagtagctgggactacaggtgcccgccaccacacccagctaattttttgtatttttagtagagacggggtttcaccatgttagccaggatggtctcgatctcctgacctcgtgatccacccgcctcagcctcccaaagtgctgggattacaggcgtgagccaccgcacccagcccaaactactctaaattctgacataggcttaaaaataatcatgtaaattttaaatgtctattatttggtcataaaagtttccttctgccatttaatttgtaaaactaaaaaatatcttcttacatgtcttttagcatgaagctttacactaaaaaatatactaagtaaagtatttcaaaatggtaactatagtaactgtcagatttatcgctataaacatcatttcttttgtggcatgatttttaaatggaatatttttgttgtccattatgtgcagaaatttctggggtctgattcttatttctaaattgcatttcctttgaatagcaagatatagtatgtattgcatggaaatgttccaagtcgctcttctttcagttattattcccttagtatcactaaaatgtaataaggttccaggcatatatcaccattcaaggaccttcctgccacaggaagtgggataagaatcctacacgtgtggacttggagctgtgcaaaggtgttcgtcagggagcgcctcagctcagagtcgaagctcagagtgaatgaggaaagccttgctgtggctggtggttatccagagttgggatgaagaaggccatggttgtgcctttgcactggagggaaacagtagaatggaaagtgttgataaagtggaggtattgaggcagtgtgcattgcagtttcacaaaggcagatggaatactctttccaaagcacaaattgcctgctcgagaacaatggtctcaatgagcccagtttgcctttatgagacagtcttgtccagctgatactctgcaatagttttttaaatgttttatgactgtcacaaacttaaaagcttttctttcatgagtaagggtgtatattgtttccattttgaaaaagtgaagcccatctacataagaattcttaactattaatagagaataggtacagcacctatgaataatctttgggaatacgctacaaccccaatcatgttggaaagaaatgttttggaacatttatcatgtcaataatatgggggaaaggagaaagaattcatccccatctccacagccacccacattaatagcctctacctcttattgtgagtaaaggtcaggaattgaaagaaaagccttgaggagatttttcattttatgttatatcttgtccttaaaagcattatattcagtgtgatttgaaccatattaatgtgtaatacaagcacaagtcaactcattttgaaaacacggagggttggaatttgaattcattctgttttctatgacaactaattatatttggattgacagtgagattcttaggtctgaagtggctttgaggctcatctggcctttgactatctaaatccaaacgcaaagaattgagaatttaaagagagagtgcacactagctgtgataagctgaaaaatagctccccagagatgtccgcttctaattcccagaacaacattccttgttcctttcatggcacgaagaatgttgcagatgtcatttaaattaaggatattgagatggggagttttgggttgctatgacaaaataccacagactgggtaatttgtaaataacagaaatttatttctcacagttctggaggccaggaagtccaagatcaagctggcagcaggttcagtgtctggtaagggtccaactctgcttccaagatggcgcctggaaagctatgtcctccagaggggaggtgcctacaatgcagtgtcctcatgatttggcagaagagtataaaaggggccaactccctctgtcaagcccctttataagagcgcctaatcccattcacaggggaggcgccctcataagctaatcatctctgaaaggtcccttctcttaatactctcacattagcaacacctgaatttttgaggggacactttcaaaccacagcagggaaagtaccctagattgtcaagggaggcctagtataatcacaatcataatggcccttataaaagggaggcgagaggttgatagagaaagatgatataaggacagaagcagaggtcagagggaagagaagatgctatgctgctggctttgaagacagaggaaggagccagaagccaaggaatgcaggtggtctttggaaactggaaaaggcaaggaaagaagtggattctcccctaagcctccagaagaaatgcagacccgctaacacctgattttagcccagtgaaagtgattttgaacttctgacctccagaatttaagataatatatgcttgatgtttcaagccaggagtttgtggtattaataatttgttatagcagcaattgtaaactaatgcactaaccactaaacactaaaggtattctttccaaagaaaaatggtgggctgtcagaaaagaaatgtatttatctgcctttgattcctgagacagcttgctttgttctgccttcttttttcaaaatccaccgaggcaaaagagagcttgtcaggaatgtttaaatgtttaaagctgctttaaatgccaaaagcagcaattttgtgtccctcgccacagcccttttttaaacatcatgtaaaggtattgggtgatgttccaaccaccaggctggcaaagttgctgtaggagtcggactaaatccagctaataccaggcaagccgtcccttcaggactgaaagtgctggcttgctgctaagcacaccgcagcgatgaggacaactgagggagcagcagggaccatcctgagaatgctaatcattacattacacgggctattcaaaaccacgcagtgcaaggtgacattgcaggcattgcaaagtctcacccaccaaagtcacccttcctctagcctcctttgaagtgaagaaagtgatgttgcaagggcatagctaactgcagattgggaatggtgctcctccggctagaatatttatgacccaagtaggtaacctttaaaaatcacatgaaaaaatgctcatcatcactggccatcagagaaatgcaaatcaaaaccacaatgagataccatctcataccagttagaatggcaatcagtaaaaagtcaggaaacaacaggtgctggagaggatgtggagaaataggaacacttttacactgttggtgggactgtaaactagttcaaccattgtagaagtcagtgtggtgattccttagggatctagaactagaaataccatttgacccagccatcccattactgggtatatacccaaaggattataaatcatgctgctataaagacacatgcacacgtatgtttattgtggcactattcacaatagcaaagagttggaaccaacccaaatgtccaacaatgattgatagactggattaagaaaatgtggcacatatacaccatggaatactatgcagccataaaaaataatgagttcatgtcctttgtagggacatggatgaaattggaaatcatcattctcagtaaactatcgcaaggacaaaaaaccaaacactgcatgttctcactcatagatgggaattgaacaatgagaacacatggacacaggaaggggaacatcacactctggggactgttgtggggtggggggaggggggagggatagcattaggagatatacctaatgctaaatgacgagttaataggtgcagcacaccagcatggcacatgtatacatatgtaactaacctgcacattgtgcacatgtaccctaaaacttaaagtataataataataataaaaaaatcaagttcaaaggatggtcgttgttcatttagaatagttcccttgaatagtatttttctttatgaaaagtaagcttataggttaaagtaatctattattatgtaatcatggagactgtcaaacattcgtctttaaaaaaagaccattattccagcagcattcctgaattgttttcatcttagccttaccagaataatctaagaaattaagaaggataattatttcaaatcagacatatcagtttaatgttggttatttatgaaagtgacttcatgttttcagtgtatcattatcattgctgcctccaaaaggaaatggcagcagttctcctaataataaactgtaagtatttattacttcaggtatacaagcccttttaggttgcagaaaataagtggaagtaatgttttttattttaactactgttttgattgatcgtacctaaagagttgcgtttgtccttgtaagccagtgagaaattggtaagacttgcttaaaagtttcatggagccccttttagttggaaacaatattttcatcaatattccaaagaacaaagcattcttcttaattttgcttataaaaataattacttctgatgcatattaaaattcaagctattccactttcctgggggaaaaaaaacgagatatgtttcaaaacaagtttttatttgccattatttaaaatatgaacattcagagagaataatgattataatttcaaatcttattaacataaagttatcctttaatcctgtcaatagaatgtcagtatcagctattcctttcaaaaaattgatttctgtgctttctagatataaaacctgtgttttagcaaaatcaagccccagaaagtctgaaagtaatttaaagttggtagtctaagtaatagaaatattttattaagaaagtatagaataaaatgtgacttgaattttttattcctcctttcatatgtttattctatgcttattaacttgagaaattggaagggagaaatgtggtttaatagtaacataaaaaaaaatgtggtttaatagtaacataaaaataacctaccaaaccaagagattcaacaaatgaaatcatttatggaccttttattattattattatttgtagtatagcgcttccctgagagaaatggaactatataagagttatatgactttaataaataagtatgaaaaccaaataaagccttaatagcaaactgaaatattgatataccgttagtccctgaggcagcagttttcagagcaagctcagggctagtgaattgcactgtgaatgtaagtgtataaaaatcagctttattttaatgactttgccctgtctttggcaaagacttcatatccagtcctgccaagaatttagccttatcagatacatttttaaaattgagtataacatattaatgttttcccatagttttatcttatttaaataaaagagagaacatcagtttagaaaacatttccctcttccttaaatacctaaatctgagctcactcatcactttatccagtcttcactgagtcccaaataagcttaggaacctgctgatgtttaaaatgggagatgaatactggatgtggtaactcacgcctataatcccagcactttgggaggccaagacaggtggaccatctgaggtcaggagttcaataccagcctggccaatatggtgaaaccccatctctactaaaaatacaaaaaattggccgggcgcgatggctcatgcctgtaatcccagcactttgggaggccaaggcgggaggatcacgaggtcaggagatcgagaccatcctggctaacacggtgaaactccgtctctactaaaaatataaaaaattagccaggcgtggtggcgggcgcctgtagtcccagcaactcgggagactgaggcagaagaatggcatgaacctgggaggcggagcttgcagtgagccgagatcgcgccactgcactccagcctgggcgacagagcgagactccgtctcaaaaaaaaaaaaaaaaagaaaaaaaaatcagctgggcgtagcgacgcgtgtctgtagtcccagctacttggaggctgaggcatgagaattacttgaactgggaggcagaggttgcagtgagccaagattgcgccattgactccagcctgggtgacagagcgagaccctgttttaaaaaaaaaaaaaaaaaattgggggatgactccaaacattcaaaggaaaaaagtcaataccaaaccattactgccattcagatgttttatgtgcatgcatcacaattttacttttttgctttctactggatttttatacatagggaaagaatatgacaaaacaagttttatcactgcattttaaaaaccctgccagatcaattatatatatagatatctataaggggactcatttgggtaaaatatagcaatgttttttaaactcaagtctatacaatgaataatgggtacaatatacatttttgaataagaggttgaaaatagcaaatacatcttcaataatggaaaatataactttgagtacatgatgtagtgtatggtatacatggggaaaagtggtatgtgtgacccagtgggaagaggacaggctgggaatcagcaatctaagatttcaaagtcagttctagcactttctggctgagtaacctgaacaagtcatttagcctctctcaacctcattgtcttcagcttgaaatgaagatattgggatagctttttaccaagagccctttctgactcaatctgtgacctgtgtgtattacacttaaagtatgaggtatatcaacactattattagattatgaaggttgttgaatttcatgcttctaaaacgttgttataagagttcttccagttctggacaagatggataaatatgcttttattactcccaataattataacaaaaggccctggacaaaacatatacatcaactatcagaagactctgaaaagttggaaggcagactaagcacctcaggattccagaaacaacctagcagcgagttccctggtggctaattttgtctgttttaacctccaatattatcccagcctgggcaccagagaagcccacgaaccataaatgccacctggcagagattaaaaataatccccaaaaaaggctgctctttctagctaacgcagtgggaaaagggcagcccagcagcacagaaacctttcagtcataccttccattctctaggtaaacagagacccttctgctacaccttctcagtggatgctgcagcagcagagtctaggtacaagccagttttccaccaccaccttgcaatagcagtggtgcactctgctgcaaacctgtgagtggaactctagcttccttccattcctgccttgcagaaactggtatccctcctttgctgagcttgtgagtgggatcctgactttcttctccaccctatagtagaagcagcaacctctcagcccaagtctatggggagagctgtatcttcatccctgacctgcagtaatgaggcagctgagactggtgagaactctatcatctatgcccatcctacagctacatgtaaaatagtactattccccaacccagtttgtgggcacagctttgacttccaccctacctgcaatacctctccctcccacccagtgccacagagaatgtggagcagagtcctgccatttgggtaatatacaagtggggcaggcacaatagcactgcagtagcatttaaaaaaaactttgtaaactaggttgacatttggatcacagtctacaaaagagcattctaaatctaaacaaattgactacaggttacaattttaaagatttagtaggaaccagagtcaaataatactcaaatatcaaagataccattcagaattactcatcaaaagttactctggaaataaccaggaaaaaaataaaaaaggacaattggcagacaccaacagcaacgtcaagatgacacagatgttgtaattatcagacaagaaaagcagctatcataaaaatgcccccaacaagcaattatgaacactcttgaaacaaatgaaaaaaaaaaaaaaaggaaatatccgaaaagaaatagatattaggaagaaccaaatggaaattttagaactgaaaaatataataactaaaaggaactcaccggattatgggcttaatagcagaatagacatgacagagtgaagatgaacttgaagtgaagataagtagaaattatccaagttaaacaacaaagagaaaatatgtattttttaatttatttttttttagagacagggtctcgctgtgtcattcaggctggggtgcagtggtgtgatcatagctcactgcagccttgaccacctgggctcaggcaatcctcccaccacaagcccgctgagtagctggaactacaggcgcacaccaccacaaccaccaatttttaaaaatttttgtagaggcagggtctcactatgttgcctaggcttgtctcaaactcctggccttaagcaattctcccactttagcctttcaaagtgctgggattataggtgtgagccactatgcttggcttagaaaatagattttaaaaagtgaactgagcctcagagaccagtgggaccataacaaaggttttagcatttgtgttgttggaatcccaaaagaagataaagaatgagaggctgaaaaaatatttgaaaaaaaaaatagctgaaaactccccaaatatggtgaaagcagtcaagagagaaatgatgcattacttacttcgggtccttttatttaaatgaaatacattaagaacagtgtagatatggaagcatctgtatccccagttatccaattccttttcgggacctggcctccacatctgacaaatatgaaatttttagccttgagttcaacttagcttctgaccttaagctgattgacaaccttgaggtacgacatagaaaaggcctttcaaagtgttatttcatttttctaaataacaacaacatagtcatggtgaacacagtttactacatgtatgcattttacctatattaacattgaagcctcacatgaacactaataaacactattattgttcccattttacacaactgaggtacaggaaatttgagcaactcactcaaaatcacacagctaataaattctagactgaactctaagatataaaagttacccaaaacattaaaatattcaggagacaggagatcttttaagtggacagttggttgccttatgattgagtcagatctcttatgtattctctaatacagagataaagaagaatttgggatttggttctgaagtcatttggacattaatgatacagaatagtgttgggtcatttgttcagatagtgtagattgagctctttgtcctggaagccattctgtattcacaagctgacattccttaggggtgataacttttggcactattagcactggtgatcccatcttccacatgtatgcagagacccagcttcccttgacacctagcctgtctttgtacatggaggtgctcagttcatatgaattctttcccgagagttgccacaggccttaagttcttatttcaagttggcagtgtctacacatttaatgaaacaatgatgttgtttgtaagttttggctaattttccttgtctctgttaactgttaccactatatataactagatcacagctaataacttttaccaaaagtcatgataatgatcaccagcatttgtctagcattttacaacattcaaagcacctgaatgcattggctcattaattctcaaaacaattttgtgaggtgaatattaggatcgtctttctgccagaaacagcaagcaaaactgaatggcgttgtatgattttcaaattggcttcactaagacctggctataaatcatatatgcaccacttggactagatttacaagaggtcaacataaagtttttatgaacttaaaaacaaatgggttattttttttaaaaagatgacatttattttagttgaattatttaggtatggtttactctgcagtctaatttaacaaaatatttgtattcctctctaccccatctaaaatttctttgtacttttcttgttgaaaataaagtgtctcacaatattaaccagaaaatgtttcatttctggcatcttagaagttataaccaagtaaaattacaaagcaaatgagtaacttcagtagaggcagtatgtgtctaggtgttaaaattggggactgactctaggggcttccagataactgaacatgtggcggttcctagagggtgatacacccagggagggctggaacctccacacccctttccccatacctcatcctatacgtctcttcagctatatcctttgtaattaaacagtaaacatttttaaaatgtggactctagaatcatccataggcttgagttctgttccactgtgtactaaatgcatggccttgggtaaattacttattacttctgtgtttggttttctcagatataatatgagggaaaaaagtacccgtttcatagagctttgtgagtttaagtgaaataataaatgtaaagcacttagaatagtgcctggcactagtaagccctcaataaatgttagccggtaatagtatagcaataaataatagttacagctatttccagctactagaggaattatatattagttatcatatatatagaaaggattacagatagatataaacatgagcagcaccattttaagagggccctggatattcctacttttggaggtccaattccgctttatatcaaatatacttaaaatgcaattataccccacattaaataaacattttatgtaactttaaagaaatgggttttttttttggctatttgacatattttgtggacattgaattaaaaacattaattttgatttttttgttgtattctcctgagatcatacagcaattaaacgatgaagcgtgagctagaattctggtctcctggcttataatcaaattgttccaagagaaaagatgaaaattattgtttttccaccaagaaagaactgctggagtctagtccactttaaaacctaattcaagctggagtgccttttgctaaaattaacactccagaatgctcaaaactctgaaaataatattgaatgtttcctttctttattcttttcttagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtgagccatttgcagtgcgggttgcagtggtctccgttcactaccagtaccaatcctgatgccttttgggtacctcattgcacaatacggttgtcttctgtaatttggaggggaatggtttcatatgtcaaatgatctcaaagactgaaatgaattaatttaacaattaaatagcttgatttcaaggtacatttaactaagtgtagccaatgtgcttgtataaaaatatatttatagatgatgcttccagtctgcaaaagttgacaggtaaagacaaattcatttttcagtttttaaatttttctttggttcaaaaagcaaaagtataaatgctctactaaaactatctataaagccaaaaacagagctgcatcctaattattctttcccacttgagaaaaacaggcctatattttatcttagtcttctgttatgtaaaagaatttatgatgtaattggggtgatgaattatttcccttaagacttaacatatttcacttaattagaccaaatgatgagccagatgatattcaggtgacaataggtaagagttaaagaactgtgtgtgaaatcgttttattctaggagaagagtgtgaaaagatttctaaacatgtatattttatttcttctgacacattacctcccagcttaaagtgtgaggagttaaaatctgaagaaaaggcataattcaaagaaactaactagttttatttttcaggtcttaattctgaaggactataccgagtatcaggatttagtgacctaattgaagatgtcaagatggctttcgacagaggtatgtttttcacaatgttccataacttaggacaataatactcttttctaaaaaggcacaatttcttgtgaggtattttttgcattatttttctaaatcattgatgattattataccaaattaaaaaacttagcttataatttcttcttttttctgagttgtaagtattaaacagtcaaatttcagaatatgaaagaagtataaaattaaactatgttaccaatatttgagtatccaaggctggtccatgttcaccaaaatacatacagagcaattacattcaccaaaaatgatagagaaaagagtaggatctataccattacagatttcaggcttctcaggcttgagttaacccaccttaccctgcctgtcatccatgccccgctggcatcctcatcaccatcttcgattagctgagtgagacccaagcccggactcaagttttggggccagaaagctgaaagaagctttaggggccttctgtgggggacccatcagccactgtaggagaaggggcccagtcaaagaaaagctcagtggagcttaattttcttagctaacatttaaattaagatttgcttccatggctctccaatttgtctttgcttcaaggactagaacaaggtggttccaaagaagacctgtagccttgaatacaggaagtaaaggagtaagagttagtgatcttttaaagaaccactttcctttgcaagtacgtattctagttctatcacacaaacctctcccattcacagacctcttgtaggcaacagaggcagaaagcaaaagtaattaaatattcattaccaacctgagggaaactaggccagcccatgtatgtgataagagcaaagaaagggaggtgaattaatggtgtattcactccaaataagcatcaggaagagcagtcctgaatccctgccagattgaatgggaagaagcatctctttactctggaagctctgcaactgagcatgtccattcccagcctctggctatgagtctcaaaaataaattcacactgacaaagaaactgaatgttcctatggaccccagagagcaaagaaatgacacagtttcctgtatagaaaatatgagacaaccattttgtgacctgaaaacaccagtaacagattttaaaattcatgaagagctcaccttggctccctgtagccacactgctgggggccagtctttggcctcccaaggatgtgtaccagcactcatctgcaagatctatagtaatgatgcaaaggattttaacatggattacaggaaaccagtgactcggatcattaaaatcagttctatatataaatgctgcccaattccatgcatgttcaaaggaataatcctatacctttgaataaacagagcaaaataatttggagtaattaaggatgatcacttctgagaggcataaacctcaagtaatgagatccaagaaagaagacaatatccataggatgctggaatgaactcatttaagagccaaggtgaaaaggcaagtttggggaaatcttccccagcttaggaaatagtgactgaatggaaagctgactattctgaggtcagcagttgccattatacctctgctacattttgtcctttggtggaatcacagatatttatgtgacaggtacagtgagagatccatggtcaaaacaaataaaatctcatcagctttaccccagaagaatcctagtctgctggaggcaagagcagaaagtaaagaaacaatcaggaaacagagatgttatagacgtcttgctgatatggtatagccctacttagaatgtagtatgtggatatcagattccaggatttgtttacattattttaaaacagaaaataagtaaatagataatacagatggaagaatatatttgtgtatttgtgtatacttactaaaaagcaggttttaaaagaaccagtttaataacaacgtacatagtaagccccggcatgttactcttttaggcccctagcttgtttaaatctattttccattgattggttaactcaaaaatattaagcagctactatatgccaggcaccatgttctttagaacatttatagagcatagacgaggtgccatgaatcctgccgagcactttagatatgatggttaaccatgtacgcttggtccttgcactcatggagggctcacattaaataataatcacacagtggctattgattttattttaataagggctataaaggaaaatattaataactggggagtttaacctgtctagtagggcaggtaaggcatgctggagatcagaagaggctctttcacagaaaattaatcattaatatgtaacgtagcacactaaattttacgttaaaaactgaagaattgctaatctttaaaatctgatttgtatacagatatgtcattcattaaaacagtgctgtgaatccagatatttacttttatttctttcaacatccttaaaagatggtgagaaggcagatatttctgtgaacatgtatgaagatatcaacattatcactggtgcacttaaactgtacttcagggatttgccaattccactcattacatatgatgcctaccctaagtttatagaatctgccagtaagtatgaatgcatgtatttcaaataacctgacaacgtcctcttggtaatcaccttcctggttttctggctaacttgaatgcattttatgaaatgtttcccctttgcctctctctatggttaatgtacttacaagaattttgcattgttctctaacgtagattattttatgacttaataccatcagaagcttctttgtaatgtgctaaacctcattttccaaaataaggcttataccagtgctctttagatgtaagccaatgcttttgtaaaataaaataaaaatgaataactggaaaagtaaattaaaaaaacaaaaccaggctggcagtggctcacgcctgtaatcccagcactttgggaggctgaggtgggcagatcacctgaagtcaggagtgcaagaccagcctggccaacatggtgaaaccccatctctactaaaaatacaaaaaattagctgggcgtggtggcacgcgcctgtagtcccagctactcaggaggctgaggcaggagaattgcttgaacccgggaggcagaggttgcagtgagctgagattgtgccattgcattccagcctgggcaacaagagcaaaactacgtctcaagaaataaaacaaaaacaaacaaaaaaccaactatcttttattaaattcagcaaacataaaatttctatcagattactatatgtttctaaattcttattctcagtttctgtgcttgtataagttcactcagactattaacagcaaactggcactggcccacacattgtactttaaaaagcactattttatatcaagaagtttttgtaaattctagttgaaatgaaaatgagaaaaagcaaaggtttatttgtcaaagttcatttatgctgtaaaaatcatacttgtaattcacacttcattttttaaagaagggaattcttattggttttaagtattagcattactggtttttttggaaaagataggctatttctgtcattttgcttttctctctttaaaaccatatgttgtcttcatctttagatgataacatcacttccttagtaacactaatttgctttttgacttgggaatttcatgaagtacaatctttctttgttctaaattttagtttccctctcagggcttttgtagaggatttttgtggttagttccatggaggtctgatttcttgtgggtcagctcaagctcccatgtagagaacagctgtgagaattacactgatttctttcaaagcattaggttagaaagcatgaaaaattctaggtctcttatggacgcagtgctgatcatgaaaatttgtatgagggatctcacatgtccttgtctcatggggcagacatttcctctccagttaagtctgattgccactcatctagaaagcaacacacacacacacacacacacacacacacacacacacacacacacacacacacacacacacacacagatagcccgtgaaaagctgcctagtccacagtatgctctgatcccgaggactccgatcccactgaaagtgggtaagcttccactctggaagtaaaactgaagcttggctctatgcctaactctggggcacacaatcagcagaggacaaagcagtgatgcaaacccaggttctgaactccacacaccgccatatctaggaagaagtaaaagccaagcctcctcttggacttcgaggcctttgtccccacaattccaaatgacctctccttccttccccacacccaccttagctgctgaagaaaatctctcctttttattatccttccaaatcatttgtcatcgttatggagtttctgaaacagccttcctgtccaaaattagcaagcccccttatctcacccctcagagaactctggaaaccacatcataagaaagaaactttcggaaatcaaggtagaaatttctccttataatttcagttatttggatgtctgatttatgaatgacaccaaaaaccctggcataataccaatatataatataaacgtttgttgtacatgtttaatagcgatatcttgtttgtggaatattgtgtccttgtacactctcttctggcagtagagtctgtttcattctttagatgtgcagatacggccattctcttaaaaggcagacaaggaagatgagagaaattaacatttatagagcatagacgaggtgccatgaatcctgccgagcactttacatccatgatgtaattttagaaaggagatgtgatggagtatcagtaaattgtgtaagatcacattgctcactaggggcggcggcaatggcattcacacacacctctaaggtcagagcccttgctttacccactctgtcacactgcctggctcacttgatagaacagggaatgagacttacacaagggaagaaggaagaacccctttcaaacgagggacagggttaaatgatccttcctaatgcggatatattctccaaaattttttttctctctcagctcctaaaaatgtctctggcatttattagcatcctttgccaacaaaatatcagaatttacattaaacctttcttctacaaaagctgtttgagctctgcttttgcagctttcttggaggaacctgtagcttaaaagctggaagggggtgactgcaagaaatgaaaaaggaaagcaagggtggagaaggccaggtcatcccatgctacagctggaagttcttccaaagcccctggaaactccctgatgaacccacctgaagtctgtgttcactcacccccaccttccttactccctccccctgcagttaagacattgctgccctagaataaaaggacaggtgcttgtcacagagcctccagtaacccaacattatggatgcttcctggtcacgatggaaacagcactgccaaagttgagctccctgtggtaatgaggggagaaatcttcctctggccaaggattctgagaactctgttcccagagcagcttcaaaaagctacatgtctcagtgtgtaaccttgagatcaactcaaagcccagggttcttggtcccaagcaacttgaaatctctggaagagaagcctgggaaggagaacttgttagtatttcctcagctctgccactgagctgccccttttgctaagttttaatcttcttgtattcaagtttctctgtgtaaaattaactagacatactgtagaagagcttttaattagatctttatgggcttagagtctttatttccttctcggacaatgttcacattttccagatccttccaggccctcctctaatgccatctgctcttccctggacctctcagctgcagaccatctttctcctctgattcccatcacctctacttggacatctttactgcctccttccttcatgctggaaggttgtaattacgttttgtcttcctacttcaccggaatcccttttaaagggaggagttcttgctcatgttccttttcccacagtacctgtgatagtcccttacttacgtaataggtataataaatatttgttgaataagtcaacttataattttatattgagaacggtaggatgttagagtttgcacatattctaaggggtcatgcagctagactgtcttctataaaacattctttttgaaatatttagttgctgcaaggctcactcactgcttccagaggcagccagtccactggtggacagatgtaacagttatgaagcccttctgtgtacaatagaaatctgcctgtttttatttcataactctctcccattggcagtgttcttgacatcacccttattccatgtgtattttgtatatttgacaactgatgatggtcattcatctctgaatacattccattttgtctatttctctcttaaattatgcttcttatagctaaagagttgtgttctataaaaaatggtaatgggtaatacttttgtaagtggaagaaaaggagaaatgagttctggagaagaatgtctgccaatttgatctcagtatattcagtgcattttgtcatttgtttccaaatgtatatctccagcctggagatgtaaatgtcctctacctgaacaccagattaatccacagtcagcatgttcatttgaatgcctgacaggcatctcaaatggaacttttctccaccaaacctcctccacccacagtctttccaatctcagttaatagaggcctcgtcctcgctgctgctgaagccaaaaacctggatcattcatgattcttctgtttctcatgcatccttcatcaggaatccaatgaactcaaccttcaaaatatacccagaatccaacaaattcttattaccttcattgctaccccctggtccaagctactgtcattcttcacctggatgtttttaataattactggaatggtctctctgcttttattctttgccttccacagtctgttttccactaggcagccagagtacagataactgaaaaatacatgtcacatcatgacctttccttgttgataaccttcccatttctcttagtaaacactaaatccttaaaatagcctacatcccttgacatgattgagtgccctgttgcccttctgaccacacctgctaatatccccctcttcactcactctactgcagccacaattggctccccacttttcctcaaacattataggcgtactctcccctcaggatctctgcatggctcctcctccaccagcactgtctttctccagatctccacatggctcattcccattgaggtctatcctgaccaccccacttaaaattgcaacgcccccaacacttccaatgcttatgctgctgtttttcccattgcacttgcctcattctaatagagtgtaactataatatatcatattcatggtttattgtcagtcaccctcagtagcaagtaagctccccatgtgcaggagatgttttttgctcacccgacaacactatctcacagttctccctacagagattaactgtggaaattaaaaggaaactgggttctttttttaatttccagatttgtgtagcttcaaattaatttatcctgtagtaaaaactagagctgcgtgcagtggtttacacctgtaatcccagcactttgagaagctgaggcaggaggatcgcttgagcccaggagtttgagaccagcctgggcaacatagtgagaccttgtctccataaaaaattaacatttagctggacatggtggtacacacccacagtcccagctacttggaaggctgaggcaggaggatcacctgagcccaggaagtcgaggctgcagtgagccatcatcatgcccctgcacttcagcctgggtgacagagctgtctcaaagaacaaaaaccctaactagtggtttttatagtaagtggagtattcgtcttttattctagaaattcaatgattaaatttcagtatctgagctggcactactgttataaattggcactttttaaaggccccaaagttcagagaccatacattttttatcatggcaaaaagcaaatacattcttcattcaaagaaatgagccaggaactgtgaagaaatttggggtagagattgtaaaatggtcaaaatttgtttgaattaaaaagcttcagtcattgttcagtttctgaaatttatcaaatctgctttaccagtgctaggaaatttttacattcatctcacgccaatttttacctgacttcaattcattactattgagttggtttgttttataagttagaaacactaggattttttatcttgtgcattctggtcagatgtagtcttcctagcatttcaaggccaccaccctgattaggactcagcagcatggagtctcattgaaattaccttgaaacccacctttttttaattcccccccaagatggattcttgctctgtcacccaggcttagagcacagtgatgcaatcctggctcactgcaacctccacctcctgggttcaagtaattctcctgcctcagcttcccaagtagctgggattacaggcacccgccaccacacctggctaatttttgtatttttagtagagacggggtttcaccatgttggccaggctggtctcaaactcctgacctcatgacccacccccctcggcctcccaaagtgctgggattacgggtgtgagccactgcatctggcctaacccaacttttaaaagcaccccatcttttgacctttgagtagaagcaggaatgtactgtggtgctcttttttgagatcgcagaattccaaatatgttaattgttttcagttatacaaatgactaatgaattgaatgcagtctgatctcaaaggaatgtgctgggtttttgttcatttggaactaaaacattcaaattaagatggttcccttcaaaatttacacccttggaagagtcacatttatttcagggctctcgccatcaggcaaaacatttggaagtgccttcaaagtctgccgtgcattcttctgaatgtctgagtcatagaaaatgtgtgcattttgaaggtagatttgatttttttatataaaacaaagtaatttaaaacagtgtaatgaatcaagcaagtaaatgttggatggtacatgttttggtttaaaaagaaaaaagtatgaatatcaattaataagactttcttggggtcatagtgggtaatggagtgacatggttagtataccattgctgaaaagggattttcaaaatattttaagcaatgtaccattctataagtattattctaaggtcacttcatttgaatgtataagtttttatctgtgtcgacacgtctgaattttttgtagttacatcctgtattccatgtccaatttcgaaagttgtcagactccaagatactcaagtgacaaaactggatgttccctccatccccaaaagtccaagtaaatagtgttgccacattgaaactaagagcctttggaaatctggacttgaaccttaaaaataatttccaaagctgtggacaaggaattacgagaaagcatttcttaccagtttcagagcattatcacaagaatagaattcagtgaaccatttgtatcagttttgtgttatttcttttcttcttggtattcgacttgctattttagaaattatggatccggatgagcaattggaaacccttcatgaagcactgaaactactgccacctgctcactgcgaaaccctccggtacctcatggcacatctaaagaggcaagctatagactttgagtcttacacttgtattgcatccaaattttaaggacaaaatgaaatgaagggtgaaagaaaggacaaataatctattgaatgaataaataaatgcatagctatattgtcttttgtgaaattgcactagttgagaaggaatgctaaaaatattttacactataatactgagtgcagacttgattgtgttataaatggatttgcagttccagtatatgttttcagatatgctagaaataccaatattctgccaaggacatgcactaatttttgtggaaagatagagttgtggctgtaaagacacttgcataataaagcaagaagaaagcaacttgcaacttgcaacttgcaaggcagctcacttttcctatcttcttgctccaaaaaaagcacttcaaacttggtgacaggattttcgattattgaattattgttgccaacactgcaaactgatgtaaaaagtggtggagtaaagaagtaagggataaagggaggaatggaaaacgaagtatttcagttaattgtggtttgatgttttcaggcgatagtcatgcagctttactccctacttggtcaccctcgatctctatcagttgaagcaaagatttccaaattacacgaccaagttttagtggttttaggttttcaaagtataaaaccaatcagaaacaaaaatacgtatgtggccaaaggcatgagttatataaaaatgatattttagtcactcatgaatgtttacatttttcctctttaagagcaccatgagttaaaacctttgtttaatgtgcttacaacttcgcttataaactcaggattgcttcctgttgggatgtatttaagtgttccacactaaaacagaggactaactctcaaatcatattttctgtgttactgtgcagtggtaaaaagcatataaacacataccctccctgacgatggtgcctacccattgcttattactgtcgctgctgttctcttcctagacacttactcaactgtctacttgcaaaactactccatagcaaagacagccagagtgaagggagggtgggtggattaaatcaaggtgacccagttccttctcagctatttgcaaatgtaggtttagaactataggctgtaggtgggctgtggcaggaggatccatagatagaactgaatccatacagtgcagcacattaactcaggcttgagcctcagtgattaccacaagtttaaattatctcttgacataatttactttaaggaaagtcagtactttgaaattacagagaaataacctagtggaagagttgataagcggacgcaaacttttattgtgaatcttgttgttttagtgttcaagcacaatgaagaacatatggcttacacaaagtcatttattcctgtacttgcatttttcagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaa

SEQ ID NO: 37750 - DNA, 58869 bp, Homo sapiens
attttgtgaagagacgaagactgagcggttgtggccgcgttgccgacctccagcagcagtcggcttctctacgcagaacccgggagtaggagactcagaatcgaatctcttctccctccccttcttggtaagtggagagggcggacgcagggaaggcgctgggtttttcgggaagcgagagggggtgtgggagagaagatgtgggaatccttccccctaactaaccgggccctcatttattctgcttgttttgggggattaggttgaagccgggggcagttttataggcctcagcctctgtataggtttaacctggtgtcctctaggccacgatcgccagggaaaatgtccttttttcgctcttcctgtgttaacggctgctttcctttcattttctacgaccgcgaggactacgggatcatgaaaatgaagatcgtgatgctcattaatatagtcgaagttaacgtagcgccgatgccttctattacctccgttcttcttacatgtaaaaagtgggggaggggaagggggaaggttaccaagtagatgtatcgcgagcctttaaatcctggatcgtgccgcgtggcctacgagaaaggtttaacaaaagattcagcattttactgataactttttattttatttctctctatgagcaaatgatggagctcgaagtagttattttcacttacatttgtaaaaggaaatattgtgatataactatattaatatttacagctgacttttcatctgcaggttacaaaacacttgaaatatataagttagtggaactttgcttgaggtaggtattaactctctttctcagacggaaactgaggcagaaaagtgttggttgctagggtcatattaagtcagtagcagcactagtaaggaatttgaccacgaggtcagtcgagtggtttttacctagttaatggaatacctagttaatatagttctaaaactactgtattgcaatctttgccaagaacctgatgacggaaaccacgaggtaactggaaattcccaaattgcgcttaagaaaaatactacgagacttgagaattttttaacgtaacttcctaagtgtaagatgacaaaatttgactttcgggatattctggcgttaattttcccgtccgcctaaatgtgggcaaaaattcacagctacgttatattaagcaaatattaacagtgcctattatttgctgggtgctgaaatttgataaaaaacttaaaagttaaaaaaaattgtttagatctttagtgtcacattgacttatctgggacatcgctttttttaatcctcacatgagatttggctaagtttatttttcacaatctgttaatctcacaaaaactaaagctgttaagcacagtttaaacccattctgcagggtaagaaattcatctgtaaggcaatctatttgataggaagtaaaataagggtcaaaaacatcgcgacccctttcttaaggcttaaacatgtatattattacaggaacttaaaactaaagtttatcattgtgctgaactgttagaaatgaggttagggtaaaaatgggaaatcatgaagtaaaaatgttggcaaggagaaatgtcagaaattagtatttaagaactgttaatagtagttgaaattgattgacgggcacttttctttgaggttttcgaaaatgggttccttccggtcagtatgtatatcagcgcaccaaaaattctttgagttaatatccgaaactgtttgccacggtatttatatcacaattctaggtgtgttctcaactagataggcgtttagtaacattttcatattggctagggggaaaagttgaagaaggatggccaggttgcaggttttctgaccttttttttccccctcatgctagtgccactctcgggaatacttggtggttgatgttccttctgtagagaatttaaacagcttacgtttgtaattaaatctctagaggatttgacatggcattcgaccttgttttggatggaatggctgtgcgaaacaagcaaagaataaactccaaaatagctagttgctctaattttaaagactaaggggcaaattattaaatcttaataaagtgttgaatgtgagaggtgttggctggggagtaagtttgcctaggagttaggagaaatagattttaatcctccttaggcaaataaggggacttagacttttttttaaaacctatttgaatttttagtttctaattcaaattttttgttgccagaagcctaaaaactgtacagattgagttttattaaaagcagttttgttttttttttttttttttttttttttttttttgagacggagtctcgctctgtcgccctaggctggagtgcatgtcgtggcacaatctcggttcactgcaacctccgcctcccgggttcaagcgattctcctgcctcggcttcccgagtagctgggattacaggcgtgtgccaccgcaccgggctaatttttatatttttagtagagacggggtttcaccgtgttggccaggctggtctcgaactcctgagctcagggagtcctcctgccttggcctcccaaggtgctggtattacaggcgtgagccaccgcacccggccccggttttctaaattggtagttattattactattcttaaccacattatttcagtcttcaagtactttattagtagttgtctctggggagcattatttgctcttaatatgcatattcatgtattctcattggaaatgggaaggttttggttttgtgcatactagatttactagaggattggtgagaaccagaactttgaggtgtagcataactacaggtattctcgatattggaaattttgagtttattaacataaaaggaaaaaaggtttctttggtacatttactatcataggttatgtgtttttggatttatttatattgtatcaggaaaacattatttggtgctctaacttgattctgtcacagtacactggaaggtcaggcattttgtttaaagaattgattctaaggccgggtgtggctgctcatgcctgtaatcccagcactttgggaggctgaggcgggtggatcacgaggtcaggagtttgagaccagcctggccaacatggtgaaacccccatctctactgaaaataaaattagcttggcgtgctggcgctcgcctgtagtcccagctactcgggaggctgaggcaggagaatcgcttgaacctgggaggtggaggttgcagtgagccatcgcaccactgcactccagcctgggcgacagagtgagaccccatctcaaaaaaatgataataattgattctaaactggggaatagagagattcccaatttaaaatcttcacagtggttctcaaacgttagccaacaccagaatcaatagggctagttaaaacagattgctatgatctctaccacaagggtttctaattaagtaagtctggggtgggccctgagagtttgcacttctagtaagttccaggtgatgatgctcatgcatcactcattctgagaggtgcccctttagaagaagggatccaaacctcaggcaggttttgacaaagaataacctagagatactttttttctaaaactatctctgagctttaggtaaggatactttttttctttgagagcctcacactgtcacccagattagagtgcagtagtgtcatctcagctcactgcaccctctgcctcccgggctcaaggggtgccctcagcctgctgagtagtgctgctaattttttgtatttttggtagaggcagggtttcgccatgttgccaggctggccttgaattcctgagctcaggtgatccacccgccccaagcctcccagagtgctgggattacaggtgtgagccacgccgcctggcctcaaggaatattcttgattgaaaatggtgctaaagttggtctttttatgagtggtagctcttcagtttaacataaataacatcttgggagatactgagctttttgatattgaaagatagaattggtttcttttcacatttttctttatttttaagcttatgtcttgtggcacctgtacaaaggacttggttgtggttgagctataaagttatgtatcttgaaaattgattaccaggtttgggctgtggctccaaataagaaaatgaaatgtttcaccataactgtatttcataaacaggaaaagaacattcagatgtatatttcttacaattcttcacaaactttttccgcaatttgtacattcatacagttttcacacatcaaatgtaaaaattaactgtcattcctacactgttctttttaaaaatgtatggtacttgttgctgctgtagtcattcatgtatagttggctcaaggaacacttctaaaagctcaattaaaaattttttttttgagacagggtctctctctggcctggctgaagtgcagtggcgtgatcagagctcactgcagcctcgaactcctgggctcaagtgatcctcgctcctcagactgctaagtagctgggatttcaggctaccacaccctgctaatgttttttgtttttaataaagtctcgtcatgtttcccaggctggtctcaaactactgagctcaagccgtgctctaccctggcctcccaaagtgttgggattacaggtgtgagccaccacacttggccttaaaatattttaatttcctcaaatttacaaaggagaataagacctcatggctaaattgaacagtgagtgcagctagttcattgtttgcacaaggaactacagtctaattgcagttcctattttagctgatgaaacaaccagtttgtcatggaaattattttagtgtggtattatgtaccagatttttagaatccataacttgaaattagctttacacgctacatagtaaatagtggactacagaaacaaaagtattaacataaggaccttaatttttttcacctattttatgaccttaaatattcagtatttttttaattccatctgtattttcgttttgtcagtgagtggaataatgtgctccttatttaaaacatcttttcccctaacagtagaacctattaggtcttgtggtttgatcactcactggttttgagaatagatgagtcatctctagtatagatcttcatggtaggccattcaccttcagtctattactcatagcaaaaactccacggacttttttaagtttaaaacccatgaatctgcttaggttttataatctcagtatttgacatttgctcactatttcatctctatttgttggcccggtttttctgtattttctttgcccaaactgctcattatcaagatgaacatttgggatatactctttttgagaccctcaagggcatattgacatgaatttagttaattttagtcatctattgatgttgaagaattgtgaagacagtcactggtagaggtgattctatggaggctatcccatcccagtggaatgttaatgctttaccaaaatgtgttagctgcagtagacagatgtttctgtcttgggggtttagggcacaacatttctgaggaactctgactcaatctgtcccttctcctttcacagggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacaggtgttttttttttaattgtttccaaaaccgggacctggatttaagatgtaatttttaaaatttctatttctattttttctgcagcagttgggttagaggaggaggagccttttagcctctcataaactgacctctctacttcctcgtgtatttttaagattgattgatgatgtggaaagggctttgcttgtctgctactgaaaactttatccttgcggtttttgtggaaactgcttttggaaagagaaaagaaatgaactttactgacttgacatttttgcacctcccgtttttctaatctgggctatttttatttttgtttttttacagtgagatttttttgatcttcagctacagtaagttattccaatttttttttaacatttttcctgactttccgctgatttcctttttattgttgttactagttactattacttattattattatattaatacttatgatggtgatgatgatgatgataatgacactgatgatttttaaccggattaaaatcgagtttttctgaatgtttctaagaatttctccggcctcctgattgactttggagttttgcatcttgggagagaaagcgaaggcattagtatttttaagtggtttgatcacgtaaaccttttctctcccaaccccacccttgccctcatccccttccccacactgaaaagaattttactggctgttaagtctatgaccttatttttcctgatctttaacttaactgttttagagcatctctggacgtctgtatttttaattttttttatttttgtttttttatttttaatctttcatttgttaaatttttaaactgtgctgcaataaaatgtgtgtggtactacttaacacttatgatcgtgatggcattttccctgaaagccatcttcctcctgtttcccttgaaatcccatcctgcttttcctgtacactacccctcacaaaccacaagctgcagcaacatggatgcccagcctggagcagcagcagccaggatgacctggagccaggggggccttcggaacagatgcacacccttcctgggtgatggtaagaggtgtgaggtccacttggattcattacaaagactaggaaataaacccgtttaacagtttagctgatgtgtataggtcatagcatctggaagtgtttgaaacttttgtgtgtgcatcttgaggtgtttcccaagggggaccacctcagttatttgtaaactaatggaataatatgagttgctaattaacttgggctgattagaacattttggatacttggaaagagcagctgaagtttaaaatgaaagtggcttgttttaatgattagcaacaagaaaacatattggggagtccctttttttagattgttacaaatcagtaaacattttctgtcatttaacatattccttgggtttgtgacatttttggattatattctatttagactttttatctcattaatatttcacaagagtcaaaccataggagatacaacataatattaaaatgctgtctcactggagggcttttaaaaatttgaaaaaaggtaggctttttgacctcacaaagcagggaaatctgtttaacctctacatccaaattaggaactgtctaaggctgaccccttttacagtggtgactcaagacccagctagattttgggaattctaatgtgaattcatagagttctaatgctagattaggaactctaatgtgttctgatgttaagaaggagtgtattctgtgttattcacaggaatggtgtagagattagtaaagatgtggatagccaaagagaagttgagcaacccgtagtattttactcactgcagcaaaatgttttgataaccattttagagttgctctgataggtttcaagctgggagataattagattttattttaaaatatttctattttttgtagagacagggtctcgctatgttgtctaggctggtcttgaactcctgggctcaagcgatcctcctgccttgacacccccaaagtgttgacattacaggcatgagccactgcacctaacctggaataattttttgaaggcatattcggtactgttgtactagggtaaatcacaaacttgcccccttataccatactcggatgaaaagtgaaatctagttaaagtgaacaccagaggtacactcaaaacagaatgggagaaaaagcaaaagattcctggaagttatctagaaaaagaatgggaatctttattttttaaataagtgcaagttttattgatgctctctattgtatgagagctattttttcttctttgctgctgtcagtgtacggaagctgttcactataggttcagtttgatttattccttgttaattctacaaatttattatttttatgggacatgttgtgtttggggatataaaaaatagtttattatgtttaagggcttcgcagcttagtgagggagacacatgaatgaaataatgtccatatatgatgagaggtaaacacatatcctatagaagcatgccaaaataagctgggggcgttggtacctgcctgtaagcctgtagtcacaactaattggaaggctgaggcaggagggtcccttggcccaggatttgagagactgtagtgtgtgatgtgattatccactgcactccaggctgggcaacataatgagaccccatctttttttttttttttttttttgagacagtctcgctctgtttcccaggctggagtgcagtggtgccatcttgggtcactgcaacctccacctcccgggttcaagcgattctcctgcctcagcctcccgagtagctgagactacaggcacggaccaccatgcacggctaatttctgtatttttagtagtgacgaggtttcaccatgttggccaggctggtctcaaactcctgatctcatggtctgcccgcctcggcctcccaaagtgctggaattacaggcatgagccactgcacctggccttaaatttttctatttttagtagagacagggttcagtagagatgccatgttggccaggatggtctcaagttcctgacctcaggtgatccacccgcctcagcctcctgaagttttgggatcacaggtgtgagctgccgcacccagcgagaccccatctctttttaaaaaaagaaagcatgcagaaatggttacctaactaaccctgagaggtcagggaatcctttttttattatttttatttataactttaaatttataaatttattccttctaccttaatcacataaagggatttttttttttttttttttttaaataagacggagtctcgctctgtcacctagactggagtgcagtggtgtgatcttggctcaccacaacctctgcctcctggtttcaagcagttctctgtctcagcctcccgagtacctgggattacaggcacctgctactatgcccggctaattttttttttttttttttgagatggagtcttgttctgttgcccaggctggagtgcagtggcacgatctcggctcactgcaagctctgcctcccaggttcacgccattctcctgcctcagcctcccaagtagctgggactacaggcgcccgccactacgcccggctaatttttttgtatgtttagtagagacggggtttcaccgttttagccgggatggtctcgatctcctgacctcgtgatccgcccgcctcggcctcccaaagtgctgggattacaggcgtgagccaccgcgcccggcccacctgactattttttattgtttttttttttttttggtggagacaggtctcattttgtttcccaggctggtctcaaaaactcctggaagattttaatttttaggaatgtctttctaataacagtatggaaatggtgtagaggaaatgagattggaagtaggagattaataaaggagatattaaaatccaagaaagaataacgacctggcttggacaaaggtaatgctatgagattagagattaggaggtaaaattaggagcatctcaggatggatgtgataaggtggacaagaacacagatttggcatgattgctggtttctagcttctgggatagggatagatattggggaatgaatgaagggagcagattatagtttgagggtgggaaaaagaatattttaaacatcttggaggtattcaaggaacattcaagtataagatgttttattaagtatctgagtactatttgaaaatcattaggtttgggcatatagggatgaacaaaacatgtcccctgccctcttagatattatagatcattgagggaagaaacaaagtaaatggcacttttcacagtaaggatcgatgaaggaaaagaagagcgtggatgagaagatggcaagggaaccaaaattagaacatggaatttgggggatgctgccagggaagcttagctacgtggaagtagctaatggtgaagctcattctgtaagaaaaccatatgtgaaagcacagataatgagggggaacaagacttggcctccaagtaagaaataatactggaaaataattaccaagaatacatagatgagggatggagttagagaggtaggcaaggaccaaacatttcatagcacgggaccttagagggtcttgtttaagatcctgtcttgggcacaagtagaatctattgaaggattttgaagaagaggtctggtttatcttctgttgtgtagggaatattagtgatgagaactaagagggcaagtagggcagtaagtttggagacctattagagtaggccactgtctcaatctcttgaagaaaataatcatcccaagcctaacaataacttgccctggtttttcaaatgagtttttattgggtgtattaatgagcaaaatcagtctgagtaagataggttgagaactgatgaggctccaggaaattactaattatttctgataccttgttgggtcatataatggctttctgatttggcagaaaaaagtagcaggacattaatttatggaagtattctaaacacttgactatgtccaacactgttaaagttgtgagtttgtgttaacttaatcatcatcaaaaccttgagtaggagtagatactgttattcatgttttagaggtgagaatattggagtacagaatttaaataacttgcctaaagttaaactgctttagtggtttagcatggattcaaccctgggattaagggtgcagatttcaacacttaatgatagtagactcctttcgtcactttgatatgttgaacttttttttttttttgagacatagtctcgctctgtcaccaggctggagtgcagtggcatgatctctggctcactgcaacctccgcctcctgggttcaagcgattcttgtgcctccgcctcctgagtagctgggattgcaggcatgcaccaccacacccagctaatttttatattttagtagagatggggtttcaccatgttggccaggctggtctagaaatcctgacctcgtgatccgcccacctcgatttcccaaagtgctgggattacaggcgtgagccactgtgtccggctgagcattctagaaaaacagattttagtttggttaaagttccaaagaacaactttggacttttattattaaaattttaaaactaaatatgtttatatttttgcccttgatttcccaacaccttaaatggcttaaagatgtgtatatgtgcaaggtagttaatgtttaggtagatgtatcttggtaaaatgttaccatggttgtgatggcattgttaatagggaagcaagcacattttaaaagtgagctttaggccagttgcagcagtttatgcctataatcccagcactttgggaggctgaagttggaggatagcttaaggccaggaaagtctggcaacatagcaagagcctgtctacaaaaagctgggcacggtggcacacagctgtagtgtagctccctgggaggctgaggcggtagaattaattgagttcaggagtttgaggtcagtgtgagttatgattgcgccactgtactccagcctgggtgacaagagtgagaccctatctcttaaagtaaaaaaacaaaagtgagctatcttttttttttttctaagacttataaaaccgaagtgaacttcagttagaaaaaaattatttgtggttaaaaaagaaccacggagacggatgcattaactaagcccaggggtcctttttcaatcctcatctcacttgacctgttggttccatttaaccagatctcttccttgaaacgtttttattttttttttactttgcttccaggtttttgttacatgtttctgttacatgttaaacttctttctgttggagtgccccatggttcagtccttccacttctcttttctgtccacactctgggtccaatttcattcagattcattcatgatgtaatataccacctataagctgatttcgacacttaagatcaacagcctatacttttctttcgaatgtcataccaattcagtttacctgcatgacaactctgttgaatatccaatatgtcaacttaaaagtgcaaaactgtgctcctgatgttcatgcctcaaaccagtctcttgtgtactgttgcctttttcagttaatgaaacaatttttgtgtctcttgggccaaagattttggctagccatccttgacttttactcttctcacctttggcctattagaaaatcatgttggccaggtgtggtagctcaggcctgtaatcccagcactttgggaggctgagggaggcgcatcgcttgagctcaggggtttgagaccggcctgggcaacatggtgaaaccctgtctcttcaaaaatatacaaaaattagccaggagtggtggcaagtgtctgtagtcccagctacttgagagacaggcatgagaatcgcttgagcccaggaagcagaggttgcagtgagccgagatcgcacccgcaccattgcactccagcctgggtgacagagcaagaccctatcacaaaaaaaagaaaggaaaaaatgctgtcagctcttcaaaatataccactactcatactgtcgacacttggtccaatttcaagccacccttgtctcctgtgcattattatatataataggtttgtatttcttttgtccctccccactagttttgttcttaaaagtgatagctagattgatcctaaaatgtattgtttgaaggattttttttttgggggggagatggagttttgctctctttgcccaggctgtagtgcagtggtgcgagctcggctcaccgcaacctctgcctcccgggttcaagcagttctcctgcctcagccttccaagtagctgggattacaggcaccagccaccaagcccagctaatttgttttttatttttagtagagacagggttgcaccatgttggccaggatagtctcgatttcttgaccttgtgatctgcccgtctctgcctccccaaagtgctgggattacaggcgtgatccaccacgcctggccattgaaaaatgttttgcctgaaaacaaacaacctaatggctgcctttttcagcattgaagtcaaaaatttttctgtgatttacagggcatcccacgtgatttgttgtgtcccttcccttgctgttaatatactgtgcttcagccacactggccttcttaactgtattgaacacattggatatgtttccactttagggcttttccttggaattttctctgactcatacagtttggttcctcagttcctctgagactttttactcagaagctacccccttagtgatgtgtcttcccttatttagcgctttaagctccccttctcctaaatactctttagcacttatcaccaactgtagaatttgtttttttctatgtaaagacataagagatatgtccagaaatacatatgccaaacaattaacattgattgcctctgggcaagaagtgggatttaggagatttgaaacttgtgtactatgtgcttaagactattataatgatcaatgtggtagtattttccttctaattaaaaagcttaaaaatgtacatcaactcttgtgattctgtgtgggcataaatagcatagctagtctgtgtaataggggtttagtaagcagtgttaatagttgaagaaactgctttaaaaggtttagctgtgatagagtcgagttagcatttgagcacatagactaccgtgttgcctgtatcaacatttgggagagcttgaccattttaaaaatatgtattctctactgagaaagcatggctatttgtaagaggtagagtgaattagagaactttttttttattatttctacctaatctgattctgactttaccagtctgaaatattcttcctgttttctaattatattgacctatggctcctgagttgattttaaaactgaaaaaactccaggagttcattgaaccagatttaggcttttctggctagtcttgaataacatttaggagtttagtagagtacattttgaacaaaaattttcctccagtcctctaactaaaataggtattctgaagaggataaactattcataatgcattgtcactccctatattgatcctttaaataaaatcttcacataagtgggttttctagcttcagagcgagaagaaaagttttctcatgctattacccttaagtttgtggaattcatgctagagttatggctatgctgtttaaaatggagtttttctggtttttttttttgttttttttttgagactagagtctcgctctgttgcccaggctggagtgcaatggcacgatcttggctcaccgcaacctccgcctaccgcaacctccgcctcccggattcaagtgattctcctgcctcagcttcccgagtagctgggattacaggcgcctgccaccacgcctggctaatttttgtatttttacaagagacagggtttcaccatgctggccaggctggtctcgaactcgcgacctcaggcaatccgcccatctcggcctcccaaagtgctgggattacaggcgtgagccaccgcagcttgctaaaatggagttttattactcctttgaaaaggaatactagtcaagtgactgaagattgatgtggatttgggagaggaggtacctcatctttatcttacctttgatccgaataaagtaatacatgctcatagaacatttttagaaaatacagctatccaaagataacatttggggtgttcttccaggctttttggggcttatataaacttcaaaaagcactgtcatacagcatatatatttaagtaataattttaaatttaacctgaatagcttatgttagtagatacagatctctgaaaaatttgtagtagttacatagtattatatactctataatactacatggtacattgtatacttgtactatattttattttaccaatacactgttgtactcgtccccattttttcttttgtaaacaaagctttggacagtcaaaactacagttgtgcatatctttattttcttacatttaagccccagaaatataattattcaagggtatgcacatcttttttgccggggaggtgggcagagtatgcactttttttttttttttttttgagacggaatctcactctagcccaggctggagtgcagtggcatggtctcactgcaagctccctctcccgggttcatgccattctcctgcctcagcctcctgagtagctgggactataggtgcgtgccaacacacccagctaattttttaatttttttttggtagagacggggattcaccgtgttagccaggatggtgtcgatttgctgacctcgtgatctgcccgccttagcctcccaaagtgctgggattacaggcctgagccaccgcgcctggccgcacattttaaaaagttcttaagtttgttctccagaagctaataagtttagcaatttattggcagtgttagcggccactaatacttaatttctagttttgtgaattactttggatcttttgctttaagatttgaccctgtattattctgaaggatttgctaagtttttaagttgaatagtaaaaatgttgatagattttgagtgaaacattgatacaatgttgtctatatttctgtgtatagtttgagattcacatgtaatttttgttttcaggtgcatgcacatctttggtgctatcttttttttttttttttttttttttgagatggagtctagaggttggagtgcagtggcgtgatctctctcactgcaagctccgcctcctgggttcacgccattctactgcctcagcctctggagtagctgggactacaggcatccagctaattttttgtatttttttttttttttagtagagatggggtttcaccatattggccataatggtcttgatctcctgacttcataattcacctgccttggcctcccaaagtgctgggattacaggcgtgagccaccgcgcctggccagtctttttttttttttttttaaagacagagtcttgctctgttgccaggctggagtgcagtggtgcgatcccggctcactgcaacttccacctcccaggttcaagcgattcccttgcctcagtctcctgagtagctgagattacagttacgctccaccacgcccggctaatttttgtatttttagtagagatggggtttcaccatgttggccaggatggtcttgatctcttgaccttgtgatctgccggcctcggcctcccaaagtgctgggattacaggtgtgagcaactgcacccgcctggtgctatcttttaattgtgaaaaaatttcacatacacaaaagagaatagtataatgaacttccatgtacttgtctcactttaataatccttggccagcctttttgtttgtatctacatctccccatccacccccttcccatgttattttgaagcaaattcttgatacatttcatctgtagatatttcagtgtgtattttaaaaagaattaggacttaaccacaattatcccaccaaaaacgtttaataaattaactattttaatactaaacatatttagaggcctggcatggtggctcatgcctgtaatgccagctctttgggaggccaaggtgggcacatcacttcaggccaggagttcgagaccagcctggccaatgtggtgaaaccctgtctctgctaagaatacaaaaaaattacctgggtagggcagtgcatgtgtgtaatcccagctacttggaagtctgaggcagaaggatcccttgaactcaggaggcagaggttgcagtgagccaagatactgccactgcactccagcctgggtgatattgtgagacttaaaacaaaaacaacaacaaaaaaagaccaacaagtccatttagtatcagaagtactaccctgagaactgagtaaggcattcctcaatgctgttttatttctacggggataacatggttggtggggtctttttgtttatttgttcttttgctaacagtcctgtatggaattttggaagtgttgtttactaaaggtaggttttgaaattttcttaggagttgggggtcttatggttatactcattggtgataaaaatcaaaccttttactattctcaaatttagatataatctcctgttttggctgtttaagagaatactgtaataactttaagccaaatatccttgttaaaaattattctgggctgctaggttattattttgttatacctgtctaaaatcttatccataatttagaaattttaaaatctctgacaaattttgcatttgacaccaagactcaatttggcaaaaaaaactgatcttaactgatgtgagattatttatgttctatgtgtgaaatttactgaaaatttatatgtattcctgcagaaatatttgatgtggtaactgtgctctcccagatgctacacaacaaaaaaagcatagtatttctaaaatctgagactatttttcctaatacgtgtgtcttttttttttgagacggagtctctgttgcccaggctggagtgcagcggcgcagtcttggctcactgcaacctccacttcccgggttcaagcagttctcctgcctcatcctcccaagtagctgggattacaggcacccaccactaccacgcttggctagattttgtatttttagtggagacagggtttcaccgtgtaggccaggctggtctggaactcctgacctcaagttatctgcccgcctctgcctcccaaagtgttgggagtacaggtgtgagccaccacacctggctgcaagcattgtagaccagagtagacttaaagtatactttgttacaactcatgctcagtctgaggtcactgataaaattgaaactttctgtaagataacaaggaaatgaagtcttttttttttttttttttttttttgagagggagtcttgctctgttgtccaggctggagtgcagtggtgcgatctcggctcactgcaagctctgcctcccaggttcccaccattctcctgccttagcctcccgagtagccaggactacaggcgccctccaccatgcccggctaattttttgtgttttcagtagagatggggtttcaccatgttagccaggacggtctcgatctcctgacctcgtgatctacccgcctcggcctcccagagtgctgggattacaggcgtgagccaccgcgcccggccggaaatggaagtcttgagaatgaatgttggccctttctattcagaaaatagcctgtgctccagcatagcatcatcaccatctgggagctacctaggaatagagtctcaccctaccccagtggtaccgatatgcacattgaaaagaacgaatctagaacacttttcactccttttttattacttggcttgggaattacaaatttcggtggactttttggcaggagtggtttttgatgtttgtggagaatgttgaagactacagtgtagccacatttactttacattggaaataatacaatataaaacatgacattttatttgcaaaatttgaaataatgacttctaaattacaaacagaattaaaaatttcaaagctggcaggctggagatacatatgctgttctgaaatacgtgctttgaattatctgaactcttaatgcagatcatatatcttggcgtgatataaccattcttggttatgaaagctgagattaacattcaaaataccttgtgaatcaaggtagatctgtcatagttataatttttttccttgagtgttttaaggaaaatatgtaaacatacagaacagtctaatgaattcttaatataccttccaccaggattgccatgtttcattttatttttttgctgaaccatttgcaaggaaattgctgactgaagacaaaagacccctaagtatttaaatgtggatttcttttttttttttgaagtggagtctcgctccgttgcccaggctggagtgcagtggtgcgatctcggctcactgcaacctctgcctcccaggttacagcaattcccctgccttggcctcccgagtagcctggactacaggtgtgcgccaccacctccagctaatttttgtattttttaatgaatttagtatacaggtagtcatactaaccatgctgttattttcattcatatagattatcagttatattagaaataagaccttcctgtgttttattatttttgcatattgcatattctcttgattcagttctcagtaaagatgtattgaccttactgaagtcattttgaaatattaaatcttaacctaggtaaagcattctttaaaatattcctggtgtttgttggatacttacagattctggaacctttctttaaaaagtgttttccaaacagaagttgctctacgttagagtatgatggacttttatgtcgtaacacccccgaaacactttaatgatggcacaatgaaatgtgaaggttgagaatgtagagagaaatttctatgtaatttgggacttccaatggctaatagaccccaaaatatgtaatacaatgttcagtgaatctagaggtacccaattcattgattcttttttttttttttttttttttgtttttgagacacagttttcgctcttgttgcccaggctggagtgcagtggcgagatctaggctccctgctatctctgcttcccggttcaagcaattctctagcctcagcctcccaagtagctgggattacaggcacgtgccaccacacctggctaatttttttttttttttttgtatttttagtagagatagggtttcaccatgttggtcaggctggtctcaaactcctgacctctggtgatccacctgcctcggcctcccagagtgctggcaggattacaggcgtgagccactgcgcccagccccaattccttgattctgtttagttctgaattgctcttggggaagagaagggcccagtttttgcttagggttttgcagaagagctttgctgactcagttatctgtgtatcatgatgactaagtttcagggtagcattttgctatctttgcagaaggaaaaattacaaaagcattatgtattattagtgaaaagttgagaaaaatttaaaaaactcaaaaccccatcccatccttagatgtcaccttggtatgtaatcttctagataacttgtacatactttggttatgctcctccacgtcaatgtcacgtgtcatttaaattgcattccattggattgctgcactgaaataatttgtactcattgtcaggcacttgttttctccttttttactgttaatgtgtccacaccattgtttctttcagatgaattctcaaagttaaaattactgagtcaaaaaacacgcagttttaaaacttttgatgtaatgatcccgttttctggaaatgcagtatgggttcatacggaccatttattttgaccattgcttgcagtagacactgtaattaaaaatgtatttgcttgtttggtaggtggaacatggtacttggtttaatttatatttccttgatagtgttaatctttttaatcttcatatacctttagtattgttagtcacctgtttgtgtccttgggccattttttgttggtatgtgccaataacagtaaatgataacagtagcagcagcggcacttgttaagtgccagttaccatcttttccagtgttttgtgtaccttgtttcatttatgcttcattcctatcctgtgagacaaatactatcaatgatactcattttacagataaggaagctgattttcaaagagattgacttcccaaagaaagtgcatgccactagcaagttgttgatcttgaaacacatgtgtctaggctggttgcaggggctcacgcctgtaatcccaaattttggaggctgagatggggagatacttgaaaccaggcatttgagagcagtttgggcaacatggcaaaaccccgtctgtactaaaagtacaacaaagttacctgggcgttattttatttttaattttggtggagataaggtcttgcttacgttgttggccagtctggtctcttaactcctgggctcaagcaatctcccacctcagcctccaaaagttttttgtttatactctatttaaaatgtgacctcattttaaggttcggtcatagtggacatggcttgaatttgtgatgatacgggttttttttttcttttttatgatgtaatcttactgcatcgccgaggctggagtgcagtggcgtgatctcggctcactgcaacctccgcctcccatgttctggcgattctttctcatgcctcggcctcccaagtagctggcattactggcgcttgccaccatgcttggctaatttttttttttttttttgtatttttagtagagatggggtttcaccatgttagtagagatggggtttcaccatgttagtcaagctggtcttgaactcctgtcctcaagtgttccactggcctcaacctcccaaagtgctgggattacaggtgtgagccaccacacccagccaaggataggtatttttgtatccactttcagtttacttcaatttggaagtatgagttacctaaaattttgatttatttttttaaacatactcagttgtgctaaaaatgaaaccagagtgtaacttttcggggtacaaaaaatagaaaactaaaccagagtataacttttcagggtacaaaaaataatgtaggacagcttcttatttgagattgactttactaattattattgttcaaaaattgaaatatgtcacgaaaaacttttgtattgaaggaaaattcggtaatgatgagactcatgaggttatgtcctatcagtgaaggatacataattgagaggggttgtttatactttacagcaaaatcaaaggctgaaattttcttaacgctggagctatatgtgatctttagtgattatgaactaggtagaagaggatgaaatacgaactgctaagccctgtacttaatgaaaagtccaacaagagttgtcaaaacatagaggttaggattacattgataaataaggattcttatatttacagttgacccttaacacaaggggtattaaggcaccagctgccagcaccccctcaaaaataaaaaatccacatattactttgaactctccaaaaactttactgatgagctcctgctgagtagaagccttactgataaagttaattaacacagattcagtatattatacattatatactgtattcttacaagaaagtgagctagtgaaaagaaaaagttattaaggagcagaagatatattgactttgttaagtagaagtaaatcatcacaaatgtcttcttcattgtcctcacattgaataggctgaggggaagatgaaggcttggtcttactgtcttgggtggtttaggctgaagaaaatccatgtataaacccatattgttcaaggtcagttgtaattgttcctgtatgtgttgacagtgccaaagtaaacagaaaagtagcatctggagagcatccagattattcctttcttttccaagggaactcaaaatttggagtactgtgttaaagggaaattggcagacttttatttgttataagacgacttttttttttttttttgagacggagtctcactctgtctcccaggctggagtgcagtggcgcaatctccagctcactgcaagctctgcctcccgggttcacgccattttcctgcctcagcctcccaagtagctgggactacaggtacccgccaacacgcccggctaatttttttgtttttgtatttttagtagagacggagtttcaccatgttagccagcatggtcttgatctcttaacctcgtgatccaccagcctcggccttccaaagtgctgggattataggcatgagccaccgcgcccagcctttgaggcatcatttattttcatagatggctaggatggggaagagtttgaatgaaatgttttgtcaaagaaaaatatagagccgtgtgctgcatagatgttttggtgaatgacagaccacatatattatggccccttaagattataatggagcaggccaggtgtggtggttcacgcctgtaatcccagcaatttgggaggccgaggcaagcagatcccctcaggtcaggaatttgagagcagcctggccaacatggtcaaaccccgtagtcaggcgtggtggtgcacatctgtgttcccagctactcaggaggctgaggtggcaaaatcgcttgaacctgggaggtggaggttgtagtgaactgagactgcgccactgcactccagccttagtgacagagggagactcctcaaaaaaaactaaaaagtaaaagagattataatggagctgagaaatttctgttgcctagtgacatcttgctgatcctgaacacctataggcttaggctaatgtttatgtcttagttttttcaaagtaaaaatgttagtaaactaaataaggttagtatattaaagaaaagaaaaatttgttttacaaacttactgtagccttaagtgtaccatgtttataaagtccacagtagtgtatggtaatgtcttagggcttcaaacccaccactcactcagtacagtcaccaaaagcaacgttcagtcctaaaagctccattcatggtaagtgctttatataggtataccgtttttgaaatatatatatattttttttggcgacagtctcgctttgttgccaggctggagtgcagtggtgcgatctcagcccactgcaacctccaccccccgggttcaagcgatttctcctgcctccgcctcgcgagtagctaggattacaggcatgcaccaccacgcttggctaatttttgtatttttagtagagacgcggtttctccatgttggtcaggctggtcttgaactcctgacctcaagtgatccacccacctcggcctccaaaagtactgggattacaggcgtgagccactgctcccagcccatttttgaaatcttttatactgtatttttactgtaccttttcttttttgaagtacacaaataatattgtgttagaacttagactcagcccttgttttctcttttgcttttttttttttttttttttttgagatggagtctcgctctgtctcccaggctggagtgcagtggtgtgatcttggctcagtgctacgtctgcctccgggattgaagcgattctcctgcctcagcctcctgagtagctgggactacaggcgcatgccaccacgcctggctaatttttgttattttagtagagactgggtttcaccatattggtctggttggtctcaaactccgtgttgggattacaggcgtgaaccacctttcccgccctgtgttagaacttcttatagtgttcagtactgtgcatgctatgcaggtttgtagtctgggagcaataggctatacgatacaggctaggtgtgtggtaggctacactatctagcttggtattgggtaactacactcttacgacattaacacagtgacaaaattgcataacgatacaattctcatgcatttccctgtcattaagcaatgtgtgattaattggtttactgatgaatgtaattccaagaatagagctaagggaagaattaaagagtcaactatgatttagaatcgtatatcattagattgtgagttctctgactttggcaattcaaaagctccaccattggtaagtgagaaaggataccttaaatggaatttttagcatcttttgagggacctcgggggaaattaaatgacatgaattagttttttacatcgagatgttttaagaccttaattttttatttgttgcattacatcactcatacattgaaaggaaacaattttgattataaaagtgctttatagagagaacttgcgggcaggcgtgggggctcacgcctataatccctgcacttttggaacgtggaggtcggcggatcacctgaggtcaggagttggagaccagctatggtcaacatggtgaaaccccatctctactaaaagtacaaaaaattatccggatgtggtggcgggcgcctgtagtcccagctactcggaaggcagaggttgcagtgatcgaagatcgcaacactgcaatccagcctgggcaacaagagctaagcttcgtcttaaaaaaaaaaaaaacttggaggaaatatgcagataaaaatagtatttactcatttacttatgtcatcagcactcagaggtaaccaccatcaacatttttatgttttgttctctgtcttatgtagctacaggtatatatatatgtatattttactaatatgtaattattatagtgttagaacctctacgtggtagatgttttccagtcagtaagtattctaccatgtttttgtttaatggctgtcaagtatcttttgtcacagatttatataaaagattcagttccaagcaaacatggaagtacttgaaattgaatatcctcagttgattaatgaatacagatatagggacctaccgtcccattgcttgataccttttattgagaattttcatatgagcctacaaaacgtgtactggtttagttagttaaaacaatggaaatgccagtttcttttccttcacttcattgcatgatcattgttacataagcagatttgacagaaaaaaagatgtaatcttttctttggaaatttggtgaagtgtgcaatctggtgtatatcatttttgaatctgctatatatagcatcttaagaaaacttttgaacacaatatatacatacatagaataaaccattcctgtgtaagccccactcttcggatagcaactgccatgtttgtcctctacacttttctcctgaatgatttcaaagtttgttgacatgatacttcagcaaacatgatacgcactgaagttaggagcttccatgtggctgcatctcctaagaataaaggaaatacatgccaccaaaatattatcaaaagaataatgaacatcaattcagtaattaaacaattgatagtaaaattatctagataaaaatgtctcttttgcccagtctagtgttcagtcagaattcacacactgcccacccccccacctctcctttttgagacagtgaggtggcttgatctccgctcattgcagcctccacttctagggttcaagcaattctcctgcctcagcctcccaagtagctgggactacaggtatgtgccaccacacccagcttatctttgtattgttagtagagatggggtttcaccacattggccatgccggcactgcttttttaatctagaaaaaggcccctagtttttattttttgaggtgtccaaaccagttgtattgtgattgcccacaaacttgaaattgtctgattgtttcccccatatatagattctagaaagatagcttggtgagaataatgcgtaggtgataatgcgtgtttaagtgtgtcacatcaggaggcatgcaatgttaggttgtcctacaactttctaactatgatcccttagtttaggttgagacctccaggtcttcattgtaaagatacattttccccctatgtaattatagagtatctgtttgcaaatcctgtactccactcaccaagttttacctggcgcttttagcatacatcgacagtactctcatatgttaaattggtgttaagtcctcaccaatgtaaataaattttaaataatgtgtcttaacatctttttgagacggagtcttgcactgacgaccagacaggagtgcagtggcacgatctaggctcactgcaacctccgcgtcttgggttcaagcgattcttctagctcagtctccagagtagctggaattataggcgcttgacatcacgcccagctaatttttagtattttttgtagagatggggtttcactatgttgaccagtttggtctccacctcttgacctcgtgatcttcctgccttggcctcccaaagtgctgggattacaggcgtgagccaccttgcctggccccacaccttattattattatatatgattatatttatgatccatttgtttggatttcctgccatttttaaattttgttactcttccttttgagagttgttttatttcatttgggttttgacctttgcgtgtgcagttttacacgatttgtatttatattaggatttagagtgaggttggttccaatttttgaaaaagatggctacctagtagtaccatgtattgaattattcattttcccaccatgatgtacaaggtcttaggtattcttagttctaatacttaaacatagcagttaacataatgtgttctaaaagtagccaactttgtttcttcataggctgaaaatgtcttagtaatatccccaggtattactgttttctcagagattactctcacagtatttaccttgagatactgtttttgattaaatgagctaatgattcttggcagttcagcaaattaaaatgcacatatttttccaggcattgttggcctctgaagaggccagagggaagtagttgaaagcaataagatccataggaagcagggtacaaaaatggtgaccagatagagagtaatgtgggatagggtagccggacctaaataggcaaaataagacttgaagtgtgttcaacaacttagatcaaatgaagatcatccaagtatgcagaggaatttatagtatccaaagagtattcagaaacttaagaaattgtgaatgactgaaaactttggaatacagaaaatttagtaaaccttttagaaaattgacaactcattgctgccatctagtgtcacttttgtctttgaaattctgcaaagaagggaaattttacatatatagcatatttagtatatagaattggcatttaatttgaattgaatgcaggggctactttaggtttttttgttgttatggttgtggtttttttttttttttttttgagacatagtcttgctctgttcccaggctggagtgcaggggtgcaatctcggcttactacaacctccgcctcctgggttcaggcagttctttgcctcagccccccgagtagctgggattacagacgcctgccaccaccaatttttgtctttagtagagacagggtttcaccacgttggccaggctggttttgaactcgtgacctcatgatctacccacctcggcctcccagagtgctgggattacaggcgtgagccttcgcacctggcctagttgaggttttaagatacagtaataaaggaaattgtaaggcagggttttgaatttccaaatctgaggtaatatatattttcctttgtctctagtgtgagataatgtctggtaagtgaaagtgacagcatgtttaatttttttctcctggaccattggataatgtgttttaagtataatgtgattaacccatgtggagaggtggccagggcttgctgaaataaatgcccagtagaaacatcttgtactttgtttaacttgtatacttttgcactaaataagccaagatatactgaaaacagttgggttgaacggcacctatctcctgtgacctgaactctatcaaagctggcatacagtgcccagataaaaaaggaagctgaagtcttgactccatgttcaaattcattttggctcagctctcagcaaattccagggctctcacaacctgtttgtggaccacttgaactttatttatgtaaaaaatcttcagataatgcaaactgccgtaccttttccaagtagaattgaattacttgagatttaaagttaatgtaatggtaatgaagtatttttataaatatattttcaaaattttagctagattgacaatccaagattggtttccctccattaaaagggtgaagaggcatgatagcacctcacacttacaatgaacagttggaaataaaatttacagtttggctatatcccaactagatagagtttttacttattttttgcttttaagctgtggctgggatggtgagagtgcgagtagaggcaaatttctatattcaggaaatttcttgtccttcccactactattaaaatcttgtatcgcttttattgcttcaggatagagcatatgataaaacagacaagcatatcagacaaaaacacagatttttgggcattagaaataacttagtattcctggttttgacttgttttctaggtaaaacaggtcttttgtgatcctttgattaaaaacaggaataagaacctgtaatgaaattatagtatataatatacaaacgcatttgtccatgtgtgtaatagaaatttgagtgctaaccactatttttccgctttttttgtcctttttctctcttgagacccagtctcacacggttgccaaggctggagtgcagtggcatgatcttggctcgctgcaacctccacctcacgggttcaagggattttcctgtgtcatcctcccaagtagctgggattacaggcatccaccaccacacccagctagtttttgtatttttagtagagaccgggttacaccatgttgcccaggctggtctcgaactcctgtcctcaggtgatttgctcgcctcagcctcccaaagtgctgggattacaggtgtgagccaccgtgcctggcctaattttaggtttttaaagtctatccttttcatgacagagcttttcatgacatgttgagtttaagaaagaaatagcacctaaggttctcatttgttgaggacattttttttttgaggtagaatctcactctgtcacccagactggagtgcagtggcgctatctccgctgactgcacctctgcctccaaggttcaagcatttttcctgcctcagcctcccgaatagctgggactacaggtgtgtgccaccataccccgctaattattttcatatttttagtacagatggtgtttcaccatgttagctaggatactgtctcgttctgacctcatgatccacctgcctcggcctcccaaagtgcctggctggaaatgtgactaaactactgcttcacttttgaagtatttaaccttctgatttacaaataatggaggctggaatatttgaactgtatgtttgtttgtttttgagacagtgtctccttctgttgcctaggctggagtgcattagcacgatctcggctcactgcaacctcctcccatgttcaagcgattctcctgtctcagcctcccgagtagctgggactacaggtgcaggccaccacgcatggctgatttttgtatttttagtagagatggggtttcaccatgttggccagagtggccttgaactcctgacctgatgtgaactgcctgcctcagtctcccaaagagctgggattacaggtgtgagccactgcacccagccccagatttcttaatgttaaatctagttcatgtaaattagtgccattttattatctaacagcattattcgactattacatactagtaaatggtgatagagtaggatccctgggttagcttgcattaaaaaaagaaaaattctagaccccttcaactagaagaggggaaatatgatgatgaggggcattgacctcaaaatatttgagtatatacaggtgcattaagacttggactattattactaatgtgattaaccttttaaaatttctaccaaatggattttctgttttaaggaatatttgtttggcttaaatgagtttttcctacagaaatcccaagcttgtatgtacattgtagtgaatttgggaaatacagagaaactgtgaaaatgattgtaaagattaatcacaagcagagtacccacagaacattttaagatattttgatgtgtttctgtactgtccgttcttaaatgatttttatgtagttcatttatgtctcctatgtattgtacgttttcagatactatttttttgactcaaattataatttgcacatcacttgaagttgtatttttaaaagactattattgctggacatttattactattgggttgttagttgttagaactcggttataaaaattcatatagaatatgaccaagtaatttagatctgtatgaggcaaaaagcaaaagtagacctattcattctacaagtggtttttacaccttccagatgtaaagggagtaacaaggcaagaaaatgggatcagggccgagtgcagtggctttcacctgtaatcccagcactttgggaggccgaggcaggcggatcacctgaggtcagaagttcaagatcaccctgaccaacatggagaaacctggtctttgctaaaaatacaaaattagccgggcctggtggcgcatgcctgtaatcccagctactggggaggctgaggcaggagaatcacttggaacagggaggcgtaggttgcagtgagccaagattgctccattgcactccatccttggcaacgagtgaaactccaactcaaaaaaattaaaaaaaaaatgtgatcaaggagtttgttttacttatctaaactattgtactactataaaaggatgctggcaacctgttacatgaaagaactgagggactgttcttaggatttctaacaacagtctgcgtaacatgttaaaagtggtgctcgagaaaccacaccatactacctagagagaaatggtattgtttaagcatcaataacaccacaaaaaggtattgccacttgtaggacgaggtagtcttgacaaaatattgcagatgaagctgagtaagccttggtcccagctgctgctttcaagagttacagaagaatatgtggaattgttctgagagtatcaatcctggaaaatacagactgggaaactacaagttaatactgtggattcttaaacagataaattttaacctaatgcaatagaagcggaacttacctacaaaaatgcttcaaatgcatcacgtttatttttctgggaagactagaatgtctatagttatacatttaggcattagaattattttaaaagtgagaaagtgctagtaaagtcataatggttgttaccttttggtgagaggaagggggattggcagtggaatcaaccacatagggtttgtttacttatgagactttacagggatgcaactgctcttgcaccttcacacatttttattgaagtcccttgtgctcacccactattggagcaggtgaaacttctaagttttaactgcttttctaaaatttcgttcctgttgcttttcaataaataactgctggttattttggtattcttgtatttctaagtctattattctccaagttgcttaccttttatttctcccacagtcagtgaaaccatatatgctggcttgcctttactgccttgcattttggaattttgatttaaatgctgtctgtaggatagtgattttgccatcttgagtcttattttgggagtcagagattcaaaaactactctgctcttgctgaccccttccaagaatcccagttcttttccagtagtttctttgtgttacagtatcgtcctccctttatggaaatttcacctgtatgatactttaaaattttgaagtagaatgaagtgtgacttgacatcatttggttatttctaaaacttcaggaaatgtacctcttccataaaatttgaagtagcaataccactggaatttaaggaagctctcaggacagtctttgttactatttgtgccctggattttccctgaaatgtggtactcagcacatggttagtaaatatttgatccccaaaatgaatgaatttgtagtgactgttcattccttaggaggacacgttactaagagtggaattaatccgtattgtgagtacgtctgtctttactgttgcctccatcttgaatttaagtcctcatagtaagtatgggtattttattaattttaggcaaactttggaagttgggatttttgtattttaaaaataagtagttgatgatttttgtagcaaatttaataaccagaccataaagaaaatgagaaatcatatccttaaactcataacaaccattgctagcatccttgtatgcctggatgcttttctactgagtttttcctttgtggatctttgagagaattaaggcctgatacacatgaaaaatgccgtggggtatgaattccttgcatcttgattagtactagctatgtactcagacttgtgaaaataatactagctatgtactcagacttgtgaaaattgagaaaatggtcatttaaatccatttctgtcttattccaaagggtacccctttcaatcacatctgtatttttctgcaaatgtccatttggaacattggactgtggtttgatgggttttttcccttatggtcagtattctgtgttggcttacggagcccctcacccctggtaatttcttctcattaaacctatggagattatattttctattgataaacctatttgtgaaaaatagttgcttaaaaccagattatacctccacttgtaataatgggaaatcttaataaccagcagtagtatctgaaaccagttaggcctcaatgcagatttttgttttaattcctctttttagtgtcctcagactttctggcatacttaatagctgaaaggctgttggtggatttcagtggctactgtttgttaatttttattgcttagtgttaaaatattaagaagtttttgtaaagatatactttagaaagtaacaaagacagacttttgaatttcagaaagatttggaaggaagtgaagttttgtttgagcttttaaatcagtactgcctgttaaatgactgtattaagcatcagaatgataggagtcatgtatatatgaaatggtgttaaactacctgtttttatgtacatatatgtatacattagacttttttacatcatccgtgagaactagtttgtcatgattcacttgaggattggaaggataacaaatactggaatcttttgagatttatcagtacctttcaaagggatgaaggggaaatcaatcttaagaatgtttttaaatcttgttcaagattgggggttggagtgggaagaggcaggaaacaaaatgctaaaagaatgaaataaaacattttcgctttacgggacctgagatggtattgtgaatctgcatatggttatggtaggattgagcctccatcacatacataaagacagataatttttggttttaaataatgcgtggaaagttgtgtatttttctttaattccccaatctttaatttgattcatgccgtgttccactggctagttttatcatcatcaccatccgatattattaaatgtcctatattttaggttatataaaaagtagccttcgagtcattgcagtctgtaaaaagatggtattgatacttatgtatctaaagcatactgcagattaattgaagtatctggaaataggtgtttccagtgtaaatgaattgattctatttattgccttttgaagaaaattatacttaatgggtaagtgtaagctatccatattaatctagctaatgaatggcttgggacagaatttgacgtttgctatgctgtgtgtatatatacagaaccggtgaaactcaataaaagcaacgtgaatcaagattattgatggcagggaatagttagcatgacctgtaatgtgaaaaacagcagaaactggtgtcagagaatttaggcaaatctaatttgcttgagtacttagaggagggccacttggaattatgtccaaggaaattatattgccaatgatctgccagggagaatttttttttcctgagaatttagagtttagtgctgctgaaatagaatggaagaggaagaagttgactttctagagtatattcagaggctggagtctctgaaattattagcaaatacatacttaatgctgtgagtccctttaagttgcctaatactctgggcagttaacagtgattcagagtgagagtggagaatgttttatcaaggaatattgtttttagcatctgttcacctgtatacttttttttgctttacagttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttaggtaagtgaattttttcattgatgatgtaattcaggcctgagtttttctattcacgttttttttttgtctttatgtctgtaaaactgacagcatgagatattctggatattgcgactgtttagcctaataaaaatacattaggcttatagttataattggctaagtaaaggatattcttcattgtaccattttgtgtagtagagctaggacaactctactacaatcgtgagtagggggagctgggaatgacacttcacaatgtaaaaacgttgcctaaatggttgtgtcctgcccacagcagactggaggagccctctagtgttgattgcttgtctccccattgggatttcactccatccgttgggccgactgcagtttggctcagtgttagattttcttgtattttaaaatgtaatgacacctcagagtacttactacctatgatttggtttattcaagccagaatccagtgtccacatgtttattttattagttgtactagatgtctgttttaacttctcattttatgtgtaccttgtgcctcagtttcaaaattatcatacctttgtttttacaaagttaagatgattatttttaaatttatatttgtgatttagtttattctttgtatacattctactatgtatattgactcaaagcatggtaggttagagttatgtgaaacaattctttgataatgttatgtaaccaaccagatacataatttgggtctatttcattgtttttacatcttactggattgctttttcagaaatttaattctctttagttttgaaacactttatatggtttcaaagtcagaattgtaaatgaggttaatgtaccaaaacctgaaggttattcatgtaatggtgttcagcaaatagacaatatattcagtcctttttttttttttgagacagagtctagctctgttgtccaggattgtgtgcagtagtgcagtcttggctaattgtaacctcagcctcccgggttcaagcgattgtcctgtttcagcctcccgagtagctggtactacaggcatgtgccaccacacctggctaatttttgtattttttagtagaggtgaggtttcaccatggtggccaggctggtcttcaactcttgacctcaggtgatcctcccgctttggcctcccaaagtgctgggattacaggcgtcagccattggacctggcctgagtcagttttcagttggtcatttgatgagctgcttttgtataaaaagggaagataaataagattaagtttaagatatccacatttggccaggttcggtggctcatgcctgtaattccagcactttgggaggcttgagttgggcaggccatgaggtcaggagatggagaccatcctggctaacaccgtgaaaagccatctctattaaaaaataaaattagcaggctgtggttctgggtaccggtaatcccagccgctcaggaggctgaggcaggagaattgcttgaacccgggaggtggaggttacagtgagccgtgattgcactccagcctgggcaatggggcaagactctgtctaaaaaaatacccacactcatctagttaatggtttgaggtggaatttggaatttatattttggggcatttgtatattaaaatgaagctcattttaataaaagcagtatatatgaaaatggagttactgttgactcgagtgctgtagcatgactgggaaggtaaactgaattttagagagtttttggctttttgacatgggctttttagaacaaggagaagataaattcttgtttggtaggcagtgggtggcagggtaggtagctgggcatacgtgttacaaattgtatttgaaaaccagggttgtttccctttgctcttttattttttttggtgtgtgtaaaggttgtttaagcaattgatcaattattcagaaagcagtcgttaacccaggatattttacgtgtagaacagctaatccttacttataaagaaaatctgaagttgcctttgaggatgatttgaggttgtcacacttcactatgttaatttgtgaattggcatatattttaatatatttcattctaatatatttgtaataattcggaatgagctgaaccattcttggaaaggcaaccagtgatagttttctcttgtaatagtaactgagtgaacagtcagtaccttgaatggggagagttgagttgaagtggtatctgagggtggagagtaccaaagacagacttaatgttagtctcaggaacacttgaatggtaaagaacagactacaaagaaacggaagatgaagccttagccttgtaaaaatttgtgagcctttttaatattaaaaggagagatgaagctgagcttgatagctcacacctgtgattccagcactttgggaggtcaaggcagatcacgtgaccccaagagttcgtccctacgaaaaatagaaaaattaaccaggcgtggtggtccctgctacttgggtgggaggatcacctgagcttcggaggtctaggctgtattgagccattattgcatcactgcactccagcttgtatgacagtgagacagtgtcttaaggaaagatgagttgttttgttccacattttctaatttatgtgtctgtgtgattttctaaacttcgtagtttgtattagctgggcatggtggtgcccgcctgtagtgacagttactctcgaggctgaggcaggagaatcgcttgaaccgggaggtagaggtttcagtgagccaaggtgacaccactgcactccagcctgagcgagaaagcgaaactatgtctcaaaaataaaaaaaataaactttgtagtttgttttacccggatacaaagttgtcattaacatttttacttttgtttttcagatattaacctggctgcagagccaaaagtgaaccgaggaaaagcaggtgtgaaacgatctgcagcggagatgtacgggtcagtaacagaacacccttctccgtcccctctactcaggtccggaactttattatttataactgcattgtgtccatcagtgggcatcttctctttctgttttctgggtgtggggaggtttaagtgtactgtgttttatctgtgtataaataaggttttattatttttgtgttaatatgtctcttttttgccctagagaaaatttctagagaattaaaaatccctgaggtttttgctattgatattaaagagtagtttgatatttatagcataacctgaaatacttatacaggatcgttgagcttctaagacactagagagtaagagagggtagaagtgtggtataagaatgcttagtttaccattctgtttttcagtgtttagtttagctatgtcgtatgtggaaatcttagcgaattttaacctgaatttccaatttgaccgctacatttccagtggtctaaggtgattggaattgagtgatttattgtatgaatgattggggatcattcagtgctaatcttgttgatctatttgttgtggtttatttggcatggttctcccctcacctgacattgtgaattagtagaaacatttccaaattaacccttttcggtatttatttttcagctcctcttttgacttggactatgactttcaacgggactattatgataggtatgttaaaatgttttgtatttctgctaaacagctatttagtgagaaccatttcgttcttctggtttgtggtgatgaacatcaaagatgttttcaaacatactcccctaactccaaaacaaaaaaacacctttttctaaatcattaagtagattattaggtagggtgatactgattttaatgcattatttcataatccctggctaacgtggtgaaacccgtttctactaaaaatacaaaaaaattcgctgagtgtggtgactagggactgggttatgggtggctttgggtaacagatttagaactgttgatagcaaatgcttaacaggaaataggatgatgtgcttaagagtgttaccacattgacattctgataacatcagtctcagttaacatgaaggaaatgttaagacttatttggcttgtcgcgttcaaactcatgcagtatatgtaagtatatggagcaaactattgtatgcaatagactttaaacatgcaatatataaagcatattactttatatactatttgtcttataatgccagtattccagtcattagtattttaatgttattactgtatataacaattcagtctgattttggaataaaaattactgattggggaatgcttaacatttgaactgagttaatcagtcatgcatgggagttgtaaaggaatcaagtcagccgttaaataccataaagtatacactgaaagtgtcagacatgaaagtatagactttctgtttgagaaataacctcacagaatatggtacgtagtcattagaaggccagaagagtaaggcccgaaaaggaattcaaatccagattgtaaagggccttgaatgccataataaaatggtgtggttgagcatcattaatgcatcatcaaaatgtttttttcatttgacattagcggtttcctcagatttttttttttttttttttgagacagtctcgctctgtcgcccatcctggagtgcagtggcgcaatcttggctcactgcaagctgcgcctcctggcacagcctcctgagtagctgggactacaggcgcccgccaccacacccggctaattttttgtatttttagtagagacggggcttcatcgtgttagccaggatgatctcgatctcctgacctcatgatccgtccgtcttggcctcccaaagtgctgggattacaggcgtgagccaccacgcctggcctgattttttttttttttttttttaaatacggaattttcctctcgtcaccaggctggagtgaagtggcgtgattttggctcactgcaacatacgcctctttggttgaagcaattctcctgcctcagcctcccaagtagctggggttacaggcatgcaccaccactcccggctaatttttgtatttttagtagaggctgggtttcaccatgttggccaggctggtctcgaactcctgaactgaggtgatctactcgccttgacctcccaaagtgctgggattacaggtgtgagccactgtgtccagccctttcctcagatttttacagttatgtgtgaacattttgaaaactaaggagttctgtaattcttcatttttatttttgttgaaatttttgaaattcttaaaaaataaaaatcagctgggcacggtggctcacacctgtaatctcagcactttgtgaggccaaggcaggtggatcatgaggtcaggagttcaagaccagcctgggcaatatggtggaaccccgtctctactaaaaaaatacaaaaattagctgggcgtggtggcacgcgcctgtagtcccagctactcaggaggatgatgtaggagaattgcttgatcccgggaggtggaggtttcagtgagttgagatcgcgccactgcactccagcctgggtgacagagtgagactccttctcaaaaaataaaacaaaataaaaatcaatggagaacttccagttgaaaataaatcaggacattactagtgaactcagcccatttattcctgaaattgcaattttttgaatttttgcaatcagaccttggtaatgacctaatgcagtaggatataaataactccgacaagcttagcattccagtaatggaacattaggcatagatgggttaattattggtcaggtgtcttgaaggcactgaaacccagtgagtttgtctgaagcatctgccctttaaccctttctgcacatggtaattgcttgaccacatttaaaatatactcatgccagcttctcctatagggattcttacacaactggtcttatgcagactttcttaagtactagtatatttttcagtgctttctatgtgttcttttgtccagtcagagttgagaatcattaataaaagattaaggacgtggttgtgtttctgtgtattattatcctatttctttgtcatggctcaattcagaccagtttaataaactcacacttttgttggtataatttcagggatgtcatggactcttagttgatgttttttatgagtgtatcaagttttagcagtatacagtgacagtcttcttgaaaatagttctcattaaaaagtcttttcttggcaaggcacattgtgaatggggaaatttgaaaatttgagcagggaatttggaaaacattagttgagacaatgagatatatactgcagagaaatctaaagaaatcacgtttgcagaaatatcttcacagaaattggtggcctcttcagattttcaatagacaacaatatattaggtttgagcaaaagtaattccgtttttgacatttctttgaacggtaaaaagcaaaaccgcaattatttttgcaccagccgatactagtagttactgtcggatatattgctgcatgttattgtcagtgaaaagtaatgtcttctattgttctaacgtcagccagtagataatgattactgataactagtggagcaactaggtaatagctggcaaagagctgacttttagagtactgagatctttgttgggaaaatgaattttaggaggtgtccacatgatgggaacttactcaagttgggttggagaattgaggaattgagtgtgtgtcttacatgatagatgttaatgaaggtgaaaggaggaggagtgtttgtttagtggggagaggggcagatacaggagttttttgctggtttggaaaatgttaggtcaatttggacctgggaaataggttgggtatgacctggtggaataacaacttagaaaaatggtattaatatcttctaagaagtcattctgaagattcattatcataaggtttagatttttattttaaatggtaacagcgatacttcattgactatgttaaattgtttaatcaaagaagatgggaaattggctctgagtgaaagctctgggtcttcatatgtaaatcggagtaaaaatcactgtcccccccccccctttttttttttttttttgagatggagtcttttctggcactcaggctggagtgcagtgggttggtcttggcttactgcaacctctgcctcctgggttcaggcgactctcctgcttcagtctcccaggtagctgggattacaggtgtgcaccaccacacacaactaatttttgtattttcagtagagacagtgtttgtccacgttggccaggccggttttgacctcttgacctcaggtggtccacccgcctgggctcaagggatctccctgccttggccacgcaaagtgctgagatgacatgtgtgaaccactacgcctggccctctttttaatattcatttgaaggcgctggttttgttttgcgaaaggtgttgtaataaaagtgaatttttatcacaatgttgggaatgcacaagtattcaaagctgtagttgttgaattaagcgagattgggaagtactctaaaaatagatctttaagtccttaggtaggctggcatatacatgaaattgatgttcgtcaacagctaccctggtactattctttctttcttttttttttttttttttcttttggaaacgagtctcgtgctgtctcccgggctggagtgcagtggtgcagatctcggttcactgcaacctccgcctcccaggttctcgagattctcctgcctcagcctcctgagtagctaggattacaggtgcacaccaccacacccagctgattttttgtatttttagtagacatggggtttcagtatgttggccagactggtctcaaactcctcacctgacttcatgatccatccaccttggcctcccaaagtgctgggattacaggtatgagccactgcacctggcccaacctggcactattcttataattctttaaaaaattctcataaaagtcttgatctatatgtgttttctgatttgtgccacaaatactgcagtgttttcatactaaaactatatctagatataaactagatatattttcttcagattgtaataaattggaaccccactttcccttataattgatcacccatgaaattgttctcaaattagataatggtgatattgcagaactaataaaaaccacggagtggcacccttttaaatggtgaattttatggtatgtgaatgacgttttgattgaaaatggatgcgacattacaattgaaaaaggatacatcactgtcttatggacagtcattcttttttgtcatatctcgtggaccctacctacatcaggatacttgccagttagagacatagatgaaacccgtctggtgctaccagcctcaaaaggtaactcttacgcctgaggatggacaccttttagaattaaaagaactctcagtcattgtgggacatcttgctagccttcatagagactgatttactgtcagctcttttcttgagtcgtctcatctctctctgtttttttttttcctttttttgagacagagtcttgctctattgcccaggctggagtgcagtggctcgatctcggctcactgcaacctccacctcccaggttcaagtaattcttgtgcatcatcggcctcccaattagctggggttacaggtgcctgccaccatgcgtggctaatttttttttttttgtattgttagtagagacggggtttcaccatgttggccagactggtctcaaactcctgacctcaggtgatctgcccacctcgccctcccaaagtgctgggattacagatgtgagccatcgttcctggcctctttaattcttatttggagaactttgggcaacacgaaatagaaactgccaataaatggcaggtttgataacaggctttattatgacagcggagacttggtgagcaagaaacctggttcaaaaagactggtttagttcaatggtctttctgaggactttttaaacttagcacattttgtatgtggtgcatgactagtaatacagtatataagtaacgagtatgaaattcttagaggttttcagagtgctgttattactccatggctaaatatattaatatgtcagtgcattagaaatagacaaatcttcaagaactcacaggtcaaagatgacacatgtaacaaagattgagttgtgaggggccttgatgtgtttgaggagcagccagctgtaaagtaaattgtaaagaatgttagttgtaaagggctttgtattacatgttctgggattgtgtcctatagatggtattttagaaacaggcctgtggctagaggaaaaaagatgtgttaaatggtaaacattgtaaatgttggaatggagaggaggttgggagaatttctgaagtagattggtcttgatgtgattggttggactaaaggtatgaaagtaggtgcttgtaggaaaataatagtcaaaagctgagattttgtcttcgtgactagatgatagattatgccattaatggttacatgaaggggggtttcacagagtttgtgctgtcagaatttcaaggagacaagcaattttgctgctggttttattctacctgacttttctaggaatgtatcttggtagagagagaaaattagttgaaatgaaaccattgaaattcaagacagaactgtcaaaccatcatttcttcaactattaatagttaatatccctaattttgttctgggcacacaaagcctgaggctttggattaacaatatgggttgaaggagaaccttcaccttactgagtttagattagcagacactttgacctccttttctatttttcagatgtttttgagtaacactgtacctgagagatgggtttgtttatatatatgtatgaagggagagagtgccaaaatacttaggttatttgaagtttgaaaactggggacattctgcattgaaaggcatgtgtttcacagagcaggagacttctaggctactttgaaaagctaacagatgactctcagaggtgtcattttaggtggagagggtactctgggcttggaagttttggatttgctcacagctccactgttaattatatctttcttttgggaacctgtgtatcatacatataggtgccagaaggattttagatggtgacatagattagtatacacttttggaacaaatcagttattagtcttttttgtttgttttttgttttttgagacctgatgtggctctcttgcccaggctcgagtgcagtggcgcatcactgctcacggcaacctctgtctcctgggttcaagcaattctcctgcctcagcctcctgagtagctgggactacaggcacatgccaccatgtctggctaatttttgtgtttttagtagagattaggttttgtcatgttgcccaggctcatcttgaactcctgagctcaagtgatgtgtccaccttggcctccaaaagtgctgggattataggcatgagctatagcatctggctggacttaaattttgctaaatatttatttcttagtattccttttagattagtttcttattgtgtcctagactcgtttagtaggtgggagatatttctttgtaggagaggcatttgggtctgaatcaatctgctgtatgactgagttgagcggtcttgattccatttttacccaacactaaggtatcctggtgttttatgaatcttcttgagggcattcttcaggtagattttgttagcctccttggtgttgcttttctttttgagatggagtctcaccctgtttcccaggctggattgcaatggcgagatcttggctcagtgcaacctctgcctcctggtttcaagtgattcttctggctcagcttccggagtagctgggattacaggcatgcatcaccacgccgggctctttttttgtgtgtgtatctttagtagagatggggcttcaccgtgttgggcaggctagtctcgaacacctgacctcgagatctggccgcctcagcctcccaaagtgctaggattacaggcgtgagccatcacgcccagctggtgtttttgttttggtttttttttgagacggagtctccctctgtcgcccaggctggagtgcagtggcgtgatctcggctcactgcaagctctgcctccctggttcacgccattctcctgcctcagcctccccagtagctgggactacaggcgcctgccacaaggcccggctaatttttttgttatttttagtagagacgcagtttcaccgtatttgccaggatggtcttgatctcctgacctcatgatctgcctgcctcggcctcccaaagtgctgggattacaggcgggagccactaggcccggccatagcagcatttttaaagatgtaccagaaaaactcaaatgtccatcaactgactaaagaataaacaaaatgtagtaaccataaaatgaaagaagtactgatacatggtacaacacggatgaaccatgaaaatattctaagcagacaaagccagtcacaagacacacattgtacgattccatttatatgaatgcctaaaataggcaaatccgtacaggaaaaaaaaacaaaaacaaattctgccatggagattggtatgcaaatttttgtgtggtcatgtgttttcatttcttttgagtatatatacctaggagaagtgctgggttgtatggtgattatatggtcaacctgaccaacagctaaaagtggctgtacccttttatattcccatcagtcatgtggaaggttccagttgctccacttacattcatatctgtcttttgcttttatccattctagtctagtgagagtgtggtggtatctcagtcaggatttaattgcattttgtttaaaaatattgaatgtcttttcatgtgtttttcagcttttttttttttttttttttttttttgagacggagtcttgctctgtcactcaatctggagtgcagtggtgtgatctcaagagccccgtctcctgagttcacaccattctcctgcctcagcctaccgagtagctgagactacaggtgcccgccaccacgcccggctaatatttttgtattttttagtagagacgtggtttcaccatgtttgccaggatggtcttgatctcctgacctcgtgatctgcctgcctcggcctcaaagtgctgagattacaggcatgagccaccgtgcccagcccagccatttgtttactcttccacacatgtattcagattattacccatttttgtattaggttgtagaattagttgtaggattcgttatatattctggaaacaagactctgagtacaacatctgatactgttagaaaattttaactgtttcttataattccaccatcctgctctgtagttataggagatatgtaactatccatttgtgctaagtcgttttgtagagtttttaaggattatgggttttgtaatagacagtaaattatagattactggactctggtaattacatataagcggtagatggaagtttgtggaggcaacaaactagaacattgcttgctgttcagtagaacatttaagttcagtggccacatgtgactagtgactatagaattggatagtgcaggtctagaatgctgcaaaaatcagttttactgggtagaataagtctagagttgtgtaagttataagaaatgtaatgactaaagcctactcttcaggaaggaaataacccagactgcagttgtagagcgaatgttgaaagagtaaataggagaaagtcatctgtagaaataaactggtatttgtgatgtccttacagcaggcatatgatttcacctccaaattcacgttcatcacaggcacaatagctgtgttttttgcatgttttttgtttttttgagacaggatcttgctctattgctgaggcaggagtgcagtggcacgatctcagctcactgcaccttttgcctcccggtttcaagggatcctcctgccttagcctcttgtgagttcctgggaataccggcgcgccaccatacctgactttttttgtgtattttagtagagacggggtttcaccatgttgcccaggctggtgtcaaactgctggtattagccactgggcctggccaatagctgatttttttttttttaaataaataccttgaaaacagatagaattttttggtaaagtatgatattcaacttttattcgattttcattgggaagtcccctgctttgatctttattaagccagaaaatcaaaacaccaatcctggcttttcagctattacatagatagggttcggtttgttacacgttgttgattgtgtgatttatggattattatttcctagaagtcagttgggaacttcatttatttactcaacaaatatttgttatgatcctgctgtgaggcattgtatatagcaggaatactataataagaaatagaggccgagagtggtggctgacgcctgtaatcccagcactttgggaggccgaggcgagcggatcacctggggtcaggagttcaagaccagcctggctaacatggtgaaatcccatttctaccaaaaatacaaaaaattagctgggcgtggtggtgggcgcctgtagtacaaggctgaggcaggagaatcacttgaatgcaggaggtggaggttacagtgagctgagattgtgcccattgcactgcagcttggacaacaagagcaaaactctgtctccaaaaaaaaaaaaaaaccagaaatagatggcctcagagaaaaggggttgggttaaagacatcacgtgacgcataaggcataatgtctttagcttttactttgaatgagatgggaagctattagagggctttgtgaagagaatgggagggtcttactcatattttaacaagatcactcttactgagaaagataatgggtggctgttcagagaagcagtgatttttggtgggaccagagaaatggcaatgggagtgatgaaaagcagatggatcttaaaggtgttgctgagaaatttgcttatgttgtgaggcttgagagaggaatcagatgtggccagcgtttttgtctggacaactggaattatggaatttacagtgacagtgattgggaggagctaaggtgaggagcagatatcataaatcagttgtggacatgttaaagttgatccgtttggagagatattaagtaagcagttgtttatatggttctaagggagtcatctgcttagagtttataaaaccgcaatactggatgattggaaacagaagagagattctgggggtactgtgacctttaaagaatgtggcggtaaggaagaaatgagcaaaggagattgaaaatgccaaaatgaaaaaaatggagaagcatgaagtatcttggaaactgtatgaatatatgtcaaaagagtagaaaggcaaacaaggtctttcatgtcactaatagttgaagtagtatgagaatttagaaaacgtctttttgaattagcggtgtcattggtgacctttgacaaaggtaggtactgttaaaggcagaaatcttacacagatttcaagtgaatggaaagatagaaattggagtcagcatagaaaacacacaataaaattcacccttttggtgtataattcctacatcagatttgatttacaaaatgcatagtcatataaccataactataaccaagatagaaatagttcccagttctctgaaatgcaccttcactctgttgcctagcaatcatatctgttccttaaaaggaattttattgtaagtgaaagaacttcttactcttctatgttgataaaatgagaattttaaaaatatgtaattttttttcccctttctttttcttcttttttttttttttttgagaaagagtctcgctctgttcccagtctggagtgcagtggtgcggtcttggcttactgcaacctctgcttcctgggttcaagcgattctcctgccttagcctcccaagtagctgggactacaagcatgtgccaccatgcccagctaatatttgtatttttagtagagatggggtttcatcatattagccaggctattcttgaactcctgatctcatgatctgccctcctcggcctcccatagtgctgggattacaggcatgagccactgctcccagcaatttttttttctttgtctcacaggctggtcttgaactcttgggctcaagcgatctgcctgccttggccttccaaagtgctgggattacacatgagagccactgcatgtgactcaatttcagtttttttttttttttttttttttttttgagagagagtttcgctttgtctcccaggctggaatgcagtggtgcgatcttggcttactgtaacctctgcttcccaggttcaagcagtgcctcagcctcctgagtagctgggactacaggtgcatgccaccacaccctgctgatttttttgtattttagtagaaaccgggtttcaccatgttggccaggctagtctcttaactcatgatctcaggcaatccacctgcctcggcctccggaagtgctgggattacaggcatgggctaccatgcccagcctcaattttagttttttaaaaaataaaattgcaccacattgtcagtttaaaattttatctttggtaaagatcaacactgacatatgggagtatgtgtattgttgaataccatgacaaatgagtaatgttaaagttatttgtggctgcacacggtggctcatgcctgtaattgcagcactttgggagggtgaggctggtggatcacttgaggtccaggagctcatgaccagcctggctaacatggtgaaatcccatctctactaaaattacaaaaactagcttggcttggtatcgtgtacctgtaatccacgctacttgggagactgaggcatataaacaagaaaagccagggattttttttttccctttcttaaaacagtcttgaatccagtcaagtttcagaattgatgattgatctaggactcaagcaacctgcctgttacagactagattctttttgactgagaaagttttcaggtgcattttcaaattgtcttcccatgaaatgtctggttttgtgttaagatagtttcctaatgaaaccatcaagacacaccactttttcccttaatatgcaacatttcattaagatgtcaaattttattcctcttaaaataagtatgtacatttaatgtattttttcttcgtggagccattttcaatcaaatggcttagaatttacaaaaatatccctaaatactaatatttgtaattctttctgatagaatattacagaaccaattattgattgatgccattggctcagtataggagctattgctacctattctttggtagtaggtatgtttatggtgttccccaacccatatcagtgatctttggacaaggctaacccaacaatgtggtaataatctatttccattttttcccccttaattaccagaattatattttctttaaaaattatgttagagtttccccatgtggtgaataccttgtatagctccagtggtgagcaaatgagcatactggtttaccatttagtcgttttatattttaaatgagtggtgcttgcagttgatagtatccgggtaaactgatgctagactaagacagcatgtttgtggtgaagtacttgcaaataacattagaaatcattgatttcagtttagaaataaaacacaagctacaaaaattttgctggttgatttatttttaagcacaaaatcaagaattccaactatgttacgaacattttgaggcaaggactacttcctcagatgtgaatgagagtccatttctgcctgagcagcattctttgtaactaaaagccccaccggctgaaatattttgaaatatttttcttcagaaaagtagagaatttgactcctaattgtgttcatgggactgttaacatagattcaaaacagaactattacttgcttcattttggctatggtcagatgaaatagtaggttttaaaaggaaattccagtgatagtacggaactagctagctagctagtttaacggatttattgttttcggtcacaatttgacatattgttatttaaattttaatgtaaacctgtgttaaacttttttatatcagtttttttatctacatagttaagtttgaggcagatgtctgtcatcagttggtagttcatttaactagtatttactggagatagaatggaaaaaactgctcctttggttctcttaatttttgttttgtgacggagtcttactctgtgatccatgccggagtgcagtggtgggatcttgactcattatgaactccgcctgttaggttcaagcgattgttgtccctcagcccccggagtacctgagattataggaatgtgccaccacacctggataattttttctatttttagtagacactgggtttcaccatgttggtcaggcccgtctccatgtcctggcctcaaatgagccgctcgccttagcctcccaaagtgctgggattacaggtgtgagccaccctgtccggcaaaacagattatttcaatctgttcacatttttaagatgagaatcagctgtggtccattaaatggtccatgtaccaaatgatagctttattattaatagattaacgtctactctggtgtagtgttgacatgtattactaggttttttgagacccaggaaatgtcactgtttgcagctaatgtcttatggtcagaatttccatttaagaagcttccctttgaaaacctcttcttagtacatgtcttgtaatgcttttactttggaattggggtagacattctttgtctttttttttttttttttttttggtggtggaggagacaaaagtttttactctgtcgcccaggctggagtgcaatggctgtctgcaacccccacttccttcctgggttcaagcaactctcgtgcctcagcctcctgcgtagctgggattacaggtgtgccactgcatccagctggtgtgttttgttgttttttttttctttttcttttccttttctttctttcttcctttcttttttttttttttaagacggagtcttgctctgtcactgaggctggagtacagtggaatgatctcagctcactgcaacctctgccttccagattcaagcaattcttctgcctcagccctcctgagtagctggaattacaggcgtgtgccaccatgcccggctaatttttgtatttttagtatacacggggtttccccatgttggtcaggctggtctcaactcgtaacctcatgatccacctgcctccgcctcccaaaatgttgggattacaggcatgagcctccacacctggctggtgtattttgtcttaatctgttcaggtgattaatgtctctagagtgttttaatttcttaatctgactagattttataccaacaccatcaagtttgattatgggtgcagttacaattctcctagggtttagtccttgttcccctggtaaaagattttaaacagcctagccttaatcagtaagtaatcagctattgttgcctcatctattgtatagctttctcatagtgagaatttccgcttaatttttagctggtgcttgaagtagtcatactgagcttcttaatatatatcccttttaacttaaaggttgtcacactatgtatgttttttttctattttcacacttaccgtcctcaacatttttcgaggcaaggactacttcctcagatgtgaatgagagtccatttctgcctgagcagcattctgtgtaactaaaagccttaactggctgaaatattttgaaatatttttcttcagaaaagtagagaatttgactcctaattgtgttcatgagactgttacatagattcaaaacaaaactgtattacttgctttattttggctgtggtcagacgaaatagtaggttttaaaaagaaattccagtgatagtacagaactagctagctagctcattggtttagatacgggtgccggtgaaggtttgtggcttaggaggtagattagatatttatttccattggactgaggcttaagctcagtttaatgctcatggatatggataacttattttgattcacctccagaaattgtcgttaagcaatttgtgtttgtgcaagtgttaccatctctcacaaaggatatgagtttctgaacactgatattttatagtttctgtatcattatactttgcaagattttggtcaaaaagaccaaaagctttatgtcaaaatgggaaagtagtgataataaaaagttactcagtatctttttctttgcattaattcccatgaatggattaaactaagagattaaccatacttaggggaaatgcaaacttttttctgttttctttttttttgagacagtgttgctctgttccgcatgagtgcagtggtgcagtcatggttctctcacctcctgggctcaacctgtctttccatctcagctttccttgctcttttaatttaggaaaatgttcctgtccatagccactcctgggacaagattaaacattgctttgttgaaatagtgtggaaacacttttaagttaacagaggagagaattagcaatgagatcttgtaaatgttttcactacaggaagattggagatattacaactcagaataacttgccactattgtatatatataagagggagaatcatgacaaaggtgattaataatatttttaaagttcttgactatcacatttgttttttaagaaatatttggagttagaacagttggtaggtgtatttttatagagtacctgggcctttgcattaagttagttgcatttttaaaaagcttgcagaattgaagaccttttcatacgttgccataggttcttatatggaaatgacaatgtggaatgtagaaagtttagaactgatgtccatgtaagaagtattttgttctgttttgaattttctctttacaaatgtaagtgtaccaagccactgctttggtgtatctttatcaatcactgggatactaagtttaagacatttgaaattaagatttctaatagaaacagcaattagttgagcaaccagtgtttattgagtgctaagtgtgtactggccagtgaatttagacataggtgagtagtgaacaagatagacagtggtctctgccctgttggaattaagcgtaaatttagttagaaatgatactacctgtttttatatgaggtattttttatcagtagtatttatacccagccaacacattttgctatgattccctcagttacatgaaattgccctgattttatagatctgaaattttatatggttcaaccttatatcactagttgtaataattcgtgtgcttctgtgggtgaaaagaatcagagatttcgctaatgccatataccactgtttatatacccttttaattggaacattttaaagagtatttgaccgtatgtgaattgtttattgtaatgtatatttgaaaataataagatccaaaggctattcattataataaatgccctgttaatactgacactagtacagaggaatcatttatatccagtgccaaaggccagccaaccatataatttgatatatgttttattttcctgaggaaaagttgctacagtattacaactattttatgtgcctaggtaaagaaataatgggataagatttctaaaccccactgtggaggtttttgctggccttcttaatgaaatttaataaaaggaaacgactagagacaatattcacttactatttatcataaggtctgttgaattgtgctgagttaatgttaggtttgaatgaattccattttcctcttatccaataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagtgtatgtattatttcattttgtgattttggtatctcttgtgttttgagatagggaagctaatgcagttacaatatttttgtgccacatgactttgtgtattcaaaataatggaagaggctgggtgtgtggtggctcatgcctgtaatcccagcactttgggaggcccagcgggtggatcagctgaggtcaggagttcaagaccagcctgtccaacatggaggaaccccatctctaccgaaaatacaaaaaatttgccggggatggtggtgcgtgcatgtaatcccagctaattgggaggctgaggcaggagaatcgcttttacccaggaggcggaggttgcagtgagccgagatcatgccattgcactccagcctgggtgacgagcaaaactccatctcaagaaaaaaaaaaaaatccaaaataacagaggagacaagattgtgattgagtggccaattctagactgcaacagctaggtaatttaaaaaatgtcatttgactttatgtagttgaggtgtgcgttaagttcctgagatttttttgtgttatttaaaaactaaaattcagacagtgttcagtatgttgattttttttaacttttctatattgaactcctcctgtaactggaaatatggaaggcagtaaaacattacagaaggtctgatgcagtggtgcgtgcctgtagccccagatgcttagggggaggctaagaccctggggatctaggctgtagtgggaggatttcatgaggccaggagtttaagttcactgtgatcatacgtgtgaatagtcactgtcctcaggcctggtcaacatagcgacagccctgatctaaaagacattaaaaacaataaaaaccattacagaacgtgctttataatagaaccaagggcctttattaccgagaaatctgtactggctctgtttctccctgggtatctcctgtgagctcctgatgtagtctggtggcagtgtatttgctaactcatatcttcggtacatttgattttaatctagtattttgtttatattaaagtgaaaggagatgaccttcaggccattaagaaggagctgacccagataaaacaaaaagtggattctctcctggaaaacctggaaaaaattgaaaaggaacagagcaaacaagcaggtaaatgggttttctgcttgcccttggtatacagttgggttagttacataaggcacttgaaagtacatgttggaatagtggaatataaagcaatgtaatatgaaacttggggagtgtgaattgggaagggtatttgtgtgggaggatttagatttgtgctgcagttctgtgatccttagtggggattgtctacgtcctgtggacattactgcccctagacagacttgtccttctcatccgcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccaggtgaaaaccacgggaaaggaaagaaaaaggtggtggaggggggctcagggacacatggagtgcctctaactccatcctgtttgtgtctgtttctcacagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggag

SEQ ID NO: 37751 - DNA, 61294 bp, Homo sapiens
aggttctcttacatcgaccgcctaagagtcgcgctgtaagaagcaacaacctctcctcttcgtctccgccatcagctcggcagtcgcgaagcagcaaccatggtgagaatcggcttcggctctttgtggccgttgggtggagtcagcgcccccaggctctacttggaaaacctttaagctcttttctttcgtaagctctctgggcgagggtggtggtatgttttgtgaggtttagcttagccccaaatcctcaagccccgccgccgccgcagtgcgggtgcaggaaccgggccagtactgcgcccagggcgcagcagagcgctggggaggaacaaaggcggcgcctaggcgcctgtgttatccgagagactttcgggggccgcgggcagcccgtctgccgcgaccgaggggtctggggcgtcccggctgggccccgtgtctgtgcgcacggtttcgctgatgctgaggggccactttctgtctcgcgttgttctctggggaccgggagaggaggaggcacccaaaaagagcgggggcgttgggcgagctgggggacgtgggagggggaacgggaacaaagcgcagcctagggttagcgtgggaagaccctccgcggtctttggcgttttggaaagatacccacacattcccgggaaaacatggtgagtttctgccggagcccccggcagcgggtgtcagggcggcgcaggggcggggttgtttgtttctggcttctatggcgttggagccactgggcggggttcgccctcactgaacctcttctgtcaggagctgactgaaaaaaaaacaaaaaaacctttcatcattgcggaactgtaggctccaaaagggttttcttcactattataagttagatgacttttttttttcttgagcaaaatcataattcacttcacaagctctttaatgtctggtctggggacgccctgccctgaccgactgaagtgtgtgtgtgtgtgtgtgtgtgtgtgtgtgtgtgtctgtgggacgccctgccctgaccgactgaagtgtgtgtgtgtgtgtgtgtgtgtctgtctgtctgtctggactgcacgttcagcgagggagaaagcccactttgtgagccccagggtaccctgatggtcaggacccagggaaacgcccttccccgccgcccccccgccccgcccccaccacatcagcgaatagacaatgaaagtggtagccctaaagaccacagagaagaaaacctctattggatgcaaagaatatgaatattatgtgatgggtagagaatctcaggatgaaaatactattttgttgttttaaataaatatttcattatccttccactgggcttttattctttggtaccttttcatgtgatgcttgtttctaacttaggaacttttgtgtgtgtgtgtgttaagatacggataatttttcagcttttacagtggagaagatctggaaaaacctttttttttaaaaaaaaaagtaatgaaattgctacagacaaagaagaattatactccgcatcccgttgtcttttgttccagtgcatcttaattaattcatttcaattcaggcacatggtcccgggcggggtcagaggaggaaaactggcaaaacagcacaatgagatcatgtaggcagctgctggaaatagagcttgctctgttaaataatgtagcagacagtacaggctagcaccaggcacagcaaatacagcaatgcagcaatgcagaaggcagaccttgtctaaactcctagtattgatggattctgcagacagactgcagaagggtgtggcttcttgcctcagctgcagtacagatgtccggattataatatcaagtcctattcagaggaaactttcatctttatttaaaagggaagaaagcagtaaaattaatcccaattaagtcataattggatttacttcattttacaaaatttgtgctttgaatactgaatactttttaaatatgaaaaatcttctattcaagcatggtagtaggcacaatgggctggtaccacgtgctgaacagggccaaggcgacatcattattcagaccacacccatatgcagcatttgtagcaggtgattttccttaatctttgtatcgtgctggggatatgacctcaaataatttagaaaaatatctgtatattattagaaatatttttgaaatttcctataagtttgaaatgctaatacaccttaattttacgattttttcacttttcctccccacagcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattggtgagttgacctcagtaacccaagtgagatcccagggtgctgggacaggaggtctgtcctggggggctccgctggtcactcacccactctccctccccgctcctcgtccctcctcctcctcccccctgctcctcccccatcatgttctccagatgaagttcgcactggcacctaccgccagctcttccaccctgagcaacttatcacaggcaaagaagatgctgccaataactatgcccgagggcactacaccattggcaaggagatcattgacctcgtgttggaccgaattcgcaagctggtatgtttcttttcaagaataaagtaaattaatgagcctaaagaacacatttgaaataatgctttttttttcaaacacagaattgaactgttattttaataaagagtggaatgagtcattcttttggggtttttaaaattcagttaaaatgaactatttgatgtcattttgtaaatgttaatgagaattttttaaaaagcatttgtcaaaataagatctaagtcctggaagatgtatgaaaagtgaaaatatatttactatgattgtactacaaagaataaaaacttaacctttcctctgttcctctcttttgttataggccgaccagtgcacgggtctccagggcttcttggttttccacagctttggtgggggaactggttctgggttcacctcgctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctatccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaatgaattcagtcctgtgttttctatctgggtgtctgaagtttttcatgtatttagtgcattgagaataaaaaataagtgttgcctgtggtttatacatatcctaggaagtgacgtttgtatttaaagtatcttagtaatttaaaacttttatttatgaaacacaaaatgtatatctaaagattaccattacagagcatcatgtactttttttttttttttttttttttgtgagatggagtcttgttctgttgcccaggctggagtgcagtggtacgatctgggctcactgcaacctcaacctcctgggttcaagagcttctcctgcctcagcctcccaagtagctaggattacaggcatccaccaccacacctgactaatttttgtatttttagtggagactgggtttcaccatgatggtcaggctggtctcagactcctgacctccagtgatccgcttgcctcggcctccctaagtgctgggattacaggcgtgaaccactgtgcccggctcatactattaagtttttacctcattattataataaagttatttaaactgccagtactttttagagttgaaagttggtaacacatagccaaaatctggttggctgctgaatcttatgtaactaacataaaatggtgaatattccaaatgcatcagtttttcatgtgccctccgctccttggtatgtgtctagtgccattatgcctcttctgcccagggttcccaaaacaaatctcctctcaaagcaagcagccctatgctagacttagttctttaccttctttccaaacctattttaagctgaatgtcatgttggaaaagcctgatacatttattcactctaatgtgttaattagatatctgaaagttaattctccaagttaatgtgggccaataacttcaaataataaagccctaatagtgcaattgcatgcattagcaccaatacaaaaaatgttttggacttacgatttgtccaacaatagagctctgctccagaccaactgaccaaaagtgtctattcccaagttcagtaaattgtcttcctactctcacattttctggttctgggatacatattagttcattttcacgctgctatgaagaaatacctgagactgggcggggcacagtggctcatgcctataatcccagcactttgggaggccggggcgggcagatcacaaggtcaggagatcgagaccatcctggttaacacggtgaaaccctgtctctactaaaaatgcaaaaattagccaggcgtggtgacacacgcctgtaatcccagctactcagagagaattacttgaacccaggaggtggaggttgcagtgaaccgagatcgcaccattgcagtccagcttgagcaaaactccatctcaaaaaaagaaatacatcaagatgggctgggtgcggtgcctcacgcctgtagtcccagcactttgggaggctgaggtgggaggatcatttgaggtcaggagttcgagactagcctctccaacatggtgaaacaccatctctactaaaaaatacaaaaattagctgggtgtggtggcggacacctgtaatcccagctgctcgggaggctgaggtgacagaatcgcttgaacccgggtggtggaggttgcaatgagccaagatcacgccactgcactccagcctgggtgacagagcaagactccatctcaaaaaaaaaaactatgttataatgggaaatgttattttatatatatatatatacacatatatatatatatattttttgagacagggtctcactctgtcacccaggttggagtgcagtggtgcgatctcagctcactgcaacgtcaggctcaagcgatccacctcagcctcccaagtagctgggaccacgccaccatgcccagctaatgtttttctgtattttgtagaggcagggtctcactatgttgcccaggctcgtctccaactcctggactcaagcgatcctcctgcctcaacctccaaagtgctaggatgacgggtgtgagccacgacgcccagcctgttatatgtatatcttaccacaattttagaaacaaacacacaatggaagtataaatcaagcactaagaaaaatgattgccaatggggagagaacatgatctaactgcacttcttctgatgcatttgttgtgtcatttaactatagaaacatgtaactatgttatataagagagaattaaggtggaaaaaaatccttaaaaatggaaaacaaaatgaaacaaataaatctaaccaaatatcaggttggtgtcttaactgcagaaaggggaattctctctttctttctttttcttttttttttttttttttttttttgagacagggtctcactctattgcccaggctgcagtggcatgatctggctcattgcaacttctacctcccaggttcaagcaatcctcctgcctcagcagccagagtagccgggagcacaggtctatgagccaccgtgcctggctactttttttatttttgtagagacagagttttgccatgttgcccaggctggtctcgatctcctgagctcaagtgatcctcccacctcagcctcccaaaatgctggattacaggcgtgagcgagtgtaccagccaccttaacaattcttgaagtatgcagttcagtattgctaaatatattcacttgttgttgcaaccaatctccagaattctttcatctttttttttttttttttttttttgagacggagtctagctctgtcgccgaggctggagtgcagtggcgcgatcttggctcaccgcaagctccgccttccgggttcgcgccattctcctgcctcagcctccggagtagctgggactacaggcgcccgccaccacgcccagctaatttttttgtatttttagtagagacagggtttcaccgtgttagccaggatggtctcgatctcctgacctcgtgatccgcccgcctcggcttcccaaagtgctggggttacaggcgtgagccactgcgcccggcccagaattctttcttcttacaaaacttaaactctatacctgtcaaacaacttatcattcctccgtctccacagcccctggcaaacagcattctcctttgtctctatgaatttgactattctaggtaccttacataagtagaatcatacagtatttgtcttttttgtaactggcttatttcacttagcacaatgtcctcaaagttcatccatgttgtagcatgtgtcagaatttacttcctatttaaggctgaataatattccattgtgtgtatatactagtttttttttttttttactcattcattcatccatgcacacttgaattgcttccacctgttgacttttgtgaataatgctgctatgaatatgggtatacaaggatctcttccagatcctgttttcagtttttttgggtatatacacagaagtagaattgctagatcatattttctgaatgtgcgtgtgtgtggttttcttaagaaatgaagtctcactctgttacccaggctggagtgcagtggtgggatcatagctcaccgtaacctctaactccagggctcaagtgatcctcctgtctcagcctcctgagtagttaggactccaagcatgccaccataccaggctaatttttgcattttttgtacagacagggtcttgctatgttccccaggtttattttctgttttttttttcaatagaagccattctaatatgaagtggttgtagttttaatttgcatttccctaatgattagtaatgttgaccatcttttcgtttgcttattagccagttgtatatcttctttggagaaatgccttttcaagttctctgcccatttttaaattggattgttaatgttaaaacacttttttttttttttgagacggagttttgcaattgtctcccaggctggagtacaatggcacaatctcggctcactgcaacctccacctctcgggttcaagtgattctcctgcctcagcctaccgagtagctgggattacaggtgcctgacaccacgcccagctaatttttgtatttttagtagagacagggtttcaccatgttggccaggctggtctcaaactcctgacctcaggtgatccatctgcctcggcctcccaaagtgctgggattatagacatgagctaccatgcccagccaaaacactttatttttatatatttttttgagacagggtctcattccgttgcttaggctagagtgcagtggtgctctctcagttcactgcagacttcccaggctcaggtgatcttcccatttcatcctcccaagtagctgggactacaggatcacgctaccactcccagctaatttgttgttgtggttgttgttgtttctggtagagacagggtctcaccacgtttcccaggctgttctcaaactcctgggctcaagcgatttgcccgtcttagcctcccaaagtgctaggattataggtgtgaggcaccatgaccggccaatgttaaaacacttttatcccaccatttaatccatgaggatataagaatactgaaattgtttgggcatggtagctcacgcctgcaatcccagcattcgggtggatgacctgaggtcaggagttcgagaccagcctcgccagtatggtgaaactccatctctactaaaaatacagaaaaaattagtcaggcatggtggtgggcgcctataatcccaactacttgggaggctgaagcaggagaatagcttgaacctgggaggcagaagttgcagtgagccgagatcacactactgcactccagcctgggcaacaagagtgaaactctgtctcaaaaaagaaaaaagaaatacaaaaattagccgggcatggtggcatgtgcctgtaatcccagctactctggaggctgaggcaggagaatcgctggaacctgggaggcagaggttgcagtgagccgaggtcgcgccactgcaatccagcctgggtgacagagcgagcctccatctcaagaaaaaaaaaaaaaagaatggtggaataactaaaatgtaaaaaaaattaactgcaaaaagttattttatcctgagaccattataagttttatttctcatgtgtacattatttccttcatatttaaaaataaaacaacaaataatgctggctatggtgctcatcctatcccttattatatctttaattggaacgtagtttttggccttgagacacatgttttataagttttttctgggccaggcatgggattacaggtgtgagcctacaatcccatcacttcgggaggttgaagtgggaggatcgcttgagccggggaggttgaggctgcagtgagccatgattgcaccactgcactccagcctgggcaacagagcaagaccttgtctctaaataaatatataaataaatttttttctcaatatatggaaagtatctcaacatgagaatatttacattatttctatactattaaaatttttaatcagaatagatgttgaattttatggaatgtcttttcagcaatatttggagattaacatatgacttttccccctcaacatactataatgagttattttaaaagatttcctaatattgaatgatcattgcatgtctaatataaaaaacttggggctgggcatggtggctcacgcctgtaatcccagcactttgggaggctgaggtgggtggaatgcttgaggctaggagttcgagaccagcctgggcaacataggaagaccccatctctattaaaaaaaaaaattaggctgggtgcagcggttcatgcctgtaatcccagaacttcgggaggccaaggagggcagatcacgaggtcaagagatcgagaccatcctggacaacatggtgagagcctgtctctattaaaaatacaaaaattagctgagcgaggtggtgtgtgcttgtagtcccagttactcgggaagctgaggcagaagaatccttgaattcaggaggcggatgttgcagtcaaccaagatcgagacactgcactccagcctggtgacagagtaagactccatctcaaaaaaaaaaaaaaaaaaaaaaaaatagggcaggtggggtggctcacgtctgtaatcccagcactttgggaggctgaggcaggtgaatcacctgaggtcagcagttcgagaacagcctggccaacatggtgaagcccccatctctactaaagatacaaaaattagccaagcgtggtggcacgcacctgtaattccagttacttgggaggcttagacaggagaatcgcttgaacctgggaggtggaggttgcagtgagctgagattgcaccactgcaactccagcctgggcggcagagcaagactccatctcaaaaaaaaaaaaaaaaattagctgagtgtggtggtgtgcacttgtagtcccagttacttgggaggctgaggcacaagaattgcttgaacctgggtggccaaggttgcagtgaacccagattgtgtcattgcacaccagcctgagtgacagagcaagactctgtctcaaaacaacaacaacaacaacaacaataacaacaaaacttggtcatagagattagtgctgccagattctttttaaaattattgactgactggttgattgattttgagattaccataaaacagcacctggttctatttgatgataaagtttcactctgaacagcagtgtatagggctgagttttatgctactattcagtatagactgtggaagttaccagagtatatcccataaaaaaaagttattccaccagaagcctatatagtgcagtccaggcaagaaagcctttgattatccaacttaattcagaaatagaatttagagtatctaaagcagcagctcattcttaattactagaggtgatgagagcagatatcctttaccattaagtatgatgttagctctcagttttcgcagacactctttatcagagagaggaagttctctagtttcctagtttgctgagaggttcgttggtttgtttttggtaaatggatgttagattttgtcaaattatttttctgtgtgcatctattaaaatgatcacatgggttttctccttttttatcttgaatgtgaaaccaaccttgcattcctgggataaaccacaattgctttatagtttaaaacaggggttcttaactcagggctcagaaaagcacaggtacttcatagatagttctcatggtttgggaactatcctaaagttgtatgcaaaattctgtgtgaatatgttcatgataaattttctccaaagatagctactaaccattcctctcatccctgtaggtacaggctacttctcccatagagcgatggaatctattcccctttccttaaaccctagctggcttgtgatgactttgacaaatagaatgtgcaaaagtgaagctgtgctagacccaggtcaagcacttaagaagcctggcagttgtgttgtgtttatatatatatgtgtatatatatatatacacacatacacatacacacacacacagagatagggtctcactatgttaatcaggctggtttcaaactcccggcctcaagtgatcctctgcctcggcctcccaaactgctgggattacaggagtgagccatcatgcccagcctgtttaaaagcaagccaccatttaagaaacttgagctagagtaacaatggatgagagaccatgtgaagagaaagagaggtcgtgtgaaaaagaaccaccccgccccatccaacagccagcacaaaggtcccacatatgtgagtgaaaccatcttaggcactccagacccagctgggctcccagctgaacacacctgcatgagtgaaccagatgacataccacatggaatcatgagaaataataaatgactgttttaagtcaatcgttttggggtggttggttatacagcaatagagaactgaaacagggcttataggcacagctaaagagagaatactgtatactgttttctttttcttcttctttttgagacagagtcttgctctgtcgcccaggctggagtgcagtggctctatctcagctcactgcaagctccgcctcccaagttcacaccattctcctgcctcagcctcccgagtagctgggactacaggcacctgccaccacgcccggctaacttttcgtattttttagtagagacagggtttaaccatgttagccaggatggtttcaatctcctgacctcgtgatccgcctgccttggcctcccaaagtgctgggattacaggcgtaagccaccacgcctggcctactgtatgctgttttcatgagattatccaaaataattataaccactaatctaaataaatgaaataataaaaattctttaggaaatccctcataaatgtatttgtttcaatgtttttttacatttattttttttagaggcaaggtcttgctctcttgcccaggctggactgcagtggcgcaatcattgctcaatgtaacttcaaatttgggatttaagcaatgctctcacttcagccccctgagtagctaggactacaggtgcacacacccacaactggctaattaaaaaaaaaaaaaaaaactttgtagagatggggtccagctatattgctcaggctggtctcgaactcctgggctcaagtgacccttctgccttggcctcccaaagtgcacggattatagatgtgagccactgtgcctggcctcagtgtgtttttgataattatcagtactatatttaagattatatgtaaattagcccagcactgttgttcacgcctgtaatcccagcactttggcaggccaagtgtgggtcacaggtggatcatgaggtctggagttcaagaccagcctggtcaagacagtgaaaccctgtctttactgaaaatacaaaaattagctgggtgtggtggtacatgcctgtagtcccagctacatggaaggctgaggcaggaaaatctcttgaactggggagatggaggctgcagtgaaccaagattgcaccactgcactccagcctgggcaacagagcgatactctgtctcaaaaaaaaaaaaaaaaaaaaaaaagaattatatgtaaatagagtgtagctttgaatttggcaattaagtgaaagattatatgctataatggaaatagatgcctaagataaaaaaaatcagataatttattggaccatctttccactgctctgaagaaagtgggtagtatttgagcgctaggccaaaagttttcacttaaatatatacatatgaacatgtaaaaatatatacacaaaaattatataaagaaaagtgaacaaaagtagatccaaagttctatatttggtcaagatatagttttgtacatgaaccaagtggatggattcacttaccataaatggtgcagccaatgtggaagtgagtgtgatttgcagttgagttaggacatacctggtagagtggatcaaaattgactgaggcggctgggcgtggtcgctaatgcctgtagtcccagcactttgggaggccaagggaggcggatcacctgagggtgggagttcgagaccggcctgaccaacatggagaaacctcgtctctactaaaaatacaaaattagccaggcgtggtggcacatgcctataatcccagctactcaggagactgaggaaggagaatcacttgaatctgggaggcagaggttgcggtgagccaagatcacgccattgcactccagcctgggcaataagagcaaaactccgtctcaaaaaaaaaaaaaaaattgactgaggcagggtgcagtggctcatgcctgtaatcccagcactttgggaggccttatctctaaaaaaaaaaaaacaaaaaaactttttttttttgttttttgtttttttaagacagtctctgtcgccaggttagagtgcagtggtgcgatctcgactcacagcaacctccgcctgctgggttcaagcgattctcctggctcagcctcccaagtagctgggaccacaggcgcatgccaccatgcccagctaatttttgtatttttagtagagacagtgtttcagcatgttggccaggagggtctcgatctctcgacctcgtgatccacccaccttagtctcccaaagtgctgggattagaggcataagccaccgagcctggcctgtaattttattttagtagaaactgggtttcaccatgtctgccaggctagtcttgaactcctggcctcaagtgattcacctgccttggcctcccaaagtgctggtattacaagcgtgagccaatgtgcccagtcaaaacaattttttttaattagctgggcgtggtggcgcagccctgtagtcctagctacttaggtggccaaggcaggaggatcccttgagctcaggagtgcaaggctgcagtgagctgtgatcatatcactgcactccagcctagacgacagagcaagaccctgtctcaaaaaaaaccacaaaaaacaaaaacaaaaaaaccctgagacatagggcaggcttccatctagtaaatggagtaaggaggtaggaaacagctgtagaaagaaaatgacacttgccgtggacagtagcacatgcctgtaatatcaacattttgggaggctgaggcaggagtatcgcttgaggccaggagtttgagaccagcctgcacaacataacacgacccagtctctcttaaaaaaaagaaaaaagaaaaaagaaaaatttaattagctgtgtgcagtggcagtgcctggagtcccagacactcaggaagctgagacaggaagatctcttgagcctgggagatcaaggtgcagtgagctatgattggccactgtattccagcctgggcaacagagcaagactctgtctcaaaaaaaaaaaaaaagaaaaaaagaaaagaaaagaaaatgagaatgacagtaacataccaccatttccaatccagcatcagaagtaatgaatcaaaaggtccagtataaagttgggctcagtggctcacacttgtaatcccagcattttggaaggctgaggtaggagtatcacttgggccaggagtttgagacaagcctgggcaacatggcgagaccctgtctctacaaaaaataaatcagctgagtgtggtggccaatgtctgtagtcccagctactcaggaggctgaggcaggaagatcacttgagcctaggtggtcaaggctgcagtgagccatgatcacatcattgcacttcatcttgggtgatagagaggagaccctatctttaaaaaaaattaaatgaggccaggcagggtggcttacgcctgtaatcctagcactttgggaggccaaggcgggcagatcacaaggtcaggagatagataccatcctggctaacatggtgaaaccctgtctctactaaaaatacaaaatatcagctgggcgttgtggcacatgcctgtagtcccagctactcaggagactgaggcaggagaatcgcttgaacctgggaggcggaggttgcagtaagccaagatcgcaccactgcactccagcctggacaacagaacaaaaatccgtctcaaaaaaaaaattaaatgaataaaataaaaattaaaagaaagtccaatgtaataagacgaagaggagctaaccctagagaaaggagcttaaagagatcaggccaggtatccaagaaataacacaaggggaaaacatcagggacctaggcagaggcctggtaggcagactgactggctcccatgttagggattatataaggaaacaacagctcaatgcacctttgggtgttgggtgtccaggatattgaaggccagatatttaaggtctttttgcctgttggtcagaaacctcccacaattccttgccgcaagggcctctccaaagagtagcagacagcaaatggcttccctcaggacaagtgagcaagacagcaagagagagctgccaagatgaaagtcacagtctttttgtaatgtaatatcggaagtgacatctcatcacttttgctgtagctaataagaagtgaatcacgcatggccgggtacggtggcttacgcctataatctcagcactttgggaggccgaggcaggtggatcacctgaggtcaggagttagagaccagtctggccaacatagtgaaaccctgtctctactaaaattacaaaaattagccaggcgtggtagcacaggcctgtaatcccagctactcaggagtctgaggcaggagaatcactggaacccgggaggcggaggttgcaataagccaagactgcgccattgcactccagcctgggcaacaagagtgaaactctgtctcaaaaaataataataacaataataataataatgagaatttaaccaataagtacatatgattacatagattctgtaattcttagaaaaatcacagatcctggatctagttttctcttctcaggcttgcaaattataaataaataaaagaagtgcctctaaaagattcataaccaaacataatgccaagtcttgtttttctacaatatatagtatctctatttacataaaattatatatgtgtatatgcctagagagatgtctaataggatctttatcaaatattaagagtattggccaggcttggtggctcgcgcctgaatcctagcactttaggatgccaaagcaggtgtatcacttgaggccaggagtttgagaccagcctgggcaacatagcgaaaccctgactctataaaaaatacaaaaattagccaggcgtggtggcatgtgcctgtagccccagctactaaggaggctgaggtgggaggatctgttgagccaggaggtggaggctgcagtgagctgtgatagtgctactgcactccagcttaggcaacagagaaagataaaaaacaaaaaaattggagctgattgcttaagaagttatttttccctgaagtactggcatttaaacagggaatttttagaaactaaagattcaacttttaaagaaatctccaggaagagaatttcaagcaccatctgagcaaagatgctattttgggtagctattttaagtatcctgagccgttaaaatcagtgcacagtgataggctaatagtcactcttcctacctgaaggctaactcagtccctcacactttatcacttgatttttcttttcctaatataacaggtttgttgaaatataattcacatactgtccaattcacccatttaaagtatacaattcaaggccaggcgaggtggctcatgcctgtaatcctagcactttgggaggccgaggtgggtggatcacctgaggtcaggagtttgagaccagcctggccaacatagtgaaaccccaactctactaataatacaaaaattagcagggcatggtggcgcatgcctataatcccagctactcgggaggctgagttggaagaatcgcttgaatccgggaggtggaagttgcagtgagctgagatcacaccactgcactccagcctgggtgacagatactccatctcaaaaaaataaaaataaaaataaaaaagtaaaaaaaaaatgttttaaaaaagtatacaattcaatggcttttagtatattaagaggtgtgtgatcaccacaattttagaacattttcatcaccccccaaaaaaactctgtaacctaggcaaccactatctccaggcaaccactaatctagtttctgtctctgcatatttccctattctggacatttaatgtagaaggaagcatacaatatgcaggcattcataactggcttctttctttcttcttttcctaatccattcaagtacatctattttggaaatatttccatttcaatgatccaaattgtgatgaggaacaccaccagggcatgaaattttagaatatagcaatctctttgtattattaattgatatacacgccataaaatatacacaccataaaattcaccctttataattttaaagtctctagtatattcaccagcttgtgcaatatctgtccttttaaatttttatatttgtctgttcactagttccagaatttaattttgtcattcatcaaaagctcaaactgtgcactcattagcagtcactccccattatctccttccttgtactagctcatggcaaacacagtaatctactttctgtccctatgaatttgcctattccggacattttatacaaatagaatcatgtaatatagggcttcgttatcttaacacaaagttttcttttttttttttttttgagatggagtcttgctctgtcaccaaggctggagtgcaattgcatgatctcagctcactgcaacctctgcctctgaggttcaagcaattctccaacctcagcctcccaaggagctgggattacagggacgtgccaccatgcccagctaatttttgtatttctcgtagagatggagtttcaccatattggccaggctggtctagaactcctgacctcaggtgatctgcctgcctcggcttcccatagtgctaggattacaggggccactgtgccaggccgagcacaatgttttcaaggttcatctatattgtagaatgtatcagtacttcctttcttttctgggggagcggggtgtggaacggagtcttgctctgtcacccaggctggagtgtagtggcggaatcttggctcactgcaacctccgcctcctgggttcaagcaattcttctgcctcagccacctgagtagctgggactacaggcatgcgccaccatgccaggctaacttttgtatttttagtagagactgcctttcaccatattggccaggctggtctcaaactcctgacctcgtgatccacctgcctccgcctcccaaagtgctaggattacaggtgtgagccactgtgcctggccagtacttcttcttattgccaaataatattccattatagggatatacattttctttattaattgatgggttgtttacattttttggctattatgaataatactgctgttaacttttgtgtacacgtttttgtgcagtcatatattttcatttctcttgagtatacacctagaagtggaattgctgggtcttactatagatctgtttaatatttcatggaactgccaagatattttcccaagtggttatatcatttacattcctactagtagtgtaagaaggtccaatttttccacatccttactaagacttgttattttctgtcttcttttattatagccatcctagtgggtgtgaagtggtatctcactggggttttgatttgcattttctgatggctaaagacttgagtaccttctcatgtgcttattggccatttgggtatcttctttggagaagtctacatttagagcctttgcccatttaaaatttttattttattttttaaatagagatggggtcttggccaggcgtggtggctcatgtctgtaatcccagcattttgagaccccgaggcgggcagatcacctgaggtcaggagttcgagaccagcctggccaatatggtgaaactccagtctctactaaaatacaaaaattagctgggtgtagcagcgtgcactagtaatcccagctactcgggaggctgaggcacaagaatttcttgagcccaggacagggaagttgcaggttgcagtgagctgagattgcaccactgcactccagcctgggtgacagagtgagactctgtctcaaaaaaaaaaaagagatggagtttcactatgttgcccaggatggcctcaaactcctgggctcaagtgatcctcctgcctcagcctcccaagtgctaggattacagacgtgaaccactgcacccagcctaaaattttattattcgtctttttattactgagttgtaagagttctttatatgttctagatacaagtatcttatatatgtatagagaaaaattctcttcaaactgtttttcctctactctcaaaccacaacaatcatcaaacagaagacaacttctgtgaccaaatgtgtggaggatttctccacacaccaagtagcagataccagctgggtgtcctctaattcagttcctatattatcactcagagatagtgtcagatcccacaggttgagggttcagtccccaagactgccccagcccccgactctaaccccacacacaccagtcacaagttcagcccccgggacttctgaccgactggtttcaagttgacgctcccatgaccccttctttgggttcgattagtttgctggagcagctcacaacactcagggagacacattcaccagtttattataaaagatattgcaaaggataccgataaaaagaataggtagggtgaggtatgggggaaggggtgtggagcttccatcccctccctgggcgcaccaccctccagtaacctccatgtgttcagctgtctggaagctcactgagccctgtcatcttgggtttttacagaagcttaaagacatcagcattccttctcccaggttatagggtgggacactctcatgggagggtattaagacctacaatcagaaaggtcgggaaagattaggctggacctggtggctcacgcctgtaatcccaacactttgggagactgaggtgggcagatcacctgaggccaggagttcgagaccagcctggccaacacagtgaaacccccatctctaattaaaaaaacacatacaaaattagccaggcgtggtggcgcgtgcctgtaatcccagctactcgggaggctaaggcaggagaattgcttgaatccaggagccagaggttgcagtgagccgagatcacaacactgcactccagcctggatgacagagtgagaacctatcttaaaataaaaaagaaagaaagaaaaaaaggtcggggaagattagcatgaacagagggcaggagaacatcagatgcctgccctgaggctcaacacacccaacattctaacaaaagactgtaaagagggatatggaagttatgagccaagaaccatagatgaaaaccaatatataacactacagatatatgatttgcaaatattttcttcattttgtgggttgtctttttactttcttgatagtgtgtcttttgaagcaaagaagtttttaattgtgatgaggtcaaatgtatctattttttcttttgttacttatgcttttggtgtcatacctaagaagcctttgcctaacttagcgtcattaagatttacttctaggctgggcgtggtggctcacgcctgtaatcccagcactttgggaggccaaggcgggcagatcacctgaggtcaggagctcgagaccagtctggacaatatggtgaaacctcatctctattaaaaatacaaaaataggctgggtgcagtggctcacacctgtattcccagcactttgggaggccgaggtgggcagatcacaaggtcaggagttcaagacaagcctggtcaacatagtgaaaccctgtctctactaaaaatacaaaaattagctgggcatggtggtgcgcacctgtagtcccagctactcgggaggctgaggcagaagaatcacttgaacccgggaggtataggttgcagtgagccgagactgtgccactgcactccagcttgggcaacagagtgagacttcatctcaaaaaaaaaaaaataaaactaaaaatatatacaaaaataagccaggcgtggtggcatgcgcctgtaatcccagttactcaggaggctgaggcaggagaatcgcttgaacccgggaggcagaggttgcagtgagctggagatcacgccattgtactccaacctgggcatcaagagtgaaactccggtctcaaaaaaaaaaaaaaaggatcacttttaaaaagagacagcaagaatagaacaaggaaagcagtaagaagtagattattttagtgtctgagagaaagatggcagacattcaggttatgttttgttaagtagagctgacaagatttgctgatgcgttagatgataaatattagagcaggagagtgagagagagaagtcaaggataactcagaggtctttgggctaagcaactgggtgaataaaggtaacatttactcagatggagaatcctgggagaagaaaggagtggtctgtatgtgagtgtgtggactggagtggagtagaattcaagagttctgttttggacatgataaatttaggatgcctattaggcatccaatcagagatgtagagtaggcatgtggatatgtgtttcagaaaataggcctgggtagaagatacaaatttgggagctaccagtatatagatatttaaagtcatgagactagatgattgtacatcttttcttttttttttttttgagattgagttttgctctgtcgcccaggctggagtgcagtggcgccatctcggctcactgcaagctctgccttccgggttcatgccattctcctgcctcagcctcccgagtagttgggactacaggcgtccgccaacacgcctggctattttttttgtatttttaatagagacggggtttcgctgtgttagccaggatggtctcgatctcctgacctcgtgatccacccacctcggcctcccatagtgctgggattacaggtgtgagccactgcgcccagctgagtgtacatattttcttatgaaattggattatgtgaccatatctctttttttttttttttttttagatggagtctcactctgtggcccaagctggagtacagtggctcaacctcggctcactgcagcctctgcctcccgggttaaagcaattctcctgcctcagcctcctgagtagctggcacctgtaggtgcctgccaccatgcctggctaatttttgtacttttagtagaaacaggttttcaccatgttggccaagctggtctcaaactcctgaccacaagtgattcacttgccttggcctcccaaagtgctgggattacaggcatgagccaccatgtccgggctatgtgaccatttctctgtatcagtgttctttacatttttgcttatcacctaaaaaaaagaaattaaactatgtaactccagtcatttttaagttgatatctaaaattcttcaagttaagtttaaatacggtaaaagctgaggcaggaggatcacttgaggccaggagttgaagaccagctgagactacatctctacaaaatgtaagaaaacaagtagctttgcctgtcttcccagctactcaggaggctgaggtgggaggacctcttgagcccaggatatatatgtgtgtatatatatatatacacacacatatatgtatatgtgtggagatatatacatacgtagtgtaaaataatgtaattttaagcatattgtggccaggcatggtggctcccacctgtaatcccagcactttgtgaggtcaaggtggtaggattacttgagcccaggagtttgagaccagcctgggcaacacagcaagaccccgtatctacaaaaaaatttaaaattagctgggcatggtggcatgcatctgtagtcccagttactcaggagactgaggtaggaggattgcttaagcccagaaggtcaagactgaagtgagccatgattgaattactgcacttaagcctgggcaacagagcaagaccctatctcccccgtcccccaaaagaagcatgttgtaaatattgatgttttacagtaaaacttacaccattctgttacatctaatgtaatctaaacacacagtaacttgatgcttaccatcatctgtttttaaaaaatgacagaattctgggttttgaataatatggtgggccagatatcttgatatgccttccaataaaaattaaaattgctagataaaataattttcttaaaagcattaaaaaggtgacaagatagtaaggaacctttaaaccagaagggagtggaacactaatgccattttctctacaaccttataggtgctggagtattttatttgtttgtttgtttatttattttgagacagggtctcactctttcacccaggctggagtgcagtggcacgatcacagcttactacagacttgacctcctgtgttaaagtgacccttctgcctcaacctcccaagtagctgagcaccatcatgactggctaatttaaaaatttttttttgtaaagacaggttctcgttttgatgcccaggctggtctcgaactcttgggtttaagcgatcctcctgcctcggcctcctaaggtgctgggatgacagatgtgagccaccacgcccagcctaggtgctaggtaaagtccagggcccaccccaagttataaatataataagaggcctgcctcatcaaaaagttgaggctccaactaaacctcacagactgggcaaggtggctcacatctataatcccagcacttagggaggcagagggaggatgatcagttgagtgcaggagttagagaccagcctgggcaacatagggagactctaactctacaaaaactaattcgcttggtgtggtggcacacacttgtagtcccaggtactgaggaggctcaggtgagaggatcacttgaacccaggaatttgaggctgtagtgagctttgtttgccccattgcaatccagcctgggccacagattgagacagtgtctctaaaaaacaaacaaataaaaaagtagaatacggaaaggctggctgggcgtggtggctcacgcctgtaatcccagcactttgggaggctgtggcagggggatcataaggtcaggagatcgagaccatcttggctaacaaggtgaaactccatctgtactgaaaatacaaaaacaaaattagcaaggcgtggtggcgggcacctgtagtcccagctacttgggaggctgaggcaggagaatggcgtgaacccgggaggcggagcttgcagtgaactgagatcacgccactgcgctccagcctgggcaacagagcgaaactccaactcaaaaaaaaaaaaaaaaaaaggaatatggaaaggctagacattaaagaattaagtttatattgaatattgacaatgaataggaaaaaatatacataaaaaagaactaatactcatttaagaggtaagaaaaagaacagtaaaataaataaaaagttaggctgggccttgtggcatggtggtggccacctgtaatcccagctactcaggaggctgaggcaggagaattacttgaacccgggaggcagaggttgcagtgagccgcgatcacatcattgcactccagcctgggcgaaaaagcgagactgcgtttcaagaaaaaaaaaaaaaaattagctgggcacggtggcacacctgtaatctcagctactggggaggctgaggcaggagaactgcttgaacgcaggaggtgaaggttgcagtgagccaagatcgcaacactgcactccagcctgggcaacaagagctaaacgccgtctcaaaaaaaaaagtctgacttaccattttttttcttttgttgcttgtgcttttggtgtcatatctaagaaagcattacctaatcaaaagtaataaagatttatctctgttttcttcttctgagttttatagttttagctcttatatttaggtctttgatccattttaatttttgtgtatggtgtgaggtaggagtctgtattaatttctcagagctgcttttaaaccacaaactgagtggcttaaaacaaaagaaatgtattgcctcatagttctgtaggctagaagtttgaaatcaaggcgttggcaagtttggttcctaccagaggctctgagggagaatctgtcccatgcctctcttctagcttctgctggtgctgacaatccttggcattccttacttaccttgtagacaccactacaatttctgcctgtgttgctaccgggcattctcactatgtttctgtgtcttcacatggccttcttataaggacagtcattagatttagggcccactctaatccagtaattccccatcttaactaactacatttgcaaagattctatttctaaagagggccacattctgaggttgtaagtggacactgaatgttggatagggtgacactattcacacagcagagtccaactacattcctttgcatgtgaatatccagttgtcccagcaccatttgtagaaaagactatcctttggagcaccttgttacagcctagcaagggtggaagtctaggctccccactcagtcttggtgatacaggtaggggtagggtcacagttctttctgtagcacttggctggagtacaggagttgttatataaagtttgctgtcttgctagattttccctttcctggttctttggctagtgagagaaggttttcgttttttgtctcacccttcggcatttttggattgtcagcttcttcagttccaaggcttcgagatgtaaggtaggaagaaaacccaggaaactcatcactatgttgttccttggacccccaagatccctagcttgtctgctgccttctctccatctttcagtctttttttttttttctttttgagacagagtctcactcttttgcccaggctggagtgtagtggtgcgatcttggctcactgcaacctccacctcctgggttcaagcaattctgcctcagcctcctgagtagctggaattacaggcacacgccaccatgtatggctaattttgtatttttagtagagatggggtttcaccatattggccaggctagtctttaactactgacctcaagagatccacctgcctcagcctttcaaagtgctgggattacaggcatgaaccatcacgcccggcttttctttcagtcttcttatgtttgttttatatataatgtccagggtttttagttgtatttagtgggaggaatttaggaagtatgtctactccaccttcccagtgcacttaatttatagggcaatttaagtagaattagcatctttgtaatctgatacctccaaataatacgtgatatatctctcagtacattaatcataatatcttcataatatctctcaataaagatactattttcttgcagatgtcttgttcttttgttgttattgttgttggtgttagtgtgaaagaaaatagaatcttgggaccccaaactcactatgccaaagggacattaagcttgagagctgaattactgcattccttttgttaccagatagctgtaatttcacaatcctgtaccatagcctcatttcctctacttccccttttcacatgtaaaatgtcaatttactgaggctaatcagagcctcacaagaatgtaacaattcgcctcactacctaccctacctcccgttttccccctcctgcttgctctttctcctttaaataatgaagttccctgccaggtatggtggctcacacctgtaatcccagcactttgggaagccaaggtggacggatcacctgaggtcaggagttcaagaccagccttgccaacgtggtgaaaccctgtctaaagggggttttgggaattcttaaattctaatcgtttatatgtaaattttgcggacaatttttgcatacatgtcatgatgttaccagtggagggtgtccaggtccctggtgtcttaaacaaagatttggacaaaatgtacaaagtaaggaaagaatgaagcaacaaaagcagagatttgttgaaaatgaaagtacactccacagggtgggagcaggccaaacataggggctcaagggctcagttacagaattttcctgggtttagggtgtggtggctcatgcctgtaatcccagcactttgggaggccaaggtgggcagatcacctgaggttgggaattcaaggccagcctcaccaacacagagaaaccctgtctctactaaaaaatacaaaaattagccaggcatggcccgtggtgggtgcctgtaaccccggctactcaggaggctgaggcaggagaatctcttgaacccaggaggcggagggtgcagtgaactgagatcgcaccattgcactccagcctgggtgtcagagtgagactctgtctcaaaaaaaaaaaaaaaaaaagaaagaaaggaagaaaaaagaattttctggggtttacatcccctctagaggttcccactggttacttggtgtacgccctatgtaaatgaggaggatattttttgtcatagctgaagtgttttcattttcatttgatttagttctaggaagtccttaggttccctgcctctagtccctattctcctgcctcagtgagtggtgcaaggttagagataagcaggtccttgcatgtttgtgtctttccacagtgtcaggcttttactgatgctattgcaatcacaaaagccaggagctacacggagttcccaagggggcaatctccttagtactgttacagtaggtagttagacaggcaagagcagggcaggagagggctccctgcacccaccaggaatgtcaggtgaccaatggtcaggcagttgtcacactacctatctaaaataattggtcacagccagtaccagggagaggcagtttcccaacagataaacacctgaaattggtaatcagcagcttccgtaagatctaaggaactgggcgagtgggctcgagcatgcacattaagaggcaaaatggaggcatatgaccttccagggcattccaccagaaaagggaagaaaacctcaggtgaatatgtttacaactccagtaaacacactgcgcatgctcacctgccaggcgttagtaggccactgtgcatgtgggcagctcaccctaaggcaagaatgaagggaaaggggcacaaaatactagaagtagaccagcatatgaaatccaaggtctggaccgggcccagtggctcatgcctataatcccagcactttgggaggccaaggagggtggatcatttgaggtcaggagttcaagaccagcccggccaatatggtgaagccctgtctctattaaaaatacaaaaattagggctgggcacggtggctcacgcctgtaatcctaacactttgggaggctgaggtgggcggatcacgaggtcaggagatggagaccatcctggttaacatggtgaaacccggtctctactaaaaatacaaaaaattagccaggcgtggtggcaggtgcctgtagtcccagctactcaggaggctgaggcaggagaatggtgtgaacccgggagacggagcttgcagtgagccaagatcgcgccactgcactccagcctgggcaacagagcgagactccatctcaaaaaaaaaaaaatacaaaaatgagccagagcacagtggctcacacctgtaatcccagcactttgcaaggccgaggcaggcggatcatgaggtcaggagatcaagaccatcctggctaacacggtgaaacctcatctctactaaaaatacaaaaaaaaattagccaagggtggtggcgggtgcctgtactcccagctacttgggaggctgaggcaggagaatggcatgaaccccagaggcagagcttgcagtgagccaagatcgtgccattgcactccagcctgggcaacagagcgagactctgtctcaaaaataaataaataaataaaataaaaatacaaaaattagctgggtggtagtagtgtgcgccctgtaatcccagctactcgcgacgctgaggcaggagaatcgctggagcctgggaggcagaggttgcagtgagctgagatcactccactgcagtccagtctgagcgacagagtgagaccctgtctcattaaataaataaataaataatcctaggtccaaggtgaaatggggcacttctccttcaagttgcccacttgggtctcttccaagtgttctttccttccttttgttcctggtgtaaagctttttaataaacttttactcctgctttaaaacttgcctcggtttctccttctgccttatgcccctcagtggaattctttcttctgaggaggcaagaattgaggttgcttcaggcctgtatggatttactgctgatgatctgtataccttccacagctaacagtacttcctgttcactcagtagtcagagctgtgggcacgcaagccagtcaatattgtaaaccatacataatagtataattaatcaatatataaatgttacaagttaaacattccatgacaaagtaacatttaacatcaagaggagaaagagataggagaaagggttaaagaaccagtccaggcagaacaaagaagaaaaggagttctgttttgggccagttggtctgccagtcttgcgaggaagagtctttgatgtggcagagccttcggaggcagatggcaagttcttatcacgagtgactgactgcaagacggtgtcagttaagatgaccattttgagctgctgaaggcctcatcttttttttttgagacggagttttgctcttgttgcccaggttggagtgcaatggcgcaatctcggctcactgcaacctctgcctcccgggttcaagcgattcttctgcctcagcctcccaagttgctgggattactggcgcccgccaccacgcctggctaattttttggattttgagtagagacagggtttcaccatgttggccaggctggtcttgaactcctaacctcaggtggtccgcccgccttggcctcccaaagtgctgggattacaggcgtgagccaccgcacccagctggcctcattttttttttttttttttgagacggagtctcgctctgttgccaggctggagtgcagtggtgcaatctcagctcactgcaacctctgcctccctggttcaagcgattctcctgcctcagcttcccgagtagctgggattacaggcacttgccaccacgcccgcctaattttttgtatttttagtagagacagggtttcaccatgttggccaggctggtctcaaactactgacctcaggtgatccgcccgccttggcctcccaaagtgctgggattacaggcgtgagccaccgcgcccggctggcctcatcttttatagtcacagaatcctctagtgagaactgatagtggaagagcatgcttgtgtccttaactggttggatgcatcttttaaaaaactttgtttattaagcaaagcatcttatacttgttgacaaagttccctatgaaatataaaatggagactgggcgcggtggctcatgcctataatcccagcattttgggaggctgaggcaggtggatcacctgaggtcaggagtttgagaccagccaggccaacatggtgaaaccccatctctactaaaaatacaaaaaaaaaaaaaaaaaattagccagccgtcgtggcgggcacctataatcccagctactcaggaggctgaggcaggagaattgcttgaacccgggaggcggaggttgcagagagccgagatcgcgccattgcactccagcctgggtgacaagagtgaaactctgtctcaaaaaaaaaaaaaaaaaaaaaaaaatggccaggtgcagtggctcacgcctgtaatcccaggcctttgggaggccgaggtaggcagatcacgaggtcagcagtttgagaccagcctgaccaacatggtgaaaccccatctctactaaaaatacaaaaattagccaggcatggtggtgcgctgtaatcccagctactcaacaggctaagacaggagaattgcttgaacccaggaggtggagattgcagtgagccaagatcacactattgcactccagcctgggtgacaagagtgaaactccatctcaaaaaaataaataaaaataaatggccaggtacagtggctcatgcctgtaatcccaggaccttgggaggtccaggcgggcagatcacaaggtcaggagtttgaaaccgcctgatcaacatggtgaaaccccatctctactaaaaatacaaaaattagccaggcatggtggcatgctgtaatcccagctactcaagaggctaaggcaggagaactgcttgaacctgagaggtggaggttgcagtgagctgagatcacgccattgcacttcagcctgggcgacagagcgagactctgtctcaaaaaatataaataaataaaaataaaaataaataaataaatataaaatggagtctttttctaagatgaagttaattatgtcaaggttgtactataccatacataactattctgtaaggtttttttctgacaccaaacaccaattctccaattctctaacaggaattgggtgtcaaacaattaaattcaattctcttggctcagttccctaaaattgctcccattttaagtgccaggtttgccaccgaacagttgtaaattcgagaatacccgccaatctccctcaggtttaataattcgttagaataattcacagaatataggaaaacactttacttacatttagcaatgcatcgtaaaggatacaactcaggaacagctaagtggaagagatgcaccgagaaaagtatgccctgggtgggggtagaaggtggaggaagatatagagtttccatgccttctcctggttggcaccctcctaacaccaattttttcaccaactatgaagctttccataccctattatttagggggtttcatggagttttcttttctctttttttttgagcgaagtctcactcttgtcccccagtctgggggacaagatctcagctcactgcaacctctgcttcccgggttcaagcgattctcctgcctcagcctcccaactagctgggattacaggcgcctgccaccacacccggctaatttttgtatttttagtagagatggggtttcaccacgttggccaggctggtctcgaactcctgacctcaggtgatccgttgtcttggcctcccaaagtgctgggactacaggcgtgagccaccgtgcctggccggagttttcaccacataagcataattaaggcttgaccttttggtgatcaaactcaatctccagtcaccactcccttccctgaggtcttgggggatggggctgaaagttctaaccctctaatcctggcttgttcttttcattctgaagctacttaggccctctccctccatatcaagcccctcagaagccatctcagggttgggcatgatggctcacacctgtaatcccagcactttgggaggctgaggcgggcagataacttgaggccaggagttcgagaccagcctggccaacatgcggaaacgccatctctactaaaaatacaaaaattagctgggcatggtggcacgcatctatagtcccaactactcaggaggctgaggtatgataatcgcttgaactgggaagcagaggttgcaataagccaagatcactccattgcactccagcctgggcaatgagtttctttagggatgataaaaaatgttctggaattagagtgtgatgatggtagcacaactctataaatgtgttaaaaatcacgaacttggctgggcacggtggctcacgcttgtaaacccagcactttgggaggccgaggtgggaggattacgtgaggtcaagagtttgagaccagcctggccaacatggtgaaaccccatctctactaaaaatacaaaaattagctgggcatggtggcacatgcctgtaatcccagctacttggaggctgaggcaggagattctcttgaatccgggaggtggaggttgctgtgagccaagactgcgccattgcactccagcctgggcaacaagagcgagtttctgtctcaaataaacaaacaaagaaaaaacaaaaaaaccactgaactttggcactgtcctgggttacagaaaaaaattaaaaaaaaaaaaaaaaaaaccactgaactgtacactttaaaggtgtaaattttctttttctttcccgaggtgaagtcttgctctgtcactcaggctggagtacagtggtgcaatcgcggctcactgcaacctctgtctcctgggttcaagcaattctcctgcctcaacctcctgagtagctgggattacaggtatgtgccaccaaacccagctaatttttgtatttttagtagagatggggtttcaccatgttggccaggctggtttcaaactcctgaccttgtgatctgcccacctcggcttcccaaagtgctgggattacaggtgtgagccatcgcgtccagcctaaaagggtaaattttacggaatctgaattaaatctccataaaggtgtttaaaaataaaaaccagtgagcaaagggcaaaaatgaatactcctatatcttatatgagtcttaattcaccattttactttagattgactttttaaacattaattctaattataaaagtaatgcaaatagattttaaaaaactcttggccaggcacaatgccttatgcctgtaattccagcaccgtgggagaccaaggcagtagcctgaggccaggaatttgtgaccagcctggacaacacagcaagacccctagctctacaaaaataacaataataatagtaattagggcatggtgatgcacatttgtagccccagctgctcaggaggatcgcttgagtgcaggagatcgaggctacagtgagctatggtcacaccactgcactctagcctgggggacagagggagaccctgtattaaaagagaagaaagagagagagagagtggggtgggtggtggggagagaaaggaaagaaacaaaaagaaagaaaggatggcaggaagggagggatagagggggaagaaaagtattaaatataaaaaagtagagagggccaggtgcagtggctcatgcctataatcccagcactttgggaggctgaggcagctggatcacctgagatcaggagtttgagaccagcctggccaacgtggcgaaaccccatctctactaaaaaatacaaaaattagccaggcatggtggtgcatgcctgtagtcctggcaacatggaaggctgaggcaggaaaatcgcttgaacccgggaggtggaggttgcagtgagccaagatctcaccattgcactacagcctgggtgacagagcgagactctggctcaaaaaacaaacaaaaaacccttctccttaatcatctttagttattattgacactttgtcttcattactttttttttttttttgagacaaggtctcgctctgacacccaggttggggtacagtgacccgatcttggctcactgcagacttgacctcatgggctcaagtgatcctcctgcctcagcttcccaaagtgctgggattacaggcatgagccactgtgtccagctgttttcattactttcaaagtgccttttcaccagttctcattttatccaaggacaactgagccttcctttcttctttgtatagaagacctgagtatctgtgcaacatggtagttactatatacatgtggctaattttttttttttttttttgagatggagtctcactctgttgccaggctggagtgcagcgacatgatctcggctcactgcaacctccacctcctgggttcaagtggttcccccacctcagcctcccaagtagctgggactacaggcatgtaccaccatacccggctaattttgtatatatttgtattatttaattgtaaattaattacaatctaataaagtaaaatattcaaattcttattcacactagacacatctttttttttgggatggagtcttgccctgttgcccactacactccagcctggatgacaaagcaagacaaacaacaaaacaaacaaacaacaaaaaaaacttcattgctgaaaaatgctaatgatcatctgagccttcaactagttataatctttttgctggtggaggatattgccttgatgttaatggctgctgactgatcagggtagtgattgctgaaggttaaggtggctggagcaatttcttttttctttttcttttttttttgcaatagagtctcgctcttgtcgcccaggctggagtgtaatggtgtgatctccgctcactgcaatctccgcctcccaggttcaagcgattctcctgcctcagcctcccaagtagctgaaagtgctgggattacaggtgtaagccactgtacccggccacaacttcttttcttttctttctttcttttttttttttttgagatggaatttcactcttgttgcccaggctagagtgcaatggtgcaatctcagctcactgcagcctctgcctcccaggttcaagcgattcttctgcctcagcctcccaagtagctgggattacaggcatgtgctaccacacctggctaattttttgtatttagtagacacagggtttcaccatgttggccaggctggtctcgaactcctgacctcagatgatccacccgccttggcctcccaaagtgctaggattacaggcgtgagccactgcacctggcctgcagtttcttaaagacaacagtgatgtctgctgcagtgattgacttcctttcatgaaagatttctctgtagcatgtgatgctgtttgatagcattttacccacagtagaacttctttcaaaattggagtcaatcctctcaaaccctgttgttgctttatcaactaagtttatgaaatatttaaaatcctttgttgtcatttcaataatgttcaagcatcttcaccgagtacattccatctcaagaaaccaccatgtgagtgtggtggctcacgcctgtaatcccagcactttgggaggccgaggcgggtggatcacctaaggtcaggagtttgagaccaggctggccaacatagcgaaaccccatctctgctaaaaatacaaaaaattagccagtgcctgtaatcccagctacttgggaggctgaggcagaagaattgcttgaacccgggagacggaggttgcaatgagccgagatcgcaccattgcactccagcctggaaggcagagcaagactctgtctcaaaaaaaaaaaaaaaaaaaaaaaaagtaaaaatgactcttagatccacgggctacagaatggatgctgttagcagtcacgaaagtaacattaatctccctccccgtacatgtcatcagaactcctgggtgaccaggtgcattgtcaatgagcagtaacattttgaaagaatctttatttctgaaaagtacatctcaacaacaggctgaaaatactcagtaaacaatgttgtaaataggtatgctgtcatccaggtgtcgttattccatttatagagcatgggcagagtagacttaccatgatactttagggccctgggatttttggaatggtaaacgagcattggcttcaacttaaaatcacctgctgcattagcccctgacagattcaggctgttctttgaaggtaggcactgacttgtcccttccagctatgaaagtcacagatgacatcttctttcaatgtgaggttgttttgtctacatcgaaaatctttttttattgctcattttttgttgatttgctttcttttggagacagggtcttgttctgttgcccaggctggaatgcagtagcatgatcatagctcactgcagcctcaaaaccctgggctcaggaagccactcacctcagcctgccaggtagctaggactacaggagcatgccatcacacctggctaatttttttatttttgtagagattaaaaaattgccttgctatgttgctcaggctggcctcaagcaatgctctcacctcagcctcccaaagtgctgggattagacatgaggcacagtgcctggccaaaaatgtgttgtttagtatagccatcttcatcaatgatcttagctagatcttctggatcacttgctgcagcttctacatcagcacttattgcttcgctttgcacttttatgttatggagacagcttctttccttaaacttcacgagccaacctctgctagcttcaaacttttcttctgtagtttcctcacctctctcagccttctcagaattgaagataactgaggtcctgctctggattaggctttggcttaagagaatgttgtggctggtttgatcttctatccagactactaaaactttctccctatcagcatcaataaggctgtttcactttttttttttttttttttttgagacagagtctctctctgttacccaggctggagtgcagtggcacaatctcagctcactgcaatgttcacctctggggttcaagtgattctcttgccttagcttcccgagtgtctgggattacaagtgtgcaccaccacactcagctaatttttgtatttttagtagagacagggtttcactatgttggctaggctggtcttgagctcctgacctcaggtgatccacccacctcagcctcccaaagtgctgggattacaggcgtgacccaccacgcccggactgtttcactttcttatcattcatgtgttcactggagtagcacttttaatttcctttgagaacttttcctttgcattcacaatttggctgtttagcacaagaggattagctgttagcctctctcagagaccactgtagggttattaattggtctgatttcaatgttgttgtgtctaatttaacagggaggcataagaagagggagacaggaaatggctggtcagtagaacaatcacaacacacacatttatatattaaggtcactgtcacgtgatcttatgtttgtggcactccaaaaccattacaatagtaacatcaaagattactaatcacagatcaccataacaaatacaataataataaaaaagcttttttttttttttttttttgagatgtcgctttgtctcccaggctggagtgcaatggcacgatctcggctcaccacaacctccgccttctgggttcaagcgattctcctgcctcagactcccaagtagctgggattacaggcgtgtgtcaccacacccagctaattttgtatttttggtagagatggggtttcgccatgttggctaggctggtcttgagctcctgacttcaggagatccgcctgccttggcctcccaaagtgctaggattacaggtgtgagccactacacccagcctgtaatgaaaaatttttatatattatgaaaattaccaaaatgtgacacagagacatgaagtgagcaaatgctgttggaaaaatggtgctaacagacttgcttgatgcagggttgccataaaccttcaatacgttttaaaaaaaaaaaagaaagagaaaactctcatcatctgtgaagttcagtaaagtgggccagacacagtggctcacacctgtaatcccagctacttgggaggctgaggcaggataatccttgaaccagggaggcggaggttgcggtgagccaagattgcgtcattgcactccagcctgggcaacaagagcgaaactctgtctcaaaaaaaataaaaagggccgggcacggtggcttaagcctgtaatcccagcactttgggaggccgaggcaggccgatcacttgaggtcagaagttcgagaccagcctggccaacgtggtgaaacactgtctctaccaaaaatacaaaaattagccgggcgtggtggcaagtgcctgtagtcccagctacttgggaggctgaggcaggagaagagattgaacccaggaggcagaggttgcagtgagccgagatcacacgactgtactccagcctgggcaacaagagcgaaactgtctcaaaagaaaaacaaaacaaaacaaaacaagttcagtaaagtgaagtgcaataaagtaaggtatgtctgtgtatctttttacctcttcaatgtttgaaccatgggaactttacctattcaaaaaatatgtgtaaagttttgctttcaagtctactgcttttattaattacatgttttttgtttgtttgtttctttttttgagacagagtcttactctgttgcccaggctggaatgcagtggcacgatcttggctcactgcaacctccacctcccaggttcaagcaattctcctgcctcagcctcccaagtagctgggactaaaggcacatgccactacgcctggctaattttttgtatttcagtagagatggggtttcaccgtgttgcccaggctggtctcaaactcctgagctcaggcaatccaccgcctcagtctcccaaagtgctaggattacaggcgtgagccaccatgcctggccagcaattacatgtttgtatatatttttatttattttatttatttatttatttatttttgagacagagtctcgctctgtcacccaggctgtagtgcagtggcgtgatcttggctcactgcaagctccacctcctgggttcacatcattctcctgcctcagccttctgagtagctgggactacaggcgcctgccaccacgcccggctaatttttttttttttctttagtagagagggggtttcaccgtgttagccaagatggtctcgatctcctcacctcgtgatctgcccgcctcggcctcccaaagtgctgggattacaggcatgagccactgtgcccggctacatgtttttataaatccattcagtcaactgtcttcttagtgactctacagtatcttcttctatttcacaaatggtgacacaatggctttagcaaaatataaatcctggttaaacccaattcactatcaggtttataccttctcctgagcaggtaaacctgactagggaaaaatacaacccagatgactgatctcattttatatttacaaccacagatgtctgaatgacctactacctctccctacttaatttactctaccattcagagataactatttcacaaattctctctccacaaacttcccacatttcacacattctctctccacaaacctcccacactccttccccaatccttacatttagctaatgatctccccatccctgtttcactgaagaagaaaaaaaaaaagaaaaacatcagaagacaaaacttacacagtcccactaccacatcagttatgacttacaatcagctgtaaataacagacacaaacacacactcaacaaaagaaaaagaaaaataggaaaaaagatcagtgtggcttaaacaaattgcttcattttctcccataatgagacgtccagggggaggcaatgcagggcttgacagctccatgttgtcatcaggcacctagactctatcttcctccatccttagcatatcatatggcataaggttgctttattatcgtaagaagattactagaactccacaggaccccagccatcttgtccatgttctaggcaaaaaaaaaaaaaaaaaaaaaaaagaaaaagaaagggccaatgacactagctcaatcttatcaatcctgttttagaaactttatcagcagccccaccaaacaacttccactaacatttcaccagaacttagtcacatggaccccatcagttggaacagaagctgggcaccctgttcccaaagaaatcagggttctgttactaaggaaaagagggagaattaggaaagattacctattttgttcttcttttttaaagatgaggtttagcggctgggcacgataggtcacatctgtaatcccagcactttcggatgctgaggcgggcagatcacgtgatgtcgggaggtcgagaccagcccgaccaacatggagaaaccctgtctctactaaaaatacaaaattagccaggtgtggtggcacatgcctgtaatcccagctactcgggaggctgaagcaggagaatcgcttcaacccgggaggtagaggttgcggtgagccgagatcacgccattgcactccagcctaggcaacaagagcgaaactccgtctcaaaaaaaaaaaaaaaaaaaaaggatgaggttttgctatgttgcccagactggactcaaactcctgggcccaaaggatcctcctgccttagcctcccgagtagctgaaaggcaccactgtatgccaccatccctggctgaaattacccattttctagttcactgcagtagaggagaaaaacagaaataatcagaagagaaattccacagattccaccactaaatctaactgccaaccgattaatcgctcctcgaattctggcttcctcctgtgtgtcagcaggtgaatactgtgctcctttccaaggtgaacccctccatggtgcactgggtgcctttccatttcactactctaaagctttgctccttttccccacaacatggattttaccttttgttttttttttctcattagcaaacaaatattctaaaatagctcccaccttagaaacaaaaacaaaaagaaaaccccgccttttattgaacatccctatccagctctcctggttattactcttctttctaaccccttaaagcaaaaatcctcaaaaaagtttttaaattctccttcctccacttccttgtcatgaatcatctcttgaacttacaccaataaggccttaattcatccttactgctccactgaagccactcttgcccaggtcaccagtgaaatctaacagctgattctcagaccccatgttacccagcctcccagaaagcacagttcaaaaagcagagttatcacctgctcctgcttgaaacactttcttcatttggtttccagaatactaaactcttcattattttctttcttctatttttttggaaacacggtcttgctctgttacccaggctggaatgcagtggcgcgatcacaacttactgcagccttcacctcgtgggctcctatgtcagcctcccaagtaatcggtactacaggtgcacaccaccacgcctggctaatttttgtatttgttgtaaagaagggatctccctgtgttgccagagctggtctctaactcctgggctcaagcaatcctcccaccttggcctccccaagtgctggtattataggtgtgaaccactgcacccaggccattattaacttccaacatcactgtctgctccttttactttacactactagatcctgttcctaatttttataagttagagtgctctggggttcagtccttggacctcttccttttttttttttttttttcagacagtctcgctctgttgcccaggctggagtgcaatggcacaatctcagctcaccacaacctccgcctcccgggttcaagcgattctcctgcctcagcctcccaagtagctgggactataggcgcatgccaccatgcccagctaaattttgtaattttagtagagacggggtttcactatgttggccaggcttgtctcgaactcctgactttgtgatccgcccgcctggtcttcccaaagtgctgggattacaggcatgagccactgcgcccggttggatctcccccgttccccaggtgatcttatccactttctatactgatgacttctaaatttatctccaacacgacctcccctctgcactttttaaccaactattactgcctaatcaacatctctacttatatttaacccactgcatctcaaacttaacatgtccaaaactgaacttttgattctttccatttctctacacctgttcctcctttagtattccccagtgttgctcagaccaaaaatctaggggtcatgactgactcctctctttctttctcacagccaacttcttaataaatcctgtcagttctgtcttcaaaatatactcagaaggctgggcgtggtggctcaagcctataatcccagcactttgggaggccaaggcaggcagatcacgaagtcaggagatcaagactatcctggctaacacggtgaaaccccacatctacttaaaaaaaaaaaaaaaaaaaattagccgggcgtggtggcacacgcctgtagtcccagctacttgggaggctgaggcaggagaatcacttgaacctgggaggcagagattgcagtgagccgagatcacaccactgcactccagcctgggtgacagagcaagactccatctcaaaaacaaaacaaaacaaaacaaaacaactcacatttccaccacttcttaccacctcaacaatatcaccttgattcaagccactatcatctcttatttgcattactgcccattcccttctagttcatcttccttcttccactcttaacctcctgtggtttactctcacaaaagccagagcaatgctcttaaaacctaaaatagaacatgtcacacctttgctcaaaactatctaatagcttctcattatttttagaataaaacacaaaatctctccatgcctaataacactattacatgagctagaccctggctacctctccaatctcatttcataacgctctccccctcactcactactctgctctggcctcattgaccttcttgttactgctttgaaaagatatacacatccagtttccagaccagcagaaaagaagctcggaagtcaccactccatgataacaacaagtaaaagctgaacaaactaaaaaatcaacagctccttttttttttttttaactgctccatgcagagcagggctaagtcataggcagtgcatctagagctgccaacaactctttatagatctgtaggagaaactagataaaaaaagtaaaggaggccgggcgcggtggctcacgcctgtaatcccagcactttgggaggccgaggcgggtggatcacaaggtcaggagatcgagaccatcctggctaatacggtgaaaccccgtctctattaaaaatacaaaaaaattagccaggcatggtggcgggcacctgtagtcccagctacttgggaggctgaggcaggagaatgccgtgaacctaggaggcagagcttgcagtgagccgagattgtgccactgcactccagcctgggcgacagagcgagactctgtctcaaaaaaaaaaaaaaaaaagtaaaggaggctgagcatagtggttcatgtctataatcccaggcctttgggaggccaaagtgggaggatgactagatgctaagagttcaagcccagcctgggcaacatggcaagacctcatctctacaaaattaaaattaaactttttttttttaaagtgaaggagctgggcaaggtggcacacctatagttccagttactttacaggctgaggcaggaggatcccttgagcccaggagttcaaggctgcagtatatgattatcacatctgtgaatagccactgcacgccaatctgggcaacatagcgaggcttcatctctacaaaaaagtaataaaaaagaaataaaaggctgggtgtggtggctcatgcctgtaatcccagcactttagtaggctgaggcaggtggatcacttgaggtcaggagttcaggaccagcctggcccacatgttaaaaccgcatctctatcaaaaaatacaaaaattggctgggtgtggtggcgtatgctgtagccccagctacgcgggaggctgaggcaggagcgttacttgaacctgggaggaggaggttgcagtgagccaagatcacaccactgcactccagcctgggtgacagagcgagactccgtctcaaaacaacagaaaaagaaataaaagagaggacataattacagattccatgaacattaaagggaaaataaaggaaaactctatgtgcacagatttgataacctagatgaaatagacaaattccttgaaagacacaatctgccaaattcacataagaagaaagacaatttgaacagctctatatctattaaagaactgaatcggctgggcgcggtggctcatgcctgtaatcccagcactttgggaggctgaggtgggcagatcatgaggtcaggagatcgagaccatcctggctaacacggtgaaaccccatctctactaaatatacaaaaaattagctgggcatggtggcacgcacctgtagtcccagctactcgggtggctgaggcaggagaattgcttgaacccaggaggcagaggttgcagtgagctgagatcgcgccactgcactccagcctgggtgacagagcgagactccgtctcaaataataataataataattgaatcaataattaataaccttcccaaacagaaagcaccaggcccagatgggttaactgatgaattctaccaaacatttatttatttattttgagatggagtcttgctctgttccccagcccggagtgcagtggtgcaatcttggctcactgcaacctctgccttctgggttcaagtgattctcctgcctcaacctcctgagtagctgggattacaggcgtatgccaccatgcctagctaatttgaattctaccaaacttttaggggaaacattatcccaattttataccatctctttaagaagaaagaagcagagggattattccctaactcattctatgagatcagtgttaccgtaataccaaaaccagacagatactacaaaaaaaaaaaaaagaaaaaagaaaactacagaccaatatttgcatggacatagatgcaaaaatccttaattaaatatcagaaaatcaaatccaacactggataaaaagaattatataccaagaccaagtggaatttatcccaggtatacaaggctggttcaacatttgaaaatgaataaggccaggagcagtggcgcatacctataatcccagcatgttgggaggctgaagtgggacaatcacttcagctcaggagctcaagaccagcctgaacaacgtggcaagacctcatctctacaaaaaatttaaaaattagcagggtgtggtggcatacacttgtggtcctagctactcaggaggctgaggtgagaggatcgctgaagcccaggagaccgagactgcagtgagctatgttcatgccactgcactccggcctgggtgacagagcaagaccctgtctcaaaaaaaaaagaaagaaaaagaaaagatcaattaataaaatccatcagatcagcagtctaaagaagaaaaaggccaggtgcagtggctcatgcctgcaatcccaggactttgggaggccgagacaagcagatggcttaaggtcaggagttcaagaccagcctggccaacatggtgaaaccctgcatctgctaaaaataaaaaaaatttgccaggtgtggtggcgtgcgtctataatcccagctaatccagtggctgaggcacgagaattgtttgtaccagggaggtggaggttgcagtgagccaagatggtgccactgcactccattctgggcaacagagcaaaactgtttaaaaaagaaaaaagaaagaaaaatcacataatcatatcaacatatgcagaagaagcatatgacaaaatccaacactcattcatgataaactctcttgataaacttagaggggaactttctcgtcttgatcaagaatgtctacaaaatccctacagctaacactatacttaaaagtgagaaattagaagctttctcactaagattaggaacaggcaagcatgtcccttctcacgactccagcaagacttattttattcactgttatatcaacccagcacttataaggagtacctgccatggtaagctctcaatacttgtccaataagtaaataaataaaaatagacaccatactgttttctctatatttaatacaatggacactttctagtctttaccctatttaacctgcaggatttgacactgcagcatttgacactgtactcgcttgaaactctttacttggatcgtaaaacccccagttcttcctctttgatcattctttctcagactccttttgtttatttgtttatttatttttgaaacggagtctcgcttagccgcccaggctggagtgcagtggtgcgatctcaggtcactgcaaccactgtctcccaggttcaagtgattcttcagtctcagcctcttgagtagctgggattacaggcacctgccatcatgcccagctttagtagagatggggtttcagcatgttggccaggctggtcttgaactcctgacctcaggtgatccacctgccttggcctcccaaagtgctaggattattgcgaccggctcagactccattttttttttttttttttttttttgagacagtctcgctctgttacccaggctggagtgcagtggcacaatctcggttcactgcaacctccgcctcctgggttcaagcaattctcctgactcagcctcctgagtagcagggactacaagtgcacgccaccatgcctggctaatttttgtatttttttagtagagacggggtttcacatgttggtcaggatggtcttgatctcctgatcttgcgatccacctgtctcggccttccaaagtgctgggattacaggcatgagccaccatgcccagccacttttttttttttttttttgagatggagtctcactgttgttgcccaggctggagtgcaatggcgcaacctcagcctcctgggttcaagtgcttctcctgtctcagcctcccaagtagctgggattacaagcatgcgccaccatgcccggctaattttgtatttttagtagagatggggtttctccatgttgctcaggctggtctcgatctcctgacctcaggtgatccgcctgccttgggctcccaaagtgctgcaattacaggcgtgagccactgtgcccagccccagactccttttataagctcattttctccactttaaatgtgatcattctttcaattccttactaaggccaggttctctatctacttcagggttctctattaataccaccacgttcagccgggaacggtggctcacgcctgtaatcccagcactttgggaggccaaggcgggtggatcatgaggtcaggagttccagaccagcctggccaacatggtgaaaccttgtctacattaaaaattcaaaaattagctgggcacgatggcaagcacctgtaatcccagctacttcggaggctgaggcaggagaattgcttgaacccaggtagcagaggttgcagtgagccgagatttcaccactgcactccagcctgggtgacagagtgagactccgtatcaaaaagaaaaaaaaaaaaaaagaaagaaaagcactactttcctagctctacacattccccctgagaggtcttaccattcccgtagtttaattaccattttaatactgaaggttcaaaatctgtctctctctcccctctccatatctgcaagtatgtctgcctaatggacatctctaagcatatgtactaccgacacttaaacctcaaaatgtgttaaaaactgaccttttcttacttcccgcccacttctttcttcaatattttgatctcagtgaaaagcaccacgattcacgtggttatttaaatgagaaacctttgctggtcgcagtggttcacatctgtaatcccagcactttgggaggccgaggtgggcggatagcttgaagtcaagatttcgagacctgcctggccaacatggtgaaacccggtctctactaaaaatacaaaaattaaccaggcgtggtagcacatatctgtaatcccagctacctgggaggctgaggcaggagaatcacttgaacctgggaggcagaggttgcagtgagccaagatcgtgccactgcactctagcctgggaaacagagtgagactctgtctcaaaaataaataaatagatagatagatagataaataaaataaatgagaaacctacaaaataacctccattccttactttacctcacaacccatatccaatcaatcacaaggttcaatattaaacaaaaattacatattaagcacctactatgtgccaggtattgttcttgtctctagggataaagcctgcttgcattggcttacattataaggacatttactgtttcctttattcattaatatttatttagtttctttaatttattatttaattaataaatgtggagataggttggttttaaggttaggtcgatagcttcacaatatcagaccactgcactgaactggcatctttatgattctctttgcattagaccctcaaggactgaagttggctctaggcatcatatcttcaaagaacatttccaaaggcagaaagcaaagggagaggggtgaaacaaaagggacttcctcaacggggtaatctctttttatcagagaagaaaatcattcccagaaagtcctcagctgacttgcctctttatgtcccattggtcagaatcaggtccaatcatgaaggaaactgaaaaagcaagtatctggcaaagggaaacaaggttgcatttatttgtccccggggactgagcacacaaataccctttaaacagtggcagataaaggaggctgtcttagcaaggaggaatggaagaaggtagtttttggaagggcaaccaagactgacttccacaaaaagagacatggagtttacataaaagaagaaactttaaacaagtaaataaatgtacaaacaaggtaatttcagattctgtaagagctgtgaaataagagtggtgtgataaaaagtagtgggcatattttgaaagtaaattgacaacatgaactaatgggactgaatgtatgagaaaaaggtgattccaagttaacactgattcccattcataaatgaagcttgagaaagataattaagggtctaaggtcataccactattaactgacaaagctagaattgaatctagtcctatctgacaccaccgaagtcaattttctatttttttcccttttttttttggtttttttttttttttttttttgagatagagtctcactctgtcacccaggctggagtgcagtagcatgatctctgctcactgcaacctccacctcctgggttcaagcgattctcgtgccttggcttcccaagtagctgggattatagccacgtgccaccagggccaactaatttttgtatttttagtagacggggtttcgccatgttggccaggctgatctctaactactggcctcaagtgatccacccgcctcggcctcccaaagtgctgtgattataggcctgagccactgcacccagcccaaagtcaattttctttccccagtaccatctatctgtggaaaagcagatgtaaatttataatattgggataaataagaatgaagttcaaatatttataaatagttaacacttggtaaattgttgccatttgttattttgtttttacttgtagagctagtgaaatgaacaaaatattttgtaaatttctgtgtctaaaccacaatatggaaactatcaaaaacagttacccactgcttagaacagtagcaaatggccatgatactatgtagcaaaaatgagaataactctaattgcatcacagggtttcccactacaccaaagactcaaagcaaacagttgcaggcctgaaagagtacaacaaaagaaaggcctatataatcaattaaaatgtgcagacagactgggcacagtggcctgtactgcaatctcagcagtttgggaggccaaggtgggaggatcgattgagcccaggagttcaagaccagcctgggtaacaatgagactccacctccacaaaaataaaaaattagccaggcacagtggtgcttgcctgtagtcccagctactgaggaggctgaggtgagaggatcgcttgagcctgggaggtggaggctgcagtgagccatgatcatgcccctgtaatccagcctaggcaacagagtgagatcctgtcttaggggaggaaaaaaaatgtcaagacagtaaatactactgtgtttatgttccagacatagataactactatttactcgtgtgtgtgtgtgtgtgtgtgtgtgtgtgtataggtatgtataataaatagaggctgagcatggtggctcatgcctataattaatcccagcactttgggaggccaaggtgggtggatcacttgaggtgaagagtttgagaccagcctggccaacatcgtgaaaccccatctctactaaattacaaaaactagccaggtgatggtggtgcacatctgtaattccagctactaaggaggctgaggtgggagaatcgcttgaacctgggagatggaggctgcaatgagctgagatggcaccactgcactccagccttggcaatacagcaagactctgtctcaaaaaaaaaaaaaaaaaaaacagaggccgggcatggtggttcacatctgtactcctagcactttgggaggccaaggcgggcagatcacaaggtcaagagtttgagaacagcctggccaatatggtgaaaccctatctctactaaaaatatatataaaaaaaataggctgggtgcagtggctcatgcctttaatcccagcactttgggaggccgaggtgggcggatcacctgaggtcgggagttcgagaccagcctgaccaacatggagaaaccctgtctctactaaaaataaaatacaaaaaattgctgggcgtggtggcgcatgcctgtaatcccagctacttgggaggctgaggcaggagaatcgcttgaacccaggaggtagaggttgcagtgagctgagatcacgcaccattgcactccagcctgggcaagaagagcaaaactccatctcaaaaaatagatagatagatagatagatagatagacagacagacagacagacagacagacacacagatgtaaaattagccgggcgtggtggcgcgtacctgttttcccagttactcacttgggaggctgaggcaggagaatcacttaaacctgggagatggaggttgcagtgagccaagatcatgccactgcactccagcctaggagacagagcgagactctgtctcaaacaaacaaacaaaacaaatagacctggccgggcacggtggctcacgcctgtaatcccagcactttgggaggccgaggcgggcagatcacgaggtcaggagatcgagaccatcctggctaacatggtgaaaccccgtcttactaaaaaaatacaaaaaattagcagccgggcatggtggcgggcgcctgtagtcccagctacttgggaggctgaggcaggagaatggcatgaacctgggagacagaggttgcagtgagctgagatcgcgccactgcactccagcctaggcagcagagtgagactccgtctcaaaacaaaaaacaaaaaacaaatatacctatgtaggttaagtatggattttttaaaaaatcagactttcctgtcaggtactaaagaggaggcaggctgggcatggtggctcatgcctgtaatcctagcactttgggaggccgaggcgggcaaatcatttgaggccaggagttcgagaccagccggggcaacacggcaaaaccccctctctgctaaaaatataaaaaatagccaggtgtcgtggcacatgcctgtaatcccagctacttggggggctgagccacaggaattgcttgaactcacaaggcagaggtttcggtgaactgagattgtgccactgcactccagcctgtgcaacaaagcaagaccctgtctcaaaaaaaaaaaaagaaagaaaaagaaaaagaaaaaaagaaaaggaaaaagaggcaaaatacatttatcattattcaatattattctggcataaaaatgtgttacagttgggtgtggtggctcatgcctgtaatcccagcactttgggaggccgaggcaggcagattacatgagtccaggagtttgagaccagcctgggcaacatggaaaaaccccatctctacaaaaaaaaaaaaaaaaaaaaaaatatatatatatatatatatatatataaaatataaaaatatatataatataaaaataaatatatatataaatatatatatatattttttttttttttactcctccaatactgggcagggctatgcccattgaatcatcagaacatcgccaggtgtgcggatcacaaggtcaagagaacgagatcatcctggccaacgcggtgaaaccccatctctactaaaaatacaaaaattagctgggcacggtggcacgtgcctacagtctcagctgctcgggaggctgaggcaggataattgcttgaacctgggaggcagaggttgcagtgagctgagattgtgccactgcactccagcctggcgacagagcgagacaccatctaaaaaaaaaaaaaaaaagaatcagctgggtgtggtggctcacacctgtaatcccagccctttgggagcccaaggtgggcggatcacccgaggtcgggagttggagaccagcctgaccaacacggagaaagcccgtctctactaaaaatacaaaattagctgggcgtggtggcgcatgtctgtaatcccagctactcaggaggctgaggcaggagaatcgcttgaacttgggaggcagaggttgcagtgagccaaaattgtgccattgcactccagcctgggcaacaagagtgaaacactctctctcaaaaaaaaaaaaaaaaaaaaaaaaaaaaaaaaaatcagacagaacatcatgcaaatatggacctcccctggctccctagaaaccaactgcaaattctctttttttttttttttttttgagacagagtctcgctctgttgcccaggctggagtgcagtggcatgatctcgcctcactgcaagctccgcctcccaggttcacaccattctcctgcctcggcctcccgagtagctgggactacaggtgcccaccaccacacctggctaattttttgtatttttagtagagatggggtttcaccgtgttagccaggatggtctcgatctcctgacttcgtgatccgcctgcctcagcctcccagagtgctgggattacaggcatgagccaccgtgcccagcccaccaactgcaaattcttataagagaatcctgtcccaaagatcaacgtccactgtcagcaggaagaagttacaaaaaatgaccttcacccttcatctccccttaagattagagtagtagaggagaagagtaaaggaggtattatgttagggaaacaggaacataagagttagggtaacatggccacgtacggtggctcacgcctgtaattccagcactttgggaggccgaggtgggcggatcacctgaggtcagaagttcgagactagtctggccaacattgtgaaatcccttctctactaaaaatacaaaaataatctgggcattgtggcaggtgcctgtaatctctgctacttgggaggctgagacaggagaatcgcttgaacccacgaggcagaggttgcagtgcgccaagatcacgccattgcacccctgcctgggtgacaaaaacaaaactgtgtctcaaaaaaagaaaaaagggctaggataacacaatttcaaaatcaattctaaatttagactagcaaagcctattccttaccagatacaacccatggtcataagatgtttacagctaaggaagcagtttattaatgctggcaaggacaaactcctatgacaacaaaatgttcggatgtcccaatatcacataacaatatacccttttttttttttggagatggagtttcggtcaaaaaaataaaatgaaataaaaaagaagttttcttttagtttgattactctgtgaaacctgaggtatttattatcaagaacctaaaaaaacaagccctcaaatacttccccattcacaacaggggaatacacagacagataaaagctaatagttttaggaaggtatctggggagacatataggcccacgggagcaaatccctgcagtggcggctctgataatctgcagagagctagaagggaggttctcccctcccccagaaaaatctatcccaaaaccataaactacatcgccaatccttggaaatacataaggtggttagggttaaagggtggcttcaaaatggttctagcagaaacctattgcggttactgaactattcaaaatatttgtccagagatagcttttctggataaaatagctttattcagagccgacagcaaaatggagttcagcagggtggttccctaacattcattcttcccgttaaagcaagctaattattttcagattcgttttaggaataagagtgggggtggtccaatggtagtgggttatcagaacttattaacattagtatcactaaaattgatatgcaacccccactgctaaaattgacaggcttaatttttttttaaagaataagaagagggacaaaataagtgagaacaatattcaaatatattcctgcctcctctatccagttggaaaaatgtatgcaaatttggattttgaatcaaatgcctttaacaagactaccaaaactatcggaaataaacaagaacctcttggtttgcaggtcaggttcagatgggtggagacacacatatatagatatatataactccttacaaaatacacttataaaccatatagatttgttatttgtctaaaatgaaggatgaaggctgtaccaaatcttcataggctaataactgaatatgaactatgaatttttagtgttttaggtttaacctttttcttcctcgtatactgggcagatattctgaatagtaacatcaatacgtttctgttaggaccattttaaagccacattttaaacctaaccaccttctgcatttccaaggattagcaatgtggtttatggtcttgaaatagattttccaggggcggggcggagggagaactagtctactcctataatgtgggcctccaagcactaagctataaccaattgatgtatcttgacacaaggccaagccgtcttatttacaaaactcttaagttgcacaaggaatccctacttcctaacatccttcagtgtcaaactatttcctccctatccaagtctttcctcacttcttcaactcagctaccacctctgaaatgtgtttttaaatctccttttcaaaaagcccttaggactgttccataaagttgatggcttagatctaaaattggggcctactttgcccttttaacagcttcaatgttaaatgcttgggcactactcttcgaatgactgaaatactatttgcttccagcgtttggtactcttactttggagaacaagtcattacagtaaaccatgtacacctattcggttttctaaagctcgcgtttttcacattatcaggtaagtaccgaatgcactgcctttaaaggaactgagaaaataaaaaggcaaaactcactgacaaactgtggcaacatgaaattaatcagctgagctatccgaaccacaactttctgcatttcacggtgcttcgtctttcaaattgtatggctctctcaagtcctgggtttcctccgaattaaggcaagcctcgtcgcccattccctggtcggtgtctttccgactcgcgcccgcccctcggcaggccctcgcagccatgcgccgcacactgcagtactggcgcgcgttgcccgcaggcgcggcagaccccaccccgcggccgcgcgaggggagggggctcggggctcggagcccgcctctgcggcggccaggccgggcgcggagtgggcgcgcggggccggaggaggggccagcgaccgcggcaccgcctgtgcccgcccgcccctccgcagccgctacttaagaggctccagcgccggccccgccctagtgcgttacttacctcgactcttagcttgtcggggacggtaaccgggacccggtgtctgctcctgtcgccttcgcctcctaatccctagccactatggtgagtaagccgtgcggctcccggctgctttcagggaagcagggaaaagcgagccggcggggcgctggggccctgtatacagccgggaagggctggcctcagagccgtccgtttggagggcggaaaacgaggcgagaggccagggcgggagtggtgagacctcggtgtgtgtaaatagcgggggcccggaaaggtcgaggggcgccaggatttcttctcggactctggaagggatggggggctcgggctgccctccgccgtatccggagctctcttttgtcgcgtaactgtgtcctgggtgcggtccctcgagtccccgcagtcctttccagcgcatgcccttactccgccttgggtggacgcgcgcgcggactcttccagccctcacttcctcttgagcgcgaaaagcgggggtgggaagcagctggagacaaaagcgcgcacgcgcgaccgttaccttcccgccgctcctgggcgggaaaccgccactgcgctttgcgcatgcgctctgggtcgcgacgcgactagggctacagggcgtgtctcctgttaacctgagtgttctttttttgatgaaagcaataagaggactgcggaagagctccctgtcaatgtaccgctctacaccagtgtattacgacagttcgtacacaacagtctgtagaggccacctgtctctccctgctgcgttaggaattcaggggagcaggtggtggcagtaagggattttgagggaacggaaatcggatcttgacccagatctgggccgccgataatctcctactgcgctcagactgctgtggaggtgttaggctgagcccgatgccggcaggcaagggaggatgggcggcttgggcagcgcctttgcagacgtggccatttcgtgcctctgcagcaccgccggggggcgcaagagcgcgcgcccggaattgctcattcatcctgtgccgcagagccccgccccttgtccctgcggacagacatttcttctgcgctggtctggccacgtgcttcctgtgctaggagctgcccggaaatgtgaccacctagtctaaagtgggcttctggggcctgagcgctggatggatgcccaccttcctgtcttggtcctccaaaggaggaagctgtgactgagctgtcttggtctggaaggaggccttcccggtttaggatgggaaggtaacattcattaaaagcaacgtagactatagtgtagctgttctcaaaagtagtacatcttagaaaaggatctttagaaaagatcgctttagaaaaggaaattcgttttcagattacgtgagtagcctaggtaacacagccagacctcatctccacaaaaaaaatgaaaaaattagccagcttggtggtctgtgcctgtggtcccagctgctccagaggctgaggtggggggatgactggagcctaggctgcagtgagcctagatggcatcactgcactcaagcctgggcgacagaccttatctctaaaaaaataaagattgcatgagtattttgttccacttgacagtcatcaatagattggtttaaattgtgatatcttttttccttcccgcagcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattggtgagttgacctcagtaacctgagatcccaggatgctgggacaggaggtctgtccaggggcttctcttgtcactcactcactccctccgtccttctctccctcctccagatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggtaagcaccacatataaatatgcatttaatgtggtgtgatagttccagtgcaagttgggtggagtgactgacatcattcattctttggcacctaccaaaatgtggaataggctgcttgctatattaattggacttctaaatcagatagtccctaggttatggacagtttgtggatatgtctgttttgccaattccttgtgcttacatcagtgagatatggttcgtaatctaaaaagttgaaatagaaattctaagataatgtgtcctggcattaaaatattacatttttttattcccctacaggctgaccagtgcaccggtcttcagggcttcttggttttccacagctttggtgggggaactggttctgggttcacctccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatca

SEQ ID NO: 37752 - DNA, 8252 bp, Homo sapiens; identical to SEQ ID NO: 37182

SEQ ID NO: 37753 - DNA, 93629 bp, Homo sapiens
ctttgccctcagccaagatggcggctgccgtggaccctgtcccggctccgccccgcggccctggccccgcctgcccctcgtcccttcctccgccccctctcctcgcgtagtccggcccgagccgctcgcgctaggagagcgggcttcgggcacttgacatggcggcagtggcggcgactgcagcagcgaaggggaatgggggcggcggtggcagggccggggccggggacgccagcggcacgcggaagaagaagggcccggggcccctggccacggcgtacctggtcatctacaatgtggtgatgacagccgggtgaggctggggctcggggaggcggggagccagcgcggccggggagggagccctgcggccagcggcggggcggataggatcggcgcggcccgccgcaggcagtgcattcccggcggggggtgcccgggacccggtacctgggcgctgagggcggccgagcgctgaatcggccccggtggctgcccgcgagctccctcctgcgctgggggtcgagccaagttcccaggcactggggcgcggggacggctgccgggcgctggctcgcgagggccgcgggaggaaaggtggggctggccacaggtgcggggccgggggcagcggccggactacctgcggcgcggagcccgtcctgggcggccagattcggatgttgaacggcgccagcatggggagtggaggagctgtggctgcagagtgaccattcatttgggcggctgttttcaaaatctgggctgcgctttaatctgaaaggtattgggaaagcgttcaaagtttttggccagcgacatgagcagagctaggctttagatgagtttagacttttaggatgggttggggtggggaagaaactggggagtagaaggcagagttactggaaagggggagaatggaccctcgaaacggttttacccatcttctgtctctttcatttcagtgcatcccttatcccggcgggtttttagttcaagctctgccactaactagctgtgtgactttggataaatcatcttatttctctagcctccgttttttcatttgtaaaactaaagggttggtctgggtgatgaaggttccttcagctctgcaattctttatcttgtcattttggtgaggaggatcacagcatcagacagttatatatttttaagttatcttcatttgtaattttttaagaagtcctaacattttattatgaaaaatttcaaacatacagaagagttgaaagaattgtatagtgaacatccatttttatttaaagtaggtgatacattgttagggttaaaaatgaaaaacatgagggaatacagtgaaaatctttcctcccacctttcccttctacccagctcccctccctcgaggcagttaattttgtgtatccttaagatgctgatgcaagcaaatatgtttatacatccccctatccctttttaaaataagacaaatgccaatatattaatatttttacagttcagcaccttgcttttttttcacgaagaagaaaatatatcgtgggaggatcatatatgtattgctagtattagaaatggtaggtgttggaacctaggctcagagaagttgtgacttgcatgagatcatagaacttgttagtagaagttccagatctagaaatcatttctcttgactcacaggtcaatgaagaactagtacagatacaagctttatatcacatcagtggtcacatagattgatttttaaaaaaacatccaggaatctcactgtgtgtattaatatttatatataaaattcttgttgtcttagcaagagccggtgagggcattggactggagagggattttgaggtacattggtaagaagaaagaagtctattcctgagcaatgaacatagagaatggggtggagggtaaggagtggtatcttaaaccaggaagataaattgggattgtgagagcaaagtaagctttttttttaaggctgttaatggttgtaccagttacaccattaaataatttcttcttttacaaactcttacttgatgtccttatgtgatagtttttggaaatagcatagaccacacacaccccattgcctagttgatactatacatttatctaaatccttccaggagacataccttaataaaaaggtccatttgttttattatggaacttaacaaaacattgtgtttatttttgagaaggacagtggaacaaaaatataacattcacagctgtatgcttaagtgctttcctgtttcgtggtttgtattgatctggctttcatttctgcattgattttaggaaatttggctaaaaaactttttttttttagcaagagccctttattcgtaattttaaaaggatagattttaaggtatgggtaattgttccagtgagacaattataacaatagtttaaagcatcttctttccaccctgtaattattaaaaaccctttaactgcacaggctgtttaaaattttcctttaactgtttttttctcgtcttagattttcttggcacctgatttagtggcacaaggaccattttagcttattcctttccttttggccttgatctcaatagcaaagttgccaaaaaaatgagctccagatgggtgaggtgccactatgctttcactgagccctcttggtaaggtgctgtcggtgttgcaacatttcagtgcattacagcttggcatttgagagctatcgtccataaatccaggttactcatgcttgaggtcacctttagcaatatcttttattgccacagctgtgtgttaacctaaatgctactttttttatttttattttttcctgattgctgttttctcttttactaggtggctggttatagcggttggtctggtccgagcatacctggctaagggtagctaccatagcctttattattcaattgaaaagcctttgaaattctttcaaactggagccttattggaggtaggtcctgagatttattgttgttattgatttccattggtatgaagaaaaacatgcaactaaattatattgaagtagcataccccctttggattcatgttaaattttgaaattttgcctcctcacatactaaagtgttgatacctaggctttttgatgttctagattgggtagaatctcatttaacttaggttaccttgaatgtattttatattcgacttttttgggaaatcaactgaagcaagcttatattaggatttttaaaaattctagggacatcctggggaagcactggcaaaatcagatgctttcagggtttatgtaatagaaatagtgaagttggtgggtgtaggatattggaagtgatagatagaagacataatagagagcctgtctagaggcgtccaaattttaaaaatttaacaaaaatgtattgatttccctgcattaagggcaatgtatatccagccctctctcttggggtaagtatagattaggattttggaattgcaagggacaaaaacccaattcaaactattttaagcaaaaaaggaattttctggcctctgtagttgatacagatacaggattaatttacaaagaaactagctcaggaatgagaaccaaggagctgacactgccagattctcttgctttctctcatttctgcttgtctgtttctctttgaatgttggtcttgggctctccacatggtgggaaacagggagggtgtttatttttcgcagcatctgtgtcacacagttcccagagaggattctggttggccctacttagactatgccagtgatgtgaggtgcttgattagccaatcttaggacacatgcccattcttctgtccaagggactatagactttgcttatggaaaagagggatggggatagctttgggcacacaaaatcaatagccgccatagttcgtatatttcattatggtgaaaaaccttcagattgcagggaagatctggttcattttgcttagcctccaggcaagaccatcataacatttatactttactggcaacttttaaaacctgaactatggaatgatacttaagaaaaaatcatttatctcgctgggcacggtggctcacgcctgtaatcccagcactctgggaggccgaggcgggtggatcacgaggtcaggagattgagaccgtcctggctaacacagtgaaaccccgtctctactaaaaatacaaaaattagccgggtgtggtggcacgggcgtgtggtcccagctactgggaggcaaggttgcagtgagctgagatcacgccactgtactccagcctgggcaacagaacgagactctgtctcaaaaaaaaaaaaaaaaaaaattctttatctcatgaaatgaagtgtgatacctctacctttcattctcaatttttttttttttcttgagacagggtcttgttctgtcgcccaggctggagtgcagtggtgccatcatggccgtggctcactgcagccttgaactcctgggaccaagcagtcctcccacctcagcttgcagagtagctgggcccacaggcttgcaccaccatacatggataatttttaaaacttcatagagacagggtctccctgtgttgcccaggctggtctcaaactccttggctcaagcaatcttcccatctcagcctcccaaagcactgagattacaggcgtgaaccactgcacccagcccactctcactttatttatttatttttttgagagagggtcactctgtcacccaggctgaagtgcagtggtgtgatcactgctcactgcagccttgacttcccaggccccagccatcctcccacctcatcctcccaagtagctgggaccacaggcgtgcactaccgtgcctggctcatttttatatttttggtagaggtgaggtttggctgtgtttcccaggctggattcactctcacgttctagatcagaaagttatccattttgcttttgtttttttctcttagaaggcagaggaatttctttttttctttctttcttttttcttttttttttttgacacagggccttactctgttgcccaggcaggagtgcagtggtgggatctcggctcactgcaacacagaggaatttcaatagtgtccaaacttaggcattttaagtaggtggtatgatgaaatgagcttccagctggaagcctgagtacctttttattttaagtataatagttttcccaactgactctatagatttgggcaagtcttttctctcgtatccacctccttttcatttgtaaataattaggttaaagtagatttctaaagtcccttactaccctaaatttgagtgtgaggaaattttaacaaatcctaatgtgaaccattttttaaacttagaggcttgaactttttttggaagcggacactagtaaataagtagtactttctctttcagaaccttggccagtacagttcccacaagctacagagaagcaaatttggagtcaagaccatcagacttccagtacttgatatagtagggggttgtccccatttggaatacttcaataatttaaaggggtttctatctctttaagacatcataatattagagctgagcacagtggctcatgcttatagtcccagcaatcccagagctttgggaggccaaggcaggaggatcacttgagggcaagagttcgagaccagcttgagcaacatagcaagacctcatctctacaaaaaaaaaatttttttttttttagctgggctgggtggtgggtacctgtagtcccagctacttgggaggctgaaatgggaggcttgagcttgaacccaggagtttgaggctgcagcgaactatgattgcatcactgcaatccagcctggatgacagagtgagaccttgtctcaaaaaaaaaaaaacttggtaatgttagaagtataatttttaaaatttaagtatatcttatggaaggtagggacattaaacagtgtcatactttaaaatccactcaggaaccaagtcttagactttgaaggattagcctgtttatccttatagaatttttaatagggatttaggaaaatatcttggatttttggttttatctctgttatccccactaagaaccaattaagtgacaaatcctggatttgattttgggaaaatgtctgtgcataaggaagtgaagactcccaggaacatgcaggcaattaacgttgcaaaggtcagtgatggaagtaatcccttggactgggcgatagagcaggcttgctaaaaccacaatttctgtggttgaggagtttttcattgcctaccccatctacactgtgtaataattagatgtgtgtggtattgtttaattacacataagttatcctgatgggaattattagtgttgacatatatcctgtttacaggaggagaaaatgaatccagggaaggcagctactcatttatatctctttatgctaaatgttattctttattaggttctgtgggagtttacttaaaaaggaaatcgaaattacttgttctccaatttcacatcttcttaagaaaataataacactttgctttttaaaagacataaaaacatttaccaagcaagtacaaaggagcatgtagtagcaaggtacaaaaggaagcctggctgagtaccatggctcacacctgtaatcccagcactttaggaggctgacatggggggattgcttgaggccagaaattcaagaccatcctgggaaacatagcgagaccccatctctacaaaaaattaaaaaattggccaggcatggtagcacatgcctgtagtcccagctaatcaggagactgaggtgggaggatcacttgtgcccaggagttcaaggctacagtgagccatgatcgtgccactgcactccagcctgggtgacagagcaagaccccatttccaaaaaaaaaagtatctataaataaaatgctactcatggataaaatgtggtctatggatataaacattcataaaattaataaaggcaaatgaattactgatatatgcctggataaatcttgaaaaaatgcatgtgaaaggaggcagatacaaaaagtcacaaatagtatgatttcatttataagaaatatccagaataggcaaatccatagtgacagaaagtagaggaattgttaggggctgtggggagagagagtggggtgtgactgctaatggtacaggatttccttttaaggtgatgatattgttcttgaaatagtggtggtgggtgcacaactctgtgaacatattaaaaaccactagattgtacagtttaaaattgtgaattttgtggcatgtgaattatatgtcagtttttaaaaaacgagttcctctgtaatgagttgtgggtgttttctactttattcatttttggagtccatgatattcattgatgaggcagatgttatctttgcatatttgtcaagtatagttagattaaaaattagtggactaatgcagttatggcagtttaaaattatgtttgagagaatttgggtttctaaatatctttggttaacataagactgtaattatagcaaagacactttcttttttttttttttttttgagacagagtctcactccatcgcccaggctggagtgcagtggcgcgatctcggctcactgcaagctccgcctcccgggttcacgccattctcctgcctcagcttcccgagtagctgggactacaggcgcccgccaccacacccggctaattttttgtatttttagtagagacggggtttcaccatgttagccaggatggtctcgatctcctgacctcatgatccgccagcctcggcctcccaaattgctgggattacaagtgtgagccactgcgcccggccaaagacactttcaaatactcatgattggatatgcctctgtgattgacagtgagatttcaaatgggttaaagattgctctgcaaagaggttaactgttgagattgatacaggctatcttcaacatatgtacattgctgtatatgacatttacctaccattgtgcatctgggacttcctgatggaccacaggaattcccttttcttcccattctcttccagatctttcttctacttgaaaccccttatctacaaaaatgaataaacaacccaatctcatttctgatcgtgtcctggaattgatctagggcaaggtctggagaagtggtgggagacagcagacagcttttgttagtcttctaaccccagcactttctcagcctcatctgtgtgttcctgtctcactctgcagacctcacttcacaatgctcttcagatcctttaatgaataggaaattgattttgggtatttctataaaatacagcaaagtcttagaaacttgcagtgtccttaagaagaaagatcccttcttatctccctgccagtttttctttctttatggctcaaacactaactgatttttgccatggaggtattgtgcttcagactgcttttgtgaactggtttgaggacataaccgttgtctgttatatttttccttcttgtggaaacattctgatttcccagtaatagtctcaaaaaggaacttctgaaatgcaagctacatgcatgtgttaggctccttttattctggacccattttgaggaaacacatctctaaaagaggcttttgaaaagctagcaagagcaagttatagtgtagatatctaacacaaataggaatgacaacaaatcccagaaaaaccagcttctcaaacagtgtgaaaaccagaggaaaactctaacttgattaaaattaataagtgtcacaacattagaagggaagagagagctggaaggaaacaggaacccacccacacaggcctcactgcttggtgactcaagcaaatagaagcaaattgatgtggtattcaaagaggtacaatagctaacatctgtagaagggaatgtactgaaattaaaaaaaaaaaagaactaaaaatatcaatggtggcaatatagggcacgaaggagccacagtgcaagaaataggtgatactgaagattcaaaaaaggcgggagtttccactcacgttctcatataaaatgaattgcagaacagaagtcatagggaaattttcaaagttcaccatgtaaaagaaacattacaaaacattataacagaaaaacaatatatatagaaccaatgtatctagaaaacctgatgaggttgtataagctttcaaaaagtaagactaccagaggaagtagaaaaggttggaatatacagcttataaataatcagggagaaaagttatagaaaactttgctgaactgaaaggccacctcactatggttagtgagagtttatggtgttccacaacaaaaaaatttcttcccttcctgagtacttaaacaatttccagcataaaagagcagattttaaaatgtaatagttaaaaacaacttgggaccttaaacttgaaagaagaaaaaatccccgtgtagtaggaaatattaggttcctggataacagaccatgcagtttcctaaagctggaaacattttgaaaacacttagaaaagctaatggaactttgaaagcaccttaccaaagattatttaactttaatcagagtagttagctgttatcaaagagtaactgttatataaataaataaaattaaccaagttttcagactagcactgtccaataggactttctgcagtgataacgttggaacgctgtccaaaacagtagccactagtcacttaaaatgtggctagtgggtctgagaaactgagtttttaattttatttacttttggtcaggagtggtggctgacacctgtaatcccagcactttggaaggccaaggtgggaggatcgcttcaggccaggagttcaagaccagcttgggcaatatagcaagacctcgcctctgcaaaaaattttaaaaatttaaaaaattagccggatacagtggcgcatattagtcctagctactcgggaggctaaggcaggagaatcgcttgagcccaggagtttcaggctgaagtaagttatggtcactccactgcactccaagtctaggagacagagcaagaccctgttttccaaaaaaaaaaaaaatgaaaattctttactctttatttaagtttaaataggcacatatggctagtggctgcacagtataagcctttagaccacggtacagaatgcagtgtgatcatgtggaatcccataagatatttcagattttaccaggatagaatgaagtgggaaggaggataaacataacgatgtaaattttgtatcactccagagttcataaatttttaaattgataatagaatagttatatgctgatgttttcagattaggaaaatcaatagggaataaaagcacaattgcagatactgaaaaaggtatggaagagtatatatcaaactgttaattagagcttacctctggaggggcgtggtattttggggcaaggggggagtaaaagattaccacttttaatatactttagtatatatttatatatcacatgaaacatgtaattttttaaaataaaattctatattatatgtaattgaaaacaagatgaatgaggaaaataagattttaaagttttttgaaaaaggaagacaataggcagcttattttatttttcgatttaaagagaaatagagttttacatctacaaatcctgttaatttttttaatggcaggagaataataaacctatagcataatagagtatagtaaaaatacatcattttttatgtttatacaaatggactgattaaatttatcaagatgaaaagatgaaatgatggttactggttaaaaactaaagtctaacaatctgttgtttatgagactgactttaagtttactaagggacaaaccagcttgccatgaccaagtgtcaagaaaagcaggactacccagttacagcataagataaagttgatttcggagcagaagctgaagagaaccttagttcacagtttgtcagtagcaagaacatgggagacacatgttggtgaaatcatatgatgaatgaatgattatctgaacagagaaacaaaatatgtaaaaagctggcagaaatgctatagaagttaaaaaatagaattgttcttaagaggtgtcacagtttgggtatgaagacttggttttgccattaattagccctgtgaccttgatcttaacctctctcgccctcgattcattatgtgcagtgaatacactggattaggtgaccttacatttttccccacttttaagttctgtgagacttcaacatttcactatcaaaatatgaaaattaagcaaataatgaattagtaaattataggggtggaaatagcaagaaaggtgaaattaagtgataaaggaaaaataatgataattgaggaatctttttacctatttcgtccttaaaaattggatgtaaaaggattttgaaaacatgtttggagtctgagggagcccagtgaataaccaacacccttttgcttgtttatgttctgaacattgagcagtaactcaaaggagttacataaggatcctaaaaatcacctttattagtgataaaggctgaggacatgctttagtgtgcgagtcaaatgggtttgctaactgaactccacagttagactcaccactcaccctgtcctgagcagcagcagatgggctgtcttagaagaaaccatgaaaacttgaggttctctatgaaacctctctagtggagctgaattgaacacaccccatttattcttcccaaatttacgctcaaatgagtcatcctttccagaggtaaagtaattaaaggagactagtactatgtggtggaaatccatccttatagaaaccagaagagagtggaaaggtgttttcccccagtaataagtactatatattcattgtagaaaaaattcagatgcagaagaaaatgcatagcagtcataatctaaagataaccactgttaacattttggtgtctatccttgaagactatatattattattattaagttttaagcaagaatgaaatcatatatgtgtagaatatgataattcctaaaacaaatcaaatattggtagatgtaactcaaattggttatggacctctgcaccgtaaaacaagtgtcgtggacatgtctgtggagctgcccagctcagcgtatcctctctggaatttgtctggttctcaaggctggacccttagcagctacatctctattccctgactctgcatcttaggccatagctggctgatccaggggtgcgtaactgagccagagtgggctagtcaggttttttttttcctcccaagaatttggaattttgaattgaaagacagagatggggaatcactgtagatgaatcacattaagtccatgggctgcagctgaggtcttgaaagctgcttgggtttctgttccctttgagacttcttaaactttttggggctttgttgttattgttttaccttggattaaaaatgaaattgaacagaattgttggtaacctacaaaaataattcccctagttcaaattttagaaactttgaaaagatgtttccaagtaatttattgtgcaaatggcaattttacattgaggttaaattttaaaactaaaatcagtttattgccagtggaaatggaagggacacaagaggagagaggagtttatggttcatattttcttttcttttctttgagacagggtcttgctctgttgcccaggatggagtgcagtggcatgattgtagctcattgcagcctcaacctcttgggctcaagtgatcctcctgcctcagccttccaagtagctaggactacaggcacatgccaccaggcccagctagtttttaaaattttttgtagagctgggggtctcactgtgttgcgcaggctggtcttgaactcctgacctcaagtgatcctcctgctttggcctcccaaagtgttaagattacaggtatgagccactgtgcctggtgcaacatgtattttcaagggagattttgaatatggcaagtcatctaaattttttttgatgaggtgtgcttattcttatccagtgattcttggtggacctcaacaaagcagtgccaccacttcacttcaccacttcagagtgcattttggaaaattgtgagagtatttcaattgccacaatgactggagatgctactggctagatgtcctacgatatgtagacagtccaacttcatgaagatttgttctgcatcctccttggcttctgcatatctccccaggccaacccctctacaaatataaatggaccattttgtagtacatattaatactgaaaaatcttcaggaaaaattaaaaagcttattaagttagaagaaggttgtggtcttagtttttgttgctgtaaaacaaaaataccacaaacctagcagctgtgaaaacaatgctcatcgattagctcatagttttctaagtcagaagctgggcttgactgggttctttgctcgggggtctcataagattgaaatcaagttgtcagccaagctggctgatttcttatctggaggctccaggggaagaatccactttcaagctcatccaggttattggctgaatctagttgtaggtgtgaggtctgcatttccttgctagctgtcggtaggaggttactcctcattcctagaggctgctctccaggccttgcacgtgactcccctgcagcttcaaagccagagtggcctgctgaatccctcttgttctttgaatatctctgacttccccttctgccaccagccagaggaaactgcttttaaagggctcatctggttgggtctggtccacccacataatatctgtatcttcaaatcaattgacttgagactttaattacacttgcaaaatccctacactgcagtacctagattagtgtttgattgaatagccaaggaacagtaattgtgggggatcgccttaagaatgctgccctaccaccatcattggtatgaaacgagaagcttaagtgaaatgaaggtattgtctcaaaataattaagtaatttattctctctgcacattctgttctgtaagcattacagcatttctagtttgcatatttagttgaaaaggatttcagcgcagtagtgaaaatcattgaaaatcagttttgagattcctgtttagacttcaattattaaattattggagacacatgatatgtagggatttcattgtatttctttcatatagactaatatttcatattattgcctgtgtgtgtgtgtatgtgtgtgtgtgtgtgtgtgtgtgtgtaatggtatgaaatctaggttgtgaaatgtaaattttattttgggatagctcgtcttctgttttgtcctaaaagtatcccctgttaaacaatggctttattgcctcttgcattacagtttttttacatctaattcctctcctattccttgttgcaccatttaaagaatacgttttcaaggtctttttacagaccgtacactgattgtatgtctcaataggatttcaaagcagaaggatagattttctgtgatactttcctccgaccccatcccatgacataacctaggagattatttagattattttgacactttataaataaataagacctagctgatttgaaatagtaatgtactccttcaatttctctactttgactgttacttactttagcatgttattccaactttgtataaggttacttctttatttctattattaatactcttttttccaagtattaggctgtacctctacatctgcccttttattttcctgtgcttgtccacagtggtttctgttactctaatttttaaatccaaacttattttcataatttactatgtacatctgactacatcattatgtccccatttacaagttgaaatacgtattttgaaaaataaattactttatttcttctttgtgtatcaattgggacattgtatttatttgcttttgaaaattttgtgtaggtaggtcattttatctatgaatttcttttcagaatggtagaggaggcattataaaatatgtgtgattaaaaaggggagagtgcatctgaggactgagacctactgctctgtcatgcaaagaagacatgctagccattcattgctgtgtgtcctctcctgcagtgtcctgttgctaatcagcagcctggatgtctttttttttttttttttttttttttttttttttttttttttgagatggagtgttgctctctcgcccacgctggagtgcagtggcgcaatctcggctcactgcaacctctgtctgctgggttcaagcgattctcctgcctcagccttctgagtagccgagactacaggcatgcgccactatgcccagctaattttttgtatttttagtagagatggggtttcaccatgttggccaagctggtctcaaactcctgacctcaggtcatccgcctgcctcggcctcccaaagtgctgggattatacgcgtgagccaccatgcctggccagtctgggtgtcttgctgcatacatggatagaataggttttctgggccgggtgcagtggctcatgcctgtaatcccagcactttaggaggccaaggctggcggatcacttgagcccaggagttcaagactagcctgggcaacatggcaaaagcctgtccatacaaaaaatacaaaaattagccaggcgtagtggcaattgcctgtagtcccagctactcaggaggctgaggtgggaggatcgcttgagtccaaggaggttgaggttgcagggagctgtaattgcaccactgcactctgcctgggtgacagaatatgatcctgtgtccaaaacaaatgaacaggttttctgtctaggtactgtcatctgtcttcttgtttcaaataatgtttttcattccccattttgatctagatctgtcttttagttctcctgaactttgcagcaggaggtgtagcttatcatatttacactttagtatctacttaacagtgttttctattgaaaaagactgtaagatttgcaatgtggtaattattttgttctcctgtcagttaccagcaacattgtgcagcttgatttgtttttttaatccaatctccccacatccctcccccacaaattgagtgaaatagtagtttttgataaggcacagagccttatcaggctcaggcatgttttagataagctaagtcttgtcaagtctgactctgtagatctctcataactaatgcacaatgaaataatatgatagaatagaaataaaacctaagttcttggtcctgaccatcatttactgccctgggcaagttgtgtggcttctctgagccttggttttcttgtctgcaagtagagattttctgtcctgcctatctgccaggtaattgttaggatcaaacaatataaagactgctagagaaatgtaaaaattctgaaatgccctacagtagctgttaggttatatcacctagaaaagctttggtcattaaatcaatcttataaatggcttcaaattacttttttgccaccaccacccccagagttaaatcactgctatattaaggatgagttggaaggggatttagaaggacttaatttgccagttggatggccattgagatggagtggagatggcagtctcactcaacgcactggaaataaaaatggggaagacagaccccagaatcgccagcaggacttagaaatggttgtacttgaggatgaggggaaggaaggactgttgaaccccaaagactgggaggctggttatcaagagggataacgggcggaatggaaggaaagcgtgtgcttcccactgaggctgtgtttgagccgctgctgtggctcccagatggagctgtccagaggcagcttgggatgtaggcccagatccccaggagacagggttggattggaccagagagcacctctgcagtgagatcattgaatgaggcaagatggggactgagggtggaacttagtagaatgaatgtctgcattgaagggcctgccaggcaagaagagccaacaaaggcccttctcaccccgtgttccggagtccgtggtggttctgttctatagcatatgggacatggagatgctgtacacttattgctcttacaagtttgtgcattatgaaagagcccttgatatctgataagctactgagtgggaagagtaaatcctcctcagaaaatccttcaaagatacacaaactaaaaatgaacaaacaaacaaaactgaacaagaatttacattttgttaaacagcttgtagccaagtttaaaaatggaatgttcatttttcatatttaatactgctggcagacgctgctctattcttactgaaacattagtttatatgaaataaaactttaatatcttgattcttactaattctcctcttttttccccttttttcctctagattttacattgtgctataggtaagtatggatattcccccctactatgtacagtgaattctgcttatttaaaaagtcatagatgataggctttattgatttctgttaaatattgaaaaaatgaaatgatttagtcatcatgtatgaaattgctgaaattagagtggctttcagtttctgaaatcataggtactatttagatgtcatgactgaacactttattaaagttcacagctattttgttctgttaatttaaaagaggtgtctcccaccttctcagtgtaagggtaatagaaacattagcatttttgtaaaaatgtggctggagttctggtgctgggctgtgttgaaaagccctctctgtgatcacttaaatggtatcattctctctccttatctttcaaatgggagtattgcctacctcccaggtgaatattacatgtttgtgagagggattaaagaagtactacgtataaagggttatacaaatgtaggggatttctactaaaagcagatacaatatgttttattttcctttttgtggggaggggcgagtcatcaaatattgctgtggaatagaggcataacgtctagtttggggtggctagaaccttctaattgaataaaatccagtcttggaaagttgatagaccctatagagcaagaccgtagtgattgctgtgcactccaggtatgtctcccaaagggaggatttgaagttgatacttagaagcactgaaagtcaaaaaatttgagaactgcaaatctataccgttatggccccatcaatttaatccataactaaagtgggtagttgctatattcagggaaacttacagttcagatgggcgcacaggtagagaacaccagactgtccactgtgggtctagcagaggtcactgtgatatctggctccattaccttctttttttgttgttttagggacagggtcccaggctagagtgcattgatgcgatcatagctcagcctcctgagtagctgggattacaggcgtgcgccaccatgcctggctaatttttgtatttttagtagagatggggttttaccatgttggccagcctggtctcaaactcctggcctcaagtgatccacccaccttggcctcccaaagtgctgggattacaggcatgcagtcaccacgcctggccaagaaccttattataaagaattgcaccttgggccaggtgtggtggctcatgcctgtaataccagcaccttgggaggctgaggcaggaggatcacttgaggccaggagttcgagaccagcctgggcaacacagggagaccccatctctacaaaaaataaaaaacgagccaggtgtggtcgtgcatgcctgtggtcccagctactcaggaggctgaggtgggaggatggcttgagcccaggaggttgaggcttcagtgagccacgatcacaccattgcattttagcctgggaaacgagtgagtctctgtttaaaaaataaaaaaaaaaggatttaaaagatttgcatctctgctggtttcccacttcttacctgggattacgggtagagagtccagggaccccctcaaatgatgtgcaaaattttatacgtatgtttctgtgtttatttggaggggcgtgtagggagagaattcatagcttcaattagattctctgaggagtctatgattcccaaaaggctaagaaatactgcttaggacctttgaatggtagatttgaaagtggcttgggggctcatctgtcccgtggtctgctttcccagagaaaactagtgatctggcccagctcatacagctggtaaatggggaagctcatttggagacaggtcagtctgacacctgcctgatttcattttatgatgaatgggtattaaacttttgtgcagtcttacacgcatttcctttttagtcctttttaattttgaaatgaaaaattttatcctttcataaacggttaaataaatcttaagcacatcctagcagattgggggatatatttggccagagagagttctggaacctctcaggccttctccacatgactgaaccctgcctcattcttcctcaactctcttaaccttcagctgtctctgtataaagctctcagatgcgtcttttccaagtatcttagccggttctggctgctgtaacaaaataccataaattgggtagcttataaataacaaaaatttatttttcacagttctgggggctgggaattccaagatcaaggtggtgctgacagattccctgtctggtgagggcctgttgctcatagacagtagcttcttactgtgtccttgtatggtggaaggggcaagtgagctcccttgggccttttataagggcactaaccccattcatgagatcccttgtgacctaatcgcctcctgaataccccaccacttattacttttgcagtgggcattaggtttcaacataggaattttggagggacgtagacattcagggtacagcaccaagcatgtgtactatgatttttagttaatgttagttttattttaataccccaaatccctttatctgtcttaaaatatacccttatatgtctttataaaatttctctacacctggaaataaagtttctgacaagtatattttttcattcacaccaagaaaattatcgaacgcctagcacgtgtgcataccaggtgctgttgggcagtgggagtagagaggtgaatgggctcagacctaggtccaggaaacccacagtcagatgggcatcccctgagttcctctggtatagtccatcctgaggactggtgtgcacatcacatgctgctcagagggttggcaggtttgcttccccctcagactctgagctcctcgagggcagattctgtttcattaagctctgcatccccagagcccagcggcaggatccttcttatatcctcaaggaccttgttctgtctgtacatctcttgctcctgcctcatcaccctgtgctatctgccttttccttctcagtgcacaaaatgctcagagcactctgtcttaaaaatcttttaacctggccattgaccctgtatttcccttatactactatataactgttctccgtcccttttcccagatttatggtaggctctttctacttcctcatgcccatcgatacctgaaccctgcagttgggtgtctgttccccttgttctacaaaaaatcaccctctggtctaaagtcagcaacaatgtctactggattctaaggacactgttggaagttcctggacttagctacatggggcaccgctgatgactccctcctggagatcctgctccttcagccttcgttggactgagccctcctgaaataccttatcctctgtggtccttttctttctttgggtgcttttctttctttccttgtcccttaatcatgagtgtttctggagttctgtcttagctcattgcccttctgactgaacataacctctgtgggtgatctcttctcatggcatgagatatgcatacctttccaattccaagccacacctgcatcccagactccagccctgtccactgatttcctggatgtctgctcctgggtgcacacaggcacctcctcagcatgacccacactcccagactcgttctacctcactattctgtctgtcagggctgccgccggccaccagccattcagtcattcatcccagacgagaccttgtcgatagtgtatgctcctctctcaccggcatgcctgtagccaggcagtcatcaggttttgtcaattcagtttgctgggtgtctttcaggttgtcttgtttcttcatccctacttgggacctcagtacgtctcatctggattcccatgtatcttcctgaatttctaggcttatagcaataataataataatgagccaccatttcttaaatacttactgtattccagtgctttacattcattatctcatttgcttcccatcttccagctgagactgagggttagaaggtttcctgtctttgttcttaccacaaataaatgtgtgaggtgatgcatatgttaattagcttgatttagtcattccacagtatattcatatttcataacatcacgttgtacaccataagtgtgtgtgtgtgtgtgtgtgtgtgtgtgtgtgtgtatatatatttttttgtcaattcaaaaaagaagaaatgtatcatgtcttgccaaagttcacacagcactaagccctagcccaggacttgaacctatggctgtgtggctccaagtccatgctccacactgctcctgtgggtttagttataggaccattctgagcatgtcatttgcctacttaaaaccttttgctggtttaaatttcttcatgatctgtgccctgcccacttctccagtctttccagtgcctactccctgcctcccactccatgctcatctgcgctgtgcccaggctctgctctctgcctggaatgagcagcccagccccttcagctggccagctctgtgtgtctcttccagtaaacttccctaccacccacagctagagtagagactcttcctcactcttctataataccttgcacctaactcggtattataccttcacaatgtattatgtgtgtggtctgacaccgcacccatgtccccaccagtaccactgaatatttttagagcaagagctatttcttattgatctctgtatcctggtaagtacagtaagtacatagtacctagcaggagtttggtgaatatttgatcatcatcttaccaaattctggtgggaatttccaaaacttatttcaaagttatttcagttccttaaaggaattagagataacaataaggagtaagctgtttctagcattaacctaaaggcaatgcttcatttttacttagatcacttaagtttatttgtggaatgatggtttatttttcggtagcattctgaaagttttcattacaacaacttagtcttcagaaacttattttaaagccttgagatacctttagtttacatattgttgatgaaaagtatagacctgagtcagactagggttactcactagctgtgtgattccaggaagtaactcaatttttgtgctcatttaattcttcatcagtaaaagggggataagaatacctacctcacagattgctgtgaaaattaaatggaaaaatgcatgaagaacactcagcacaatatctgaaacatggctgtattgaaaattgcccaataaaatggtagctcttattattacttaagcaacataatctcatagaataatattaaaagattattgttcctctaatgttcaatatttagatatatataaatgtaactctttcatattcttaattttcttaaattataatttctttgcaagtgagcacttcagggcccttcattcttagtatgagttggggttgcgtcttgctcacggttgtgacaatgcaacttggcaaatacggcctccagaaacaatcaactaaaatccatggaggggctcatttctgtgtagctgtaaatgagttcccacacctcaactttttcaaagtaggtggtttgttttgtattgataatagaaggatgggatttctcaaatgctgtggctgcagccctcaatctaagatttgcaaagcttttatatttattcagtgtttttccttttagaaatgagaattttaaaaaataggccagtcgtggtggctcacacctgtaatcccagtactttgggaggccaaggcgggcagatcacctgaggtcaggaatttgagaccagcctggccaacatggtgaaaccctgtctctacaaaaagtacaaaaattagctggacatggtggcaggcgcctgtagtcccagctacttgggaggctgaggtgggagaatcacttgaacccaggaggcggaggttgcaatgagccgaaattgtgcctctgcactccagcctgggcgacagagtgagaccccgtctcaaaaaataaacagacaccaaaacccaccctgagatatgtttttttttttttccgtaatactgcaaagaagagttgtggttttttattcatgtggtgtgatttgtgttgaatgaagtattaagaagtgttatatcttttctgtgtcgtcttcaagattagattgtggaagaggcatgggggctatggttctcagctgactctgcaatatggttcccctctttatggatggggattagaggtgcaggtagtggaactgaagatactcttggtaagatgtgacactgtgcatttagtgaactttcatgtcagaaattgtactaccaactctagaagttttcttttgatagaaaattgtagctcagtcacagcccagagagttatatctaaagcttagtatttgcactttaatttcatcaacaggcagggacaaaagacctttcacttaggatatcctggatttgtggtttcagatatttgctgtgtgtgccagcttgcactcctccctcaaacagaagacactttattaaaaaattttaagtgaattccaaaaaaatcataatcaccttaatattcatcggtagcgtatggctccagactgattttattaggtaacaaaggttgccaggtaggaagcagagcagccgctagggagacccacccctcttcctaccaaaaaaatctttccagcccactaattagagctaactgaatcctcccttgaactgtaacactccctcctctgcccccccgctactttgagagggccaagtttttatcagtcattcacaatgcagtattgtaaaggaactgccatcacttatttttaaaaccagacacagaacccaccaaattttagcagaagagaactctggaaggagagcatcttagagggaaggggggaattcctccaaatttctctctcctggaattctgctttcacacctgtgcccagccttcagcagtgtggctgggcacagaaacattactgcattgtttccacttagctgacattttaaaaatgaaccttaccaaattgtaagaaagagacaaaaaggaataattacccaaaatacagacagtacagtataaaaaccaccatccccaaagaacaagtttctaatccaaagctctaactcccttttagtttctgggggctggcgcagcttctactggctctctttaagccttgttcttaccgggacccctgtcacaaatatggataacaaacatttcttattcagatttaaatattgctttctgcctgggagcatgtttagtggtggtgatggcagggggatgggggagaaagggatgtaacctagccaggcagctagcctgtctcccctgcttagaggtttctaaggctgacccctggagagccgcctggggagattggaggcctgggtaggaggttgccaaatccaaccttcccctcctttgcaattaattctgcctttgtcatttattcaaatacagtagttttccagcatcctgacaatggagctctaacggtcaagaccataagtggtcatattcaaactttaatctttcccaaatcagttaagcgcttcagaccagaccagcttagtagcctccctctgccttagctctggttcattctgttgtctcctgatcaaatgttccctgctcccctccagacaaggagagaagaaaatgcacctgcatcttgtgctcctgatacacaaagcttcagcccctgttctctgaataaaccttgctttttcacacctccataattttgtacatatggtttccttggcgtggaacaccaagctctgttagttgttccctgctctgtgtgaatgtaactgagatgaaggaaaggaagagagaaatagagcatgctcatttgtagcctaaagagcctgagcagggagggtggaagacttacccaggtatacaccacctggtacctcgcactttgcaagcactcagtgagcagcacccaagtatgaggcaaaaacagtccccgaggatttctgtgcctagttggagttcagaagggaaagctatgaagagagcccagatcagggaattttatcctctgctgtccctgcaggaacaactaagtctttctttggaatggaaacctattattgagaccttaaggtgccttctctatgagatagtattagctggctgtccagtccgtcagaaatcaacccagggcacaccctgttggaaacattactagtcgtttgacaagtcagacaccttccctctgggcctagtttccacatgtgaaaaacgagggcattggactgaatacgtgatgatctctatcattccttacagccactcgttctgaaattctgtgaacctgtaaatgtgatgttgcttcagaaatgaatgtcaatgatctgagtagtgatgtaaaaggagggtacgctagatgtttaaacgtgccaaagtatgagtgtttggaaattcatttcaagtacagtagttctactacctttttccctctagataaattttgaaagtcccatcagaatacagaattgagagaggacacacacaacacgttttctgtaacagacgtttactatggtcaccactagatggcacccttgtattagtaaggagatttttctcagaaattatagggcttcgggatgacttctaataaaaatagatagtaattaatcaatagctgaaactgaggaatgagcaagttaagcagagaaaatagaaatggatgtttttctatcactgtctgatgacttgatccttaagattcgaggtaaggaaaagctggagctgtctacattgccctgatggagattattttataaatatttcttaattgtaaagcataagatacctttaaatccaacatgagtttgatttgcttgatgaaaatgggtgccatatttcagcagttctttggtgcgatggtttgtgatagtctgaagtcaaccttacacctattcttagcttcaaaagcaaggttagtcctgcaaagttgggaacaccaagtagttaccaagttgagtaaatcctgttgaaccaaaaagtgaaaacttgagtcatcttttagccaaagaataatttgatttatgcttctgtggcaggagttgaacaatgtgttaaaagggagcaagaaagcttcggaaaatttgtatgaccgtgatatgtcatttttatagttcagtttccttttcttgggagaggattttttttctcttcattcactgtaaacatctttccattaatttttaaaaatatgctatttttttagagcagttttaggttcacagcaaaattgagaggaaggtacagacatgtcccataggcccccttcctccacgcatgcatagtctcccattatcaacatccccaaccagagtagtacatttgttacaattgattaatgtacattgacacatcatttttgtccaaagcccatagttcactcttagcattgtacaatcgttgggtttggacaaatttataatgacatatatctaatattatactgtcatacagagtgttttcactcccactctggggcttgtcttaaaaatcttctgtactctacctgtttatcccccagagccctggaagccattgatctttccactgtctccatggttttgccttttccagaatgtcatacagtatgcagccttttcagaccgacttctttgacttagtaatatgtgtttaagttttctccatgtcttttcatggcttgatagcccatttcattttagcactgaataataccccgttgtctggatgtaccacaatttacccattctcctagtaaagtacatcttggttgctaccaggttttgccaattgtgaataaagctgctatggacatttgtgtgcaggtttttgtgcagatgcaagttttcaaatcctttggataaataccaaagagcatgattgctagattatatgctaagggtatgtttagttttgtaagaatctgccaaacagtcttctaaagtgtctgtaccgttttgctttcccaagagtaatgaatgagagtttcttattccacatcctctgctgcgtttggtattgtcagtgctctggattttgacccttctaataggtgtgtagtggtgtattgattatacatgacgtagagcatcttttaatatgcttatttgcatctgtaggtcctctttgatgaggtgttttttgttgtttatttttttgagacagtctcactctgtcatccaggctggagtgcagtggagcaatcatagctcactgtagccttgaactcctgggctcaagtgatcctcctgccccagcctcccaagtagctgggactacaggtgtgagccaccatgcccagctaatttttttaattttttgtacagatgggatcttgctatctttctcaagctggtcttggcctcaagtgaccctcccacctcagcctggtaaagtatcttttaaggcagcggtccacaacctctttggcaccagggactggtttcgtgaaagacattttttccatggactggggataaggggagggggtggttttgggatgaaattgtttcacttcagatcatcaggcattagattctcataaggagcactcaacctaggtcccttgaatgcacagttgacactagggttcatgctcctatgagaatctaacactgctgctgatctgacaggaggtggagctcaggcagtgatactcactcacctgctgctctcctgctgcgcagcccagggactggggacccctgttttagggtctttttaagtttaggataacagtcctttgtcaaatattatcttttgcaaatattttctcctggtctgaggcttgtctttttattccctttacagtatcttttgcggagcagaaatttttaattttagtcaagtccagtttgccagtttgttggacttcagacattctaataggcgtgtagtggtagttgttgttttaatttttatttctctaatgacaaatgctatggcacatcttttcatatgctcatttgtcatcttttggggcaaggtgtctattcaggtctttgctcatttttcagttggattgtttttttgttgagatttaagaattctttctatattttggatacaaattctttatcagacaggtgttcagcaaatattttctcttgctctggggcttgtcttttgattcttttaatagtgtctttgaggaagcacagatttttaaatttaataatgtacaacttaaccagttttccctttcatggattgtgctttggtattgtgtctgaaaacttgttactatagatatctcgattaccctgatttgatctttacatattacatgaatatgtcaaaatatcacatgtaccctgaaaatatgcacatctattgtatatcattttttttttttttttgagacggagtcttgctctgtcacccaggctggagtgcagtgtcatggtcatggctcgctgcagccttgatctgcagggctcaggtgatcctcccacctcagcttcccaagcagctgggactacaggcgtgcaccaccacacttggctagtttttgtgctttttgtagagatgggacttctccgtgttgccagggatggtcttgaactcctggggtcaatagatctgcctgccttggcctcccaaagtgctggaattacaggcatgagccacttcacccggcctcaatttattttttagagatggggtcttgctgtgttgcccacaccagtctcaaattcctggcctcaggtgatcctcccgcctcagtctgtgatccattttgagttaatttttgtgaaaggtgtcaggtctgtgtctagttttatttatttatttttttacatatagtcatccagttgttcggcacgatttgttgaaaagtctattctttctccattgcgttgtctttatgccattgtcaaagatcagttattgctggatctatttctggcccctctgttctattgatgtatatgtttattattttgccaataccaggattaccttgattataagtcttaaaatctggtagtagaagtcctctaactttattccttcttttttcagtattgtatgggtcttttgcctttccatatgaactttggaatctttttgtcaacatctacaaaatagcttcctgggattttgagtgggattgtgttgaatctatagagcaagtcgggaataattgacaccttaacaatattgactctttcaatccacagacatataatatttctccacttatttagatctttgatttcttttatcattgttttgcagtttttcacatagcaattctctgttttgttagagttatatgtgtttttatttggtgttagtataaatgatttttttttaactttaaaattttggtggttcattgctggtacagagaaaggcaattgaccttcatatattgatcttatatcctgtgaccttgctatacttgcttattagttctaggattttgtgtgtgtgtgtgtttgtagattctttgagatcttctatatagataatcatatcatctttgaacaaagacagttttatttcttgcttttcagtttatttaccttttatttctttttcttgtcttactgcactggctaagacttccagtatgacattcttcatattctttactcaataagataaaattattcctagctcagttttctccccaaccaattttgaaggcatatacactttctacttcatttttactatcagggtataaaattcaatgtctatttttttaagttcttctgtatccttacttatttttttgtctgcttgacctgtcttgcacttagaatgataatgttgttaacatctctaagtattaatgtgtttctaattttccttgcatcttctatagcaattgctttagcaaaagttgttgctatgttatttgatgcataaatatttataactgttatttcttcattgtcagttgtgactttagcatttaaaaaagtctgtcagatttaatgcttttttgtcttaaatcttactttatcggaatcaaaatcatgaccctctactttcttttgtttccatttgcctgatatgcccttgtgcattcttttattttgtgtcccttaatcaatcactttaatattagcatagagttgggttttgttttgtgagccagtttgaaaatctttcatataataggtgagttaagctcgttcatagtttttgatatgacaggtatgtttatcttactctgttacatttatgttataattgctacatactctgttatatttgctgtatttgcctacctgatgtgttttctttattttctttaattttttttcgagagatggggtctcactgtgttgcccaggctggagtgcagtggctattcacagaagtgatcatagcacactttagccttggactcctgggctcaagtgatccttctgcctcagcctctcaagcagctgggactacagatgtgtaccaccatgtccagctactgatatgtctttatatctttttaaatgcccttagtcctctgttttcttatttaattttttactctcaagcttgtcagtttttaaaggttgtcttttaactcccacctattgccagtataacagtgagcttattctactttcctctttcccttctcccatttttaaacttacattgtttatagcttgtcagaacatataacatttatatattattcttttagttggatgaaggataatatatattatataaaagaataatatatattattagtttggcatcagactcctcaagggaaacataaaaacaaggtgacaatgcagcagcattttcaagaaatttaagggaaaaaaaagtcaagggaagaataatatatattatataaaataataatatatattattcttttagttggatgaagctcattctctagtagtgtcaggaactgtgacacattggagatgtcaccttactcacaagctagtaagtttgttagcatttcatggatcctgacagaaaacatgagactcttgggccagatacaaatatattgccatattactcatgggaaaaacaatagccagaacaccctcttcatttgcatcagttctccatgtcccccaagtcccatggggatgacacatgtgcgtctagatgaatatctaaatatgcagtggtttatattagagcacttgaggaatctagtgtttttatagtaaatggaagctctttgggaatcaatgctgccttatccttccaggttgctccttgaaaacacaagcctaagaaatgacctgggaaaagagcagtcaggagcttgcctttttggcatacctagcaggaatgcccagggcccatggcagaatgcctgtccccaaaagattcccaagaagggctgtgggcatagtattctctgagtccatccatgtttaagactttttctgtagccttgatatttgaaggactgatttgctagatacaaaatccttagttgactttttcttcccttaaatttcttgaaaatgctgctccattgtcaccttgtttttatgtttcccttggggagtctgatgccaacctaattatcttgcccttttgagatatgtggtctttttatcataaaactctgagatctttctctctctctgtctctgtaaatatacatactttttaaagtctaatagttttactaggacatgcctcaattgagctttacagggtgattttcccagatacccaataggccctttcagtatgtagatttgggccttcttttgtttctgaaagtgttattagactatagttttaaattttacttctgtttcattattttgtttctcttttaatttaaggattccaaacatatgtgtgttggatcttctttgcctccttccctttcaactgctttactctgatccctcttctttgcttatcctattttcattctcatggttattttgcttttattattcaattttctttattacatttttatttgaatctgttctcctttgggtgctttgaaatttagtcttcatttcagatataattttatctttttcttttttttactgaatttaatcaattttttgttcagttctgcccacttttagtccatttctattttcagtttttgaattgattaaacatgtatttttttcatagcccaaatgcctatttaaggatatttaattcagtttgggttattgtgttaaagtttcctttgtgattttttggagggcattttcattagctgaaatgttttgatcttctttttctattttctcctgaaaatggttttgtatagttgtaaactacttgcatctgctccttttgtagacaagattggaagtttgggttggtttataagatccctagtttgcaaacactgtaatgcttaaatgcagtgaagtatagtctctttagtggatggctttttgcttgaagaggtcggtgggggaggaattatatgaccctgattgttttacctcacctttgtgttacaggaatctaaatttcctcctgcctctttctctttccctatccagtcactagagggcacctcctctcccttcttttttactcatttcttccttagaagcaatgccgttttcagattgccatagcatcccacagactctgtctcttccctgtggttagtgctccaaataagatgtttttcagtgtttttataattagggtagactgtctctttcaggagtgattttggctcagatttaggccttctgttctgctcttctctcttccatgccatttttccaaattctcctcactttccacaaagatttgcagtgggacctcaggagatagctgtgcttggaatttgctgtttattatttttacttacaggtgtattgagtctgtagtctgtgtcaattaattgtgctgaagatgtgaggtttgtatgcttgtatttgttactgttgatctgtatagatttttggaggatttctaatattcagctatatagatatattgtgatttttaaccagttgtctatttgttaaatatgttggtggttttaaagtgtgcaaattataactacttgtagcttaatgtttatacagctgtgattaatctctatagataaatttccagaaataggtcaaaagttatatattccaaggcttttactaatatagacttcccagtgtccctccagaaaacccacaagtatttattattaatttttctttttttttttctttttttgagacagtctcactctgtcaccaggctggagtgcaatggcacaatctcagcttactgcaacttctgcctcccgggtttaagggattccctgcctcagcctcccgagtagctgggattacaggcactcgccaccatgcctggctaatttttatatatttttttttagtagagatggggattcaccatgttggccaggctggtttcgaactcctgacttcaaatgatccacccaccttggcctcccaaagtgctgggattacaagtgtgagccaccgtgcccggcctatatttatcatttatcgagtttctactgggtggcaggcgtggcactgacaaagcactgaggatacaaaactcagtctgacccacacctgcccttaagcctaggaggtaaacatgaagcacagagggacagtgtgacaaatgtttcgccgaaagggtaagttcaaagaggtagaggaacacagaaggaaggccacagggctttctggaacccttttccatgataaacaaggtcacctctgtcctcacagagtacgaacatcctcagtttcttaccttactgaaaacctgactacttgaggacattgctgccactcaaggtgagtgagactgttcactctcccacactaccagtctctctcccagctctcatcctgcaccttagtcacctgcctttgtcctgagattccctcatgggttcttctttctccctgcatcctgcaaatggtgctccatgtgctctggcccataacctttctcttcccctctgcagtctccctgtatggtgccactgtaccttcccacagcttcagtggctcccacataccacttctgggccacatccttctcctgcatctctgtcccagctgcccacctggacatctccacatggttcctctgcagacaccacagactcaacatgtgcagaagccacctcatcattgttccccgacctgctctcctctgtactctggatctgctagtggcactaccagtttccacctcgttcctaatcaggaacctggggtgtcagcctttgtcttcttcaccatttgccctctgcttctctgtctacctcttttcctttcagggaacatcatttctctgccacttgtgtttctgttctttaaaacaaaaaacaaagcctcttttgccttcatcccctactctaaatctcccccttttctcttccctcttgccctttctttctctgtatttttctagccgcttcattgctgctcattttctccatttctctttttcctcttgcttctctagtggttccttctcattccctattcacattctcttcagtcctcactgcgcagataccaatcttgatcctgcgcctgttctttttcctttaggggatttgagtttcgatgggacagcttgaggctggccattgctaaagcctggggcatgggagaatggggtaagcaaagtatcaaatacttctttttgttgttgttgttgaaacagggtctcactatgttgcccaggctggtctagaacccctggcctcaattaattctcctgcctcagcctctcaaagtgttgggattatagatgtgagctaccacactcagccttaaatacttctagactaaaatccaacttactgtttctctttcccttctacaccaagaggtaggccagtatttgtcctctgagcatacctggattcccaaatgacaactctggggtgccttgaagactgcagttataattttggggcagaaaacacccccagaaatcctcaaacctaataaaagatatctgaatgatcaggaagaagggctttagaggtatgtcagtctgcaagcagcagctgatctttgtggtgtttttgttgttgttgttgtttttggagacagggtcttgctctgtcacccaggtttgagtgcagtggtgtgatcacagctcactgcagcctcaacttcccaggctcaagcaatctttccacctcagcctcccaagtaggtgtgaccacaagtgcatgccaccacgcccagctaagttttgtatttttggtagagacggggtttcgttatgttgtccagactggtctcaaactcctgagctcaagaaatgtgcctgccctgacttcccaaagtgctgggattacagacatgagccaccgctcccagccctgatcttggtgcttttgatggtggctcttcttcacagccttcttgagatgcagttcatctttagcagttatcacactgtagccttgagaagtgtgactaataacttcaggaggcagttgagttcagtaaagagtattttgaactcctaaattgttctgttaatgacggctgctcagaaaggagtcaagggtctataaataatggcagattagcaccttgaatagacagcttgttcttatagatttttggaggtggaatatattgtttttttattgacttaagcgaatatgtgacaatttaaggcaggaataatcttttaaccttaatatactccttgtttaataaagtaagtaaggtagaatttcagatattaattagttctattcataagcttttgaagggacataaaggatatgttgttctacccttctgcaatggtcaaaatggtattgctttcagagagtgaacaaacatacgagatcattaagtaattacacaatttatagcttatctaaatatgatttgatattgaaaatcttgggctgggcacagtagctcatgcctgcaaccccagcactttgggaggccaaagctggaggatcacttgagcctaggagttcaagaccagcctgggcaatatagtgaggccctatatatacaaaaaaatcaaagaatttagccaggcatggtgacacacacctgtggttccagctactcagagaggctgagtcaggaggattgcttgagtccaggaggtggaggctgcagtgagctatgattgtaccattttactttagcctaagtgacaagcgagaccccatctcaaaaagaaaaaaaaactggctctgataaaaggttctgcgtgttgtaatctatttttggatagtagtagtagtagttttctattgatacattaaaacatatcttacaacttagttgcttaaaacaaaatgtttccaatctctcagtttctgtgggtcaggaattcgggagcgctttaggtgagtagttctggcccagtctctcatgcagttgcggtcaaagtgttggctagggctgtagtcatctgcagactggactggaactgggggatggctgttggcagggggtcctggctcctcaccacgtgctagaatgtcccttgtgacatagcagctggttttcctcaaggaagagaagaggtctaagagagggcaaggaggaagctgcagtgcattttatgatccagtctcttttaagtcacataccattacttctgcttgttttctatttgttagaagcaagttactaagcccacatcacgccctagcagagaattaggctctgccttgtgaagggaggagtatcaaagaattcgtggacgtattgttagcaccacccaccacaggcttgtttttcctgatttttttcttcctaggttgaaggtggtacagcttagtagttaagagcatggttctgaagccagactgcctggctttgattctggttcttccacttgcttactgtgtgctttagtaagtgtgagttgccttctctggacctcagttccctcatgtatgcgttgaggaaaatggtgcctacctcacagaagtgtgtgagaagtaaattaattaatataagtaaaggatgtagatccgggcctgatgcatagaatgctcttagtagatgttaacttttagtatcgttattgtcgtttgaacagcagtatagcccagtttgtttctccctttatttctatgtaatctaacgtaatgcttggtctaacatataccacctcatacaggctctggtcatcctggtaggtcatacatggtaggagccaagtgggctgatgactctcagtgcagactccacctgtagtagtatagcatgtgagggctcttagcttcttgttgatacatggtaaggaatatccctttcccttccagaactctcacttggaaagggcttcctcctaaacttgacaggaacctgctctgggacctgtgagctgtgttcagtgttctccacattcactcacactttcagtccataaatatttatgaaacgtccctggaattcaaagcaaagtaattcccacagtactttatctactgtgaagaatcaaggggaatacatatgtcctagctctttagagtttattcatataacattttcatcttagatctggggctgatttgcttagttggttagagtataatgcttatgggtggaaattttttccttaaaataatctgtgtggaggaaggcgtaatcacaattccaacacttttaaaggaaaattatttattaaagggcaatcaactatttataatagttaagtacgttcgttaaatacttcatttatatctggtagatcttgacctgacattgagttgccacattcttggctctagaaagatgtttttaaaagatgttcatgaatactacatgtcaaaattgtaagagaaagcagatttttaaaatttttggacataatatactagcaaatttttttagatatgaactctgttttatagatgattcagaagattgtttaccagaaaaaaattattacaccaaatttccaccatattttttcttattgatgtcattgctttccatgactgaaaagtgtaattgaaatggcttcttttaaaagtgttgccttgtcctgcactctgatggtttgacttcttaagtccacccagattctcttcagatattgagttcattttctcaactataaaaggataagtaggattgcatttggttatgcataccagaattctgactactgtggctttaatcaagtagggatttatttttcctatataacaggaagtctgtctttctgctctactatccttagtgtgagacttctgtctttgtacttgtagtcttatggttataagacgtctgtgatgagttaatatggtgtcatgtttacattccaggcagaaagtgcaaggctttccagaaacttggtttatgtttccttggtcagaactgtgctaggtggcttcctcaagttgcatgggatcccaagaaagctagtgttttagcagggtacattgctaacccagatgagatcagtgttctgttagtgagacagaaagggacattgtatagtgggtaagcaaatggtattgtctgccacaagggtttggatggttgctcaagtcctgagccgatagagcaatccatgagtccatccacttggcaatagcacatagtgatagtacagtactcagtgtaagtaatgaatcggctctatatctttagtgttggaatccagaagcaaaaacacagagtagtttacccctaggtaatatacgtggtcataaatctcaataatgatcttgtacgtgatcttgttttcctcccattaaagtcctcattaataataaggggtacttgaataaataaactcttccaaaagctgtttccatttagattttttttgatatatttgagccaggcacggtggttcattcttgtaatcccagcactttgggaggctgaggcatgcagattgcttgaggtcaggagttcgagaccaccctgggcaacatggtgaaaccccatctctactaaaatacaaaagttagctgggcatggtggtgcacgcctgtaatcccagctactcaggagtctgaggcaggagaatcacttgaactcaggaggtggaggttgcagtgagctaagatcgcaccactgcactccagcctgagcgacaaagggagactgtctccaaaaaaaaaaaaaaatcttattattattatatatatttttggtaagatgattgtaaataagttgtatatgaaaatgattgttgtatattgtttcagtggaaattgtacccatttttatttttaacagaattggcaatatggtgactattaaatcaagttgtggtctttttttttttttttttaaagtaaaaagactttatttctatttatttatttatttatttatttatttatttatttatttttactgagactaagtctcgctctgttgcccaggccggagtgcagtggcatgatcttggctcactgcaacctctgcctcctgggttcaagcaattttgccacctcagcctcctgagtagctgggataacaggcatgtgccaccacgcacagctaatttttgtatttttagtagagacggggtttcgccatgttgaccaggcgagtctcaaactcctgacctcaagtgatctgcctgccttagcctcccaaagtgctgggattacaggcgtgagccactgcgcctgaccaaaagactttatttctaatataaagtaacacatacacattgtttaaaaaaaaaaaaaaaacagctagtaccaaagtactaaagaagaaggtaaataacacccttgatctcattacccagaaataattatatttttaccatcttttttttttttttttttttttttgaggcagggtctctcttactacagcttcgacctcctgggctcaagcaatcctcccacctcagcctcccgagtagctgggaccacaagcatgcaccaccacatgctgctagtttttgtattttttggagagacagggttttgccatgttccccagactggtctcaaactcctgagctcaagcattcctcctgcctgtgttaccatcttgaaatacatttctgtgcataacaaaaatggcatttgaaatttagaaattatatttggaattatttgtgaacatagttcagtatgaataagtatattagctgagatatctcttgacataaaaatttggaaaactttagataaataattccatttaaaccttcaaaaagtaaataaaagttaacattttatttccattatttatagctggaaattttttaggtagcatttctgaaaaaacctgacattgataaattcttattgattttgatttatcttctaacaagaaataaaagctttcactctgagcctagcatttccttattccttcttgaggccatttatttattttggggcatgacaatggaaatatcagaatattacagaagattgatatgaaaaaatatctttttttgcaatgaccatttaatgttctgtgtgggttgggtcttcttgtacctgaacattcatttgcctatcgttttcaagctgcagatatattccacctctccagttaaatttagctgaggaattgttaggtgcgggctataattgctctttctcttctcttcactttcccagcctctgcagtactttgacaagcttcactcctcctgcgagcagtgttttcagtgtgtgtcttttatgtgctgtcgacaggctctttccatgttctgtgggcctcctactcggggaacgccaccactgccaccacccccgtattagtacaggatgggaaagcagagctgggcaaagtcatttgtacttttaacatctgtgtgaacagcactcaagagtcccttttatccttcttggatcttttgcctgcactcagagttgttacccccaaacagttcttggtgccttgattatgggctcaagattcaaaaagccaagatttcctaaaagtataaatgacagaaagggaaaaaagactgtatttttccatttaaatgtcactgtaacattacttattagacaaataaattataaatatagcaacggaattctttttaatgaaaagaaaaaaatcccccatattctgcaatgctggtcaataatttttatttttctgtgtttccttttagacctggtctgtatgcatatccagtgtctacattgttataattcgagtggctatcatttggattctgacagttttttttcctttaatataatcatttttccattttgttatgtgatcctttatagtgacactttaaatgagtttatttttttaataagtaattcattcacatggtataaaatgcaaaagctataaaagggtatgcagtggaaagtgagtctctttcccaccccagtcccccagccatccagtgcccttcctcagaggtaacagtttttcctcatttcttgtgatataacaatattctttgttttttttactttgattctttcccttgatttacgagttttcaggataatgtgttggtttcccggaatcctctaaagaagaccagtgaaagtgtgtagggtttctttttccatgtaaaatgtgttttattggtttctttaaaaaaaggttcagggtttagtttgaaatcagacagcaatacctctcatccgttgacggtcaaattggcttcagctaccaatacttcattaactctaaaagaaaataactgtttccattttgagggggggaaatccagtttaaattagttttacattggtctgtaatttaaaacggaatgagggctagtgtttcctgttgctttatacagccctctgttcatacagaacctggaatgtaatattcccaactcaggcaggcactaatactgacgtatacacacacccttcccccaaacagcaagaatcagagtgtcaaagggacagtgaaggttttcattttattttgtcataatctcatagcttttaacatatttgatgtgattccatccattttaacgattctttctgatgctcatattagcccattcttggccagttggagcatcttcagattatcttctgagtcctttttgaaaggaccccagtgatctttaataatgttctgctttctgatacgacagaatgtttcggctcatcttgtattcactaatacttctaaattactacaaaatacctgataatgagatgtatcatcatgtctctctcagtggagaacaagttgttctcatttttaaaatattagaaataatttttcaaccaatgtctgtgtcgatatatacactctttagtctttggcttatgccgttggcatctctgttgatagatagatgttttagtctttggcttatgcgtttagcatacatctttatgtgtaatgactaattcaaaacatatgaatattcttttaactcttaaataatattaccagattgaattcccaaaggattgtgcccatttgtaaaatgtgagtatggttgtttcaacatagtaccagcatttgggtattatgattcttttttaatattcactaagttacttatagaaaaatcataagtattaatagtttctttgatgcgctttattgctaattgtggagttgaatataattccatatatttgtttattaattgtggccatttttgtgtgaattgtctatttatgccctttgctcatttgcctattagcatcttgatttttttaaagataaaaacaatttgtattctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacacctggctaattttttgtatttttagtagagacggggtttcaccgttttagccgggatggtctcgatctcctgacctcgtgatccgcccgcctcggcctcccaaagtgctgggatgtattctttatatactttaaatgttaatctgttgtcatattggttgcaagcattttacattgtgaacatttcaaacattggttgcaaatatttgattttgtcctagttatataaagaccattaatttaccttcttagagagtgaccaccaaatgttaaacgtacataccaatttgttatattgaactatctatgtaagcttggcaagtcactttaccttctcccaacctcacatctatcaagtgttgaattgaacttgattgcttggatcctttccaactctgacagccaacattttcttagtaaaaaagcaccatatttaaccccagcagttccttgctctcttacatagagaatctttcccatggatgccttttttcacaaccttctagtacagctaaatattatctccagtcttctttccctgccccacatagtttggtagaactctgaagaaggaacattgccaataggagtatatttcttggtttgcttaagtgaaatcctgcgatcgctggtttagtagagtcaagagaaaatgacttattctctcaaccttgttgtttattagatcttgtgttatttcaagaaagtggctattaggttgggtttagctttttttttggacagagtctcactctgttgcccagtctggagtgcagtggtgcaatcttggctcactgcaacctccgcctctcaggctcaagcaattctcctgcctcagcctcctgagtagctaggattacaggtgcgtaccaccacacccggctaatttttgtatttttagcaaagatggggtttcatcatgttggccaggctggtctcgaactcctaacctcaggtgatccacccaccttggcctcccaaagtgctgggattatagacatgagccatcgtgcccggctgggtttagctttttgaaaaagctttgcataaaaaagttttcaaaagtatattgaaacagtatttgataaatttttaaaatagaaatactaataatttttttatccagcattcaaggtacttatgggttattagtataagttagcaaaaagtgatgatatatataatagttcaactgttttttaaaagttcaattttgttcggccctgacagttttactaattaaaaaaaaactgtctgtgatgtgctcttgctggtgaaatacatatgaaccattcatatttcaaggctctaattaacaatctggtttaaaacactggtattccataaacaataaaaataatagggtgggaatttcctattggaatgctaactataatacagagatttgagtaagtttccatgacttacaattgactcactgtgtcctctcagagaatgacatctattatcttcacattttcatctttttcaaaacgtgacacccttttaagttatcttcagaaaggaaatatgtgtcatttatttcatgtctatattttgctctcattcagaggttagactttcagagtggagacctcaaaagtaaacaagcaagtgaggaggctctgaatgttcgagaaagctttcaaaaaagtcattcccttaagaggtctctgggccctctcttgaaaccaatttattattttttacctgtaagaacttcaataagtggatgagtaagatgctagtggcagatatttggacagctggccgtctgaaatggaggaagtagaaaagaaaatgaataaagtacatccagtgaactagaaaccagtacagcaaagtcattaatatataggaacacggctcaaaaaaccaagcaccaggatttttttctttcttttcttttctttttttttttttttagacagggtctcactccgtcccctaggctggagtgcagtggcgtgatcatggctcattgtagcctcagactcaggctcagtgatcctcccgtctcagcctcctgagtagctgggattacaggtagacaccattatgcctgtctttttttttttttttttttttttttttttagtagagacgaggccttgccatgtttcccaggctggtctcaaactcctgaactcaagtgatcctcctgaagagttgggattacaggcatgagccaccgcgcccagcccaggttttatttctttcatggaccctatgaattgtacaactggattattttctctcattgtattggttgtaaaggagctcagagccaagtttgtgatccacctcaaacaggtgcacaggccttctctgcatttgtttaggtattaatttctctcatgattttaaattattgtttttacccttattttccctgagcctgacttctaccatacgtttttttaattttgtttttctttgagaccgagtctcactctgttgcccaggctggagtgtagtggtgagatctcggctcactgcagccttgccctcctgggttcaagtgattcttgtgcctcagcctcccgagtagctgggactataggcacacaccaccatgcccagctaatttttgtatttttagtagaaatggggtttcaccacgttggccaggctggtctcaaactcctgacctcaagtgatctgcccacctcggcctcccaaagtgctgggattacaggcgtgaatcaccaagccggccccatatgtgttttttattatgtattatagtgctctttcagcttttcttcccaagttttctaaacaccaatggggaatataatttcgccccagaaggttttgagagtaaaggcaaggtagccttccttaaatgagacacctttgggtccccttttatctatttaatgtaaaaatggatttcccccaaagttttcagggaaaatcaatattccatgaagatatactgtatatatccagtggctatatcttctgaagtagaattgcttatgtaggggtaaaattcctatgaaaaataccttaaatttaaattactcgtacatcacagtgcaacttagtatcagctcctagtaagtctagcacagctgctttattctccagttgaaagtgttcgttcttccttcatttgaatgccatatgatataattggctctcatttaggaactatattaaaattacattatccaaagatagtataaagaacagtaacatcacaatcatcatgctgagaggccaggggacctaagaccaccattcattctggtgcacatactcacatcgtaaaatgctgggtgcagttgctcacactaagttatttttctgttcattttgttttggttgagttcatatagctgagtttgagtaagttgaccactagtaggatgtcactggattggacaccactgttacatcttttgggtatgcatgccctagttagagaagcacctctgtacttagttttgtcacttaaatggaaaagatttcaatctagccccacacttcttaccaatgatgacacctgaagtatcaatatacttgatttcttatgtttctcctttaatattcatttctgtttcattacaattaagcatgaatatatgtagtaacactatccttttagcacaaagaaaatataatgcccttttaaagtttagtacatatttcagaatgccaacttcaaggaaatccacagaacttataaataccatagttttgctattgatttcagtctaagacaaatttcttttgtcggaacccaataacctaagtgtggttatgtgaaatttattgaatattgctttctgggggtggtcgggagctgcaaccccaagagacatggccagttttctatgttctgggaaaaaagaaaagagaattgccctctgtcagtcccctgaaaacaccagccatcctcttttctgagtcccatggtgtttgaatctgctccggctcctgttttatatcccatccttctccattttggtcagaaatattttctgttaccctgagattagcttgtactctaacagaaagaaagaaaattcctgtttaagattataagtggttcacttttagaattatctttttgctagtgccaaaagtttaatttattgttaagaataatgatttttttaattttgaaaatttaatttgtgttctttaaaagtaggcagtgtggaaaagtataaagaggagagtttaaaattattctaaattctatcaatagggctaatcttcattagtattagttaaatgtcattccagagagcattctcttcacatgtatattaatatgagaaagaaaaagtaggcagacagacatagcttatactatcatgaaaaagacatttttcattaaaaacattattcatcaaaaaaaaattttaaaacttttttttaccgtgtgtgtgtgtgtgtgtgtgtgtgtatgtgtatttgttgttgttttgagatagggtctcactgtcattccaggctggagtgcagttagtgccatcatagctcaatgcagcctcaaactcctggttcaagcgttcctcccacctcaacctgagtagctgggattacggacacatgctaccatgcccggctattttttaaaaaaatttttgtagatgtggagtctcactgttatccaggctggtctcaaacacctggactcaagtgattgtctcaccttggcttcccaaagatccgggattgccatgcctggcaacactatttgctaaaagatataagaaaaaagttatgaaaattctagattcaaattatgtttacctatattttcattttacataacatctcttaactctattaaggacatttagacaatattcttaattctgttaaggaaattagtatctcttccctcactcctatttttaaattgttattaatttattattgttcatagcatttataatatagtctatgaccataattaccagaattgtttagtcttaatattatatttgaatggatttagtgcccaccatgggcatttttattatgacttctccattcctgagttctttattttgatttatttcatttggctgagtttctgacagcttgtgtttctcaaggtcacataagcattatacgtgaagttctttcacatttggtgatgtctaccttttgccttattgtagtattgaaatgacctcttgagtgggtatgatatcctcgaacatactctctttgactcagacctttatagtgttgcttcattgccttcttactttggatgttgctatggagaagtctaaactcaggctgagtttttactactttataggtaatttttttggtctggatctctgaagtattatttttgtaaccaagaaatttctcagttttagtcattcactatcagttgttatgtggaacacggtgtattctttcagtgcagatttagttttttcatttcaggtttctgttccatgttgcatccccgtcgttggggataacagttatccttatgttgggttgtcttcgttttccatagtatcttccagttgctttaatctttgactttccccctggatgcaatgggtggtttccttttgtttccttgctttcttgtattctgtttgtgttgttgccatgtctcttcatcttgttgaagtgttagcagttctgtccagcaattttatttgctctgatagaggtattaccaaattctccctgcctgcatttccacagtattgaagattcagttgttctcccctctgagctacaatttaaggatttgaatttttctgttttacacatttttctacaccctgaggacatgggggtacaggttaggagagtgtatggttatgaaaacattataaagcctcagtcattaaaatttacatattgatataggaagatcttcaggataaattttaagggaagaaaagcaaggtatagaagaatgtgtataaaattcttcctttatataaaaaattgaaaaaagaatgtatataaatatgtctttatacattcacctacatatttgctttatatactttatctctgaatgctagacaaggaattaataattggttacctgtggaaaagggacctgggtagtgatgggattgggagggagaattttctctgtgtatcttcttatacttcttgaatcttaagcaacatgaatgagctatgtattaaatatgtgggcactgctttctgttctgagatttaattgccctgttgtaggattcctcaaccctgaaggaagtgtccctggttcccatagagaattttatatcagtctccgactcagtgtggggcctggaaggctcagcatggatgaggtggctgctagttagtcacttcccccacttcaccattgctgttcagcctccagttctgtcacactctatccagaaatttgtatttctctccaaatctggctcattaataaacattcaggattttgttgattcaccaatattacttttgggggaagagactgtgccataatctctttcttgtcctgactagcatgttttaaaatacatggcattaagttgtacctattgctttttggttgctgctggtaatttttgtagttgttgctgttgttgtgatttaatgttattactttagattcagtatattttgtatttggttagggagattctgtgatctgatttctcttgttatcatgttagcctactacacacctaggccatatggtctagcttgttgcttctaggctataagcctctacagaaggttactggactgtacgacaggtgtagcacagtggtatttgtgtatctacacatagaaaacgcacagtaaaagtatggtatacaagatttaaaatggcacttaccatgaatggagcttgcaggactggaagttgctctggatgaatcattgagtggtgagagaatgtgaaggcctaggacattgctgtgtactactgtagactttatgaaccctgtacacttaggctactaaatttataaaatatatttttctttctgcaataataaattaaccttagcttattgtaaccttcttacttcataagcttaattttctttaacttttttgctttttgtaaaactcttagcttaaaatacaaatacattgtatagctgtacagaaatactttacgtccttattctataagctttctcctatttttaatttctttttttactctttaaaacttttttgttaaaaactaagacacacacacacacaagcctacgtctacatagggacaggatcatcactatcactgtcttctgcctccacatcgtgtcccactttaaggtcttcggaggcactaacacacatggagctgccatctcctataacaatgccttcttctggaatacctcctgaaggacttgcctaaatctgttttacacttaacttttttttaagtaagtaggactatactctaacaataaaaattatagtatagtaaatacataaaccagttacatagtcgtttattatcaagtattatgtactgtatataatgtactgtgctatattttatatgacttttatatgacatgctatatttttatatgactatttttatatgactagcagcacactagatttgtttataccagcaccatcagaaacatatgagtaatgagttgcattataatgttaacaatggacattactaggtaacaggaatttttcagctccattatagtcttatgggaccatcatcatatatgcagtacgtcgttatccgaaatgccattgtgtggtgcatgactgtactcaactgtcaacctggtctttgtcaggtatagccagtctcccaacttcactaacctgccccatctgaaggttgcaccaggcagggaggatttctagtgctgctcagctttgcagggctcagtggtttggggagtcctcagagcaccctcattctggggaagcaagcaaccaattgccagatcccctttatacagcttttgcttcacacacacacacacacacacactccactatgtttcttttatctgccagtgtttttgcttcaaaagttcattgccctttcaacataaattcccataactatttctcaagttataaccttgccttgccaaagatttgcactgctgacagagatatctttctgaaaccaagttgtaatcatgctgtcctcctgtttacaaatgtttggtcacccctcatcaccttcaggaaaaagtcttatttttgagaactacgctaaaacatatcagtcatagcctgggagtgtgagctcaccagggacactgtcttccctttgcatccccagtgtggagagtggtatctggcacagagtaggcgctccacaaatattaacaaatagtagatgtctggtacatcttttttgaatgaattttaggctagtgagagtttactagtaagattccagaatgtctctgtcatctgtaaataaccaatttaagtagccaacaataaaaatatctgtagttttggttttaacatgctatgccattgtgttcaaataagaagtaatggcatgtaaatgcaaaaacagtgggattgactgcaagaagtgccagaaagaaagaggatctatctgccaggcacatgcctgtaatcccagcactttgggatgctgaggcggacagatcacttgagcttaggagttcgagaccagcctgggcatcatggcgaaaccctgtctctgctaaaaatacaaaaattagctgggcgtggtggcacatgcctgttgtcccagctacttgggaatctgaggcagaagaatggcttgaacccaggaggttgaggctgcagtgagccatgattgtgccactgtactctagtctgagcaacagagtgagaccctgtccaatcaaagagagaatctagtctgtcttgtctatctatattccacattctacaacgatttgtggtagctcatacacaaaatatcacactatagtatgcttcagatctagcgtgaaggtttctggctaccaagttaaagagggtgacagagttatataattcttattattggaaaggagcaaacctttcttaacattgagctctaaaacaaatttcctacctgtatgagaggctttgagtgatagggtggacattatactgtacaccattcctacggcaaataaggtaatattaatactgtttgacagtcttttttttttttttttttttttttttgagacggagtctcactctgtcaccctggctggagtacagtggcacgttttcggctcactgcaaactctgctcccgggttcaagagatctcctgcctcagcctcccgagtagctgggattacaggcgactgccaccacgcccggctaatttttgtatttagtagagacggggtttcaccatgttggccaggggccaggttggtctcaaactccggacctcaggtgatctgcccacctcagcctcccaaagtgctgggattacaggcgtaagccactgtgcctggccttagtttcttatgaaattcacctgataataatgataagcccaacttggtgatgccagctctgttcagagctgagataatgcccatctatgtggccatctgttctttagcttaaattcagggatagagctcttggccttttgactggtccagtagagcaggcatttcgagattgtgctgtcaggtgagggcctgaactgctgtttgctgggtgactggttgaagtagttgtctatgctacagagaaactaagtgacagttggtctgaatgacatgatttggggaaaattaaggtgtctaagtaggcgagttcactggatagagaacggtagaagcacctgcaggcaaggccagaaacatcttgacatctacttcaattagaaagtattgatcagctttttgttcactacttattaagatttaaatttactgccaaaggtgtgctaagacaggcacttttgtatattgctggtgggagtataaattggtaataaacttcttagaaagcagtttggcaatacatttcaagagccttaaaaacattcatgccatttgacctagtacttctacttctgggaaaatgtcccaaggaaataatcctttttttaaaaaaaggtctaagcctcgaattttgagtgttatttgtaatgcttcattacttcatttatagtatcaagaaattcgaggcaatttaaatgtcccacagaaggagaataaacaaacatattaactcaaaggaatatcatgatttaagctaaaatcttttgaagaagagaaggaaaattcttaaaatgttaaatgagaaaagcaaaaacaatataaacagtagaagttaaactggtttaaaatatgcttagaggaaaagactggtgagaaatacactaaataaatcgttgtgtgtgtgtgtggatactaaagcatttttaagaaaaacactgttgaccaggtgtggtggctcactcacacctgtaatctcagcactttgggagaccgaggcagcgggtggatgacctgaggtcagtttcagatgacctgaaactccgcctctaacaaaaatacaaaaattagccaggcatggtggtgcatacctgtaatcccagatactcaggaggctgaggcacaagaatcacttgaacctgggaggcggaggttgcagtgagccaagattgtgccactgcattccagcctgggcgatagaacaagactgtctcaaaaaaagaaaagaaaagaaaaacactgttaatttatgtatggcatttttgaaagggagacaaatacaaatttatattccctagagaagggtgatttatagtggagagggaataattaataaacctgtgttcagctgaattgcagtttttgcccctagaccttctagttccatttgtttaaagttactcttagcgcctgtaatcccagcactttgggaggctgaggcgggcagatcacgaggttaagagatcgagaccatcctgaccaacatggtgaaaccccgtctctactaaaaccacaaaaatgaactgggcatggtagcgcgtgcctataatcccagccactcgggaggctaaggtaggagaatcacttgaacccaggaggcaggggttgcagtgagccgaaattgcgccattgcactccagcctgggcgacaggagtgaaactccatctaaaaacaacaacaacaacaacaaaaagttactttagctgggcatgggggctcacgcctgtaatctcagcattttgggaggccaaggcaggagaattgtgtgagcttaggagttcgaaaccagcctgggcaacatagcaagacgttgtctctacaaaaactttaaaaaattacctgggcaggccgggcgcagtggctcacgcctgtaatcccagcactttgggaggccaaggcaggcggatcacaaggtcaggagatcgagaccatcctggccaacataatgaaaccccatctctactaaaaatataaaaattagccgggcatggtggcttatgcctgtaactccagctactcgggaggcggaggcaggagaaccccttgaaccagggagttggaggttgcagtgagctgagatcgccccacagcactctagcctggcgacagagcaagactccgtctcaaaaaaaaaaaaaaaaaaattacctggcacaccgtgtggtcccagctacttgggacgctgaggcgagaggatggcctgagcccaggagtttgaggctgcagtgagagatatgatggcgtcatgtactccagcctgggtgacagagtgaaatctggtctcttttttttaaaaaaagaaatcctttaattctcagttcttttctttttactttttgtttgtttgtttgtttgaaatcaaagaaatcaaaggcttcctctatatgggtgctttccttacaggtgcctaggtagttattgcttcaacctcattaatccccctctcccagcaaaatgaaacttaacatgttaataagcaaaatatgattttcaaaataggtctattataatagaaatatggaagagtacaattctgccattttcctaaatattaaacattattttacaagaatggcttaaaacataagccttgttttgcagtatatgagctttccatcttcaatatatttttttttttaaattggtttctagaggaaatccacaactgcatattgtcccatctaagtgtgatctggctaaatatattcactaaatgtttgacttactaattagctctgttagctgtattacacaattatataaccaggttttataattcatttatacatttatttatgtatttatttacttttactcatttattctgagacaggacctcactctgtcacccaggctggagtgcagtggcatgatcacagctcactgcagcctcaacctcccaaactcaagcaatcctcttgcctcagcctccctagaactggtactagaggcgtacgctaccatggcgagctaatatgttttttatttttagtagagacaaggtctcgctatgttgtgcaggatggtctagaactcctggactcaagcaattctcctgcttcagcctcccagagtgttgggattacaggcgtgagccactgtttctggccatttatttttttagtaacagctttgttaagatataactaactgccaggtgtggtggctcacacctgtaatcccagcactttgggaagccgaggcaggcggatcagctgaggtcaggagttcaagaccagcctggccaatatggtgaagccctatctctaccaaaagtacaaaaacttagccagcgatggtggcacatgcctgtagtcccagctacttgggaggctgaggcacaagaatcacttgaacctgggaggtggaggttgcagtgagctgagattgcaccactacactccagcctgggtgacagagtgagactcggtctcaaaaaataaataaagaaaataatcaaagatgattccagtgttataacttgaggacattgggaggataattgtgccagggcttgtaatgaacaaggtgataaaaaaaaaaaaaggttttaaagatagtcttttatgttgttatgcttgttggcaaaatattcaagtagataataaaagatacctaacttaaccattagatagtgtatcaagtctgatgtccatgagcttccagcactcattagacacaaataggattgatttctcatcctttgtttcctatttgttttgaaacccgtattgtaaaatgagtcttattttaaagattaggtagtggttttgctttctccatctatacagtaagtgtaaaaaatactgtacttggtcagtggttttgagaggtttaagaaaggtacctggatcccatggttttataataccattaaaaatattattgtttttagggagaaaactttgttttaatgtggactacattgaaaacttagtctgtgtaacaatatagacacctttcagttgctcaagaccgttttgactctaaacatttaagttggaatgttttagaaaatatattatatatcgaaacttagtacagtacatttatttatccatcccaaaatttctttcaggaattgttccatcttctgttgtcctgacttctttccaggtgatgtcaagagtttttctaatatgggcagtaacacatagcgtcaaagaggtaagtgtttatatagaccaaaataatgtcaacactaacaaacactagtcaacttttctgattcacatgtttgttatggctaaagagttccaggtcagagttccaggtcatgtcaatatagctgagataaagctcacattcactgtaggaactgggttaatagtgggaaacatatcccagatatgcagtgttgttaaaaagaagactgattaaatggtaaagtcctgtaatctgagttctcatggaggttcagatggtgtggatgtggtctgcaactcagttatatttttctgatatcttgttcgtatcatgttgcccaggccgctctcgaactcctgagctcaagcaatctgcctgcctcactctccccaaattctaggatttcaggcatgagccaccacacctgacccaagtcatcattttaaacctatacagtagttccctcttatccaaggggaatacattccaaaacccccactggataccagaaacagcggctagcacacaacccgattgctgctgaccgaaacacgtttctgtttatgccttctacccgcaaatgtaatgccttttacatatttactaagcatttatcatgccctgtggccgcaacttttgcagtttgaggttcaccagcaaaacaagcacaaatttctttttccttcacaatttcacaaatataagatttgttcctactgtaggacttagcaactttagcatacagtttgttttgtttcgttattaagctgagaacttttactgtctcgcttcaaggaagttctttatggctcctctttggcatatctgaattgccagcatcactactcttgcattttggggctgtttttaaataaaataagggttacttgaacacaagcactgataaccaagttagctactaagtgattaatgggccagtagcatatacagtatggatacactggacaaagggaagattcgtgtcctaggtgggatagagtgggacagcatgagatttcatcatgctgctgagaacagtgtacaacttaagaattaggaattgtttctttcaggaattttccatttaatatttttggactgtggttgaccaggtgtaacagaagctacggaaagtgaaacttcagataagcaaggactgcgatatttcttcctctcatacttttgtgtagataccatttccttttcattttaaccaacaactcataattttatcttccaatagtctccaatgacctaaaacttcttcctagtagtaactcatttacattcttaaatagataattaatgtactttcagtaattaagtgctaggtacatgaagtcaaagtattgttcactatgaaatatccaatcactttgccaatatagtcaaatattaattgtccaggtgctaatccaccagttgatagattcttcatgggctctgcttcctcccttccacttagtgaccactcctcagctatgagcacatctgccaaagcaggtagacaggtacgtcaaaaatgctttacaactcaaatcaggcaattctattagtcaagttgctgttagcaacatttgccaggatttcctgtgtagatcattgaaactggttggcttgcaaagctattaaatgtctctgtggattataggtacatggacttggtgtcatcctccataaccatgctgcctgccagatgcaaaggacttaacatataacagacggtttcacatacattatcacatttgagctttacagtaatttgttatatactcattacatttccatattcaaaattgtttctctacaaccagagtgactcaatttctgctaacattaacatatcattttctttacctgccaaaaaaaaaaaggaaaagaaaaagaaaaggcatatcattttctgaagtatgtagtacattcttcagtatattttattgtcttcccatcgcctcttggatcctcttgtttttacatatgcactgttgatgaattgacttactcttttcacttgtaattggacttcagcgtttctgctgtcctaggatcatggttcttttctcctcattctctttttctctgcacagaactcctcattcatcgttttgtttagagcagtaggtgccctccatccctgccctacgtcttcgacagctaacttgaaaagcctgttgctgtggcccctcagaggccagtacttgctatatgtcaccttgaaaagcctgttgctgtggcccctcagaggccagtgcttactatctgtcaccttgaaaaggctgttgctgtggcccctcagaggccagtgcttgctatatgtcaccttgaaaaggctgttgctgtggcccctcagaggccagtgcttgctctctgtcaactgttccctggacccttctcttggccaaatgctatttttcctgccttggagtttcatattagctatagttcaatttgttctgtataacatcacatatgacttctgttcttcgatttcctgaagcatcttaaaaatgtctttattttccttaatattcaactctgcttactttaatggtgggaactgtataattaatgcataaggaaattgaccttagaaataactgcttaatcacatatatctcactttcttgtagtaatgttcaaattcttttcacactactatcatttctcagtttctttttatatcatattcccctctaaagtggacaagaattcttcattttaatcacattacatgtgaatttggactcctgctccaccccctctgccctgcgtgtttcctttgctcatctcccttgtttttctgtacctgtacatgatgtgctagggtgtagcctatataaccttttcagactagactctacttttttcacgtgaggtatatttccttttaagaagccctatgggacatgcatcattgcttgtcattttaattctctaccctttggaatgctagtcacataaatgtcatcacgtacattgtgaaactaaaaagtgatcagatggttttctcttatgtgtaaggatctacccatcagctagtgtgacaccttgatcagcaggatattaatgaaaaaatttgaatcaatacacagaggcaagaaaagaaaaaaagaattgtgatccgtatgctcacatgcttttccttgacctaacatagcaaataccccatccacctttttcctttccaagagaccatataaatgaacaaacaaaagctctggcgaaacaagccagctgtgtcccgcccccttctggcttgctgctgggctttgtgacacttaacttacattctcaccaacttttcagcaggatgcttgcgaaaatcttgttattagtgtttaagaaagtaacctcctttatattttttacaatagcattggtttttgtttgatatgttatagtttacagagggctttattaaagtacgttatgatcattctctcttaacaaccatgccttgagataggtagcttgtagtctccatttagagtttggaagctacagcagcaaagtgactattgcacacccaataaatggcagagtcaggattggattctaaatccagggtctttctgctgcatcagagctgccaccttctcaccctttaaaaacatgatggtggccgggcacagtggctcacacctgtgatatcagcactttgggaggctgaggcaggagttcaacaccagctggggcaacatagtgagacctcatctctacaaaacaaaaaacaagaaaacctgacgtaaacataatgtttttaacttttgttgtgctgacttctctcactcccctatggagtggaaatgcctgtgtgagatccataggtgcttttcctcctcaacagttccaccatgccatattcacattaggatatgattctcctgctaaatcatctgtacatcagatgtacacatcaattgtgggccctaggtgcttatctgcaacacattgcttctctgtttttttactgctcaagtgctctgagatgaatccttctaattagcctctctccttaaaagttctaagactctttctcaaactaggatgtatgcactatttggaccagaatcacccagagggcttattaaaaacgcatattccaggacccaccttacacttgatacagaatgtctgggagtgggaccagggaatctgaatttttattaggcttctcaaataattttaagaattccaaggtttgagaaatgatctaagatacctatgtgttgtgctgtaatttttgtgaccttcccttgatttaatttacttttctacttagtttacttgaagcctaacccaatctcagcatctcttttctaactccaagagccattgtttcattcttgaagaatgaaaaccttagagttcccttaaactgctaagtaaagatactgtggaatttctggtgctctgtccaaaatccagcgtctttgctgatgactaggtaagaggaagcttaaggagcctgccttaaagcagaggaagatctgaaatcattgcactgaagaagcaagactgactttggtttgtttttaagagagaggcccaaggaatccagctgcctcacactggggtggagttgctgggaagggtctgtagcaggcatgtgcttcatgctgtgggccagagccattagggagatctcttcacagagctgtcagggagatcagttcagaggccattcccacctgaggtaacacagtgccgacacctcttcctgggattcctcaaaagtgtcacctcacctggacagttttattcttttctaggtaattagaactcagtattctagaatgtggaggcttagcacccaaaatttaggtgaagggttgatgagtttgggctttaacatttaccttgtgacaggatgaagcacttcaacttgccaagtcttgtttttctcatctgtaaaataataatactaatatctgccctgtctgctatactgccgtttttgtgaagatgaagtgagaaggatatatgagaacaaggtggcagttatcgagagagaactcaaggtctccagcatgcaggttttcactgagcagcttctgaaacccttacaaagcagccagcggcttttgtgcagaggagtgccacttccttcagagagagaacacggttttcctttcttcctctttccctcttccgttcaactcttgtagaagccaaaacaccagatacataatgtcctaatgcccctgcttccggacctgttttcgttgttggggtttttcctccctgctgggtcctccagctgggtcacagtgtgctcgtgttcttcctgcctctgaggccacttccctggttggcgtgtctcctgtggccgcacgccttctgtgttatccctgatagctgtgttgtggacttcccagcatgcgccatccgtgaacgtggtatcatggtgaggcagaaaggcagcttcttacccccatcattcagatgaggagatgagatgctgtgtcaggggcacatcatttcttccttgggccctgtgcttggaccaaagctgtgccgtcctgtcatctagccccagtgccctttccacagtgacactgcagctcagttagcagaggccattgagttatattcagtatcctttgtccccactaaaagctgaatgtctaaaatcctccaccctactccatttggttactttctattttaaatattcttgtaggtggatttacatcaccttcattttaaaataacacctctcttaaaggtaaaaaaaaaaaaaagtctccttatttgattgttaatcagacactgtcaaacttgaggcagcttctagacaaatgcagcagcacttagtggcattttcacttaaagattgtgttagttatctcatagctagctggatccttttgccgttacctatatttagcatagatggttttggcaaaatcagaatgtctatttttctctcagtgtttttctgcctgtccctttccaacattttccttgtactgtgtatgaagattttatttcaaaatattgaaaaaatatttagatcttttaggttcagtgtagattcacttctctctctctctctttttttttttttttttgtttggagacagggtcctgctctgtcatcctgtcatcacccaggctggagtgcagtgacacagtcatctcactgcagtctcaaactcctgggatcaagctattctccagccttggcctcctgagtagctgggactacaggtgcacaccaccacactcagctaattttttattatttatttatttatttttgtagaggcacggtctcgaaccattgcccaggctcgtttccaattcctggcctcacacaatcctcctgcctcggcctcccagagtgctggaattacaggcatgagccaccacaccggccaagagtgggctcacttctgtcatcccatgttgcatctttctcctgttgtcttagttcctttatagcccttgaaaaattccaccagaactcagttgttgtttaaaatgtaatatcccctgatgatgatttagttagttacatgtaaaagaaagagaaagcaagcaagcaagcgtcttcttaaaccacagaatccaatgttaccaccactttatactgtactttatacaggacctctttgccaagtaatagttggataggttccaagctcagcaaaatcaggaaattggtttcacttgtctttaatgttaatctttttctgctctgggctcacctccactgcaccctgcaccctcctccctgtggtgactctgctcctgaaaacacctagacatgggaagcttctcagggccttttttttttttttggctctctcacctcaagggctaaaatctgatatacaccattcctagttgtcaattctaacgcaagaagggacatttataccagaagtctgcacagttatcttaatttggggaaatctcattcaggagaggaagggccaggtcctgacctaggagccccagagaaaaatatcctacggtcctgaggttcccctaggactcagagctgtccctgccctagcctaccccattccagactgtcctggcagacaccagtcccttcaggcttgagcactgatcaacttcttcctctccctctgccccaggacttccagattataggtttttcagtgcatttagcattttggttagccttctaaaatatgatactaaccccctctcatttaatttatcttctggatgtatccatggggtctcctacattactcctatttttgatggtgaaatttttgacaagcttgttggaatacattctcttcaagcataagatgtgtctatactgtcgggtggtatcttaacatatgtattgatgctactttccaatagtgggaagcctgtttagagctaaatctggttacttgcagttctgggattaacaaaagatgcttgacttttcactttaggaaactgtcatagaaaaggaatgagagtgaaggaagaaaaaatcattaccttgggcttaaaatagtagttctccaaataagcacacgagatttccaggctaagagcctgtgtggttttaactttagttatatgtgatcagcttaaattaatgaataacacggggaaacaaggctctatgtttaaactatgttgtcaagttgtattatcagtggggagtcaccagtaagtgaatcctgacattcaaaccagttttaatccatggattcaaagtgaaatgaattaaggtgcttatttagactgtttattctaagacaaaaaagtaagtttttagtaccatacagtggtggaaagatgttggttaccaacatgtttgctgtgggtatttcctctaccccagcactgtccaatagaactttctgcattgctggaaatgttctgtgtatctgcattcttcaatacagtagctcttagccatatgtgaacacttgaaatatggttaatgtgactgaggaattgaatttcagtgtaattgtattttaaatagccacatgtgactagaagttgcactattagacagtgtagctctggctattcagtatgacattatttaccattctcttgattttaggcaattcggttttcatatattttatcttatgtgtatgtgaatggctgtataatttttcttttaaaggaacaaaagaaaatttataaggtatatttggtatgttgtattccttaaattaaggggtttttttagtactctagattaaattgtcataaaaatcctaattgcaggtgtgggaaatgatgttgatggtgttctcctcatgcactgcagaggtagcaattggttagatggtgagtcaggaggccatacaggcctcacctctcagagggctgcagcttggcctctgcaatggattcacctgataagtttgcctttgttggaaaccattttacatgccttttctctcctatatgagttaaaatatgccataggtgtacagtcagcgttattatcccactgagtttgaagattctcatttctcactgtaaaagtgaggtgattggtatgcatcgtgagcatgttaaactgtgtcagcaaagccaagaaaagttagaaactattacctgtaaactacttttaagcagatgtgctccacagtacaacaggtggcatttttaaagcattgattaatattcatttgaaaacttgcgggaggaggaactctctcttattacctgcttctttgccaaaatgtcagtcctttatgtagtgtagcttttcaaaataaatctattttgaaataccaataggggatatcagagagtttaattaaaaatacataaatatgacaagaataccagtacctataaccccttgatagttgtcacgcacagtgaattcagtcaggtaactgatctctttgggaatcttaaagatcatagaggaacctgaaaaaattacccccatcactcctgtgaaatatccatacagtgtatttccatttcttcagggaagagagtttagtaacctttttaaacttacccatatcaagaagccctgtagtcaaaacctctcactgcaaactgagatgcatcacagaaaaaataaagcatgtgactaagctgtctgcattttccagagagaggactctttccaagtctggagtaaaaccctggtgtacttctggaatttgtaagatgtgccttggtgtacatgtgtggatttgtgtgtatgcatgctaaggggatgctttttttagaggggaagaaacactaattattaggcttgttacactaaagatttttaacttttgttttcttcagaaaaactaattattaggcttgccacattaaagagttttagcttttgttttcttcagaccataaaggtttgttttttagcaggacaggttttggcaccttctccctctcacttcctcttgctctgctttttttttttttttttttttttttagttggagtctcactctgtcatccaggctggagtgcagtgacgcgatctcggcccactgcaacctccacctccctggttcaagcgattctcctgcctcagcctccctaggagctgggacttacaggcacgcaccacaacactggctaatttttgtattttttagtagagatggggtttcaccatattggccaggctggtcttgaactcctgaccttgtgatctgcctgccttggcctcccgaagttgctgggattacaggcatgagccaccatgcccggcctttgctctggcttattgccagaataacccagaatgtgaaaattgtgaatctcttttgccttctgcattggtgtgctgtcttgttaggtcaggtttaaagaatctttggccaaggtcattgccttaaagaaaagtatgttcagagcctcaagtgtaaaaactaatcagacttttaaataacacttttaaataactaaagtttttaaaactttagagttttcaaatatgttgcatgacatttgtgtagcactttacaatctgtagcagaggctatctactggcggcagaggtctgtcccacaggattttaaaagaacatggaagaaaagcatggtgactggagggtgcatgccatctcacacaagcagtcagtgtgcagctcagctagagattgccagacagattcagtagtgcaaaatctaatttttttgagaaaaggcagaaatctagatttttaaaatgagaaatcccctaatttttaaaaactgattcaaatattttttttttttttttttttttttttttgagacggagtctcgctctgtcgcccaggctggagtgcagtggcgggatctcggctcactgcaagctccgcctcccgggttcacgccattctcctgcctcagcctcccaagtagctgggaccacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccaaatatttttaaagcactgtacaagcccaaacagaacatctatggtcagggaccgtaggtcaccattttgatatttctggtccaagagatggtgttcatagctttttttccccaccttttgaaatttttgcaattattacactgtcatagaacagaaagaaccatgacatttcacaaaatatattgccagtttcatgttcttttgacatttcagttacctttctgtcagtggtaaatcttctcccctctggagtgttgggtgggcacattgggatactgcatttggagatttgggggcggactgtgggttgagtaggccccagctcttttcttggggccacagtcaccaattgctgagaatattgttctctgggctatcattgctggagttaaaggactatcacttcatagaatatttagactggattagatatatatgatgaaggttgggattaaatatgactccattctgatgcagtgtctgtgtttgaattgagttgaaggtaatagttgcatgaaagcttttcagttagtaacacgctttttggaggtgagcaaatcaaacaggactaaggaagaatattgggaaagactagcagctggtgagatccttagacatctcagagttggtagacatatgttaaccttcaagtagagggagaggtggcatcttttaaacaatgcttgggcaacaaaaagcaaaacaagaaaaacacaaagcatttctttgtaattaagcctaagagacagccatcaggttgtatggagtctcagcagtgactagcatagatagtaggatctcaataaattgaatttttcccttcatggaataataatggtaactgcttaaatggcaagggctttgctaagcacttaatatgtttttctgacctctccagtttacaaatgaggaagctgaggatcagagaggataagtaacttgcctcaggacatgcagccaggaagtctggagatctgtttgattccagagttacactcaattggagtagaggccagtggtggtgaagctaggctagttgaggtaccgaccatcctttcttcatgttttccagaaaacaggctgaacacataggaaccattaaagttggactaatgggaacattttagcattctgcatgtctggcctgtcataaatgcagaatcgatcatgtatcgcttgttgattgcatgcttatatatcttttcattgcatgttcagaaaagtttactttgtgaccaagagttgttttgataggccagaacatttaactagtccattattcacatcaaaaaaatagttctcagttattggtgttgtaatggtaagaactttttaaccagtttcctttgtcactgtaggatttttttaaaaatctggccgggtatggtggcacacgcctgtaatcccagcactttgggaggccgaggtgggcggatcacgaggtcagaagatcgagaccatcctggctaacacggtgaaaccccatctctactaaaaatacaaaaaattagccgggcgtcgcagcgggcgcctgtaatcccagctactcgggaggctgaggcaggagaatggcgtgaacccgggaggcggaggttgcagtgagcagaagatcatgccactgcactgcagcctgggtgacagagcgagactccatctcaaaaaaaaaaaaaaaaaatatgttgcacattattctctcctttaaaggggaagaaatattaatatttttataactcacatttttcataaaataggaatagtattttgtttagcaggcactttatcatggatttttaataaattataaaggacactttatacataaaattgttgtgtgaaaagactaatactaggccaggcgcggtggctcatgcctgtaatcccagcactctgggaagccaaggagggcggatcacttaagatcaggagtttgagactagcctgggcaacatggtgaaaccccgtctccaccaaaaaaatacaaaaatttagccgggcatggtggtgcatacctgtagtccccagctactccagagactgaggcaagataatcacttgaactggagaggcggagattgcagtgagctgacactgtgccactgcactgcagcctgggtgacagagcaagactccgtctcaaaaaaaaacaaaaaaccccaacatactcatccaaatatcttttttttttaaaccaccatgtgtgtatctattactattacatttcaatatcaaggatgaaattccttttagataaataaccaaatgacttaacatttttgttcaaaaaagcttaatcaagttagagaaaggacccagattgtcgttagaactgccctgttctcgagcccaagccctcagctgacggaccaaccagcaccagcactgcagccccttaggagctgccctcccacccaaggctgttccagctgagtcagagcacatttgctgagactgcagttgggttgccatctattatttcttcattcctgttcattcaacagatatttattcagtatcttctatgccccaggcattgtgctaagcactaagtaagacacatgagaaaaggacagatgcagttgttgccctcacagggcttccagcctagtatgagtcaagcagaatccagcagacagcaaacaccatatagtgggataactgctaaggcagagggatgatagtgctgtgaccgctgggtcatccctcagttgcccagttgagggctgagtaggctgttccagttcctcaggagctgtgccagtctcccaggccccgtggttcccttcatgaggtggtctgcgagttaacacatacaaagcacttagaacactgcctggtgcttagtaagtgctcaataaatcttagctacctactgggtataatgtaacctaatctttccccaaaaatttaatgacaaatttctgtataactgttttgaattctgtgtcctgaggtttctaacagagatataattggcttttcacacagaactgaatatgttctttatacatactaaaatagtttcacagttagctggtgaaaatttatgcataattacttttatcattcttaaggaataattagccctgctaatgggaactatcattatcttaatcatcattattatcccaatctaaagcatttattaagaatttgattttgccttataactaagctagcccttcttcaaagcaagtttgtgaccttgtcttcggcttgtttacggtctaagacaatactgatggggaggtagattggggccagtgttcattctgctgttccctctcaagttaccttccattcatgtacgcttgttgatatgttttcttataaatgttatgtctttatggttataaaacccacctcttccagcagatcctgaggcctcacacccaaaataatatgtttagagaaccagataatagttatatttccttctcattgtacccccggagtggttgcttagtatttaggtgatttttagaaaacaattttttctgaagtaatttcaaacttagagaaaagttgccagagcagtacaaagaactctcatattctcttcactcagattccccaattattggcattttacttcatttgtttcgtttcctactctctctgtgttttttgtttttttgagacaagtctcactctggtgccccaggctggagtgcaatggcgagatcttggctcactgcaacctctgcctcctgggctcaagcgattctcccacctcagcctcctgagttgctgggaccacaggcgcttgccaccacgctcggctaatttttgtattttttgtagtggcagggtttcaccatgttgcccaggctggtcttgaactgctgggctcaagcaatccgcccgcctcagcttcccaaagtggtgggattacaagcatgagccaccatattcagcctctctttgtttttatatgcattatcatttattttttctgaactttgagagcaacctgtgtgtaacatcctatcacccataagtacttgagtatgtgttctagacactcctatatcacctgcatagaactctccaaatcgggaaatcagccttgatacaacactactgtctaatccagtatgctccattcaaattccacgaaccgtccaaacaatgtattttttctccattctggaatggagaaagtaatcggtatcttctgcgttccaggtcttgtgctgagcactgggattcatgggagaaggagacatgcggttgctgtgatggtcctgccacatccgtgtgatgtttctttgtcaggtctctccagactccttcagtctggacgatctcctcagccttgccctgtccctcatggccttgtgtcaattttaaagagtacaggctgtaagttctcagcctaggtccattcagcgttccctgataaccaattcaagccatgcctgctcttctcaggaggcacgccatgactacccttcccactcctggtgacgttgacctctgtcacctgctcctgttagcatctgccaggtttctccacctccagttcacctcctttttattaattagtattttgtgggaatgactcctgcctgtgtcagccacctctgtgatggttatcaaatggcaactgtctatttctgtcatttcttttacacatgggagttggcattctataagaaatagctttccctttctcccatttatttattttatttatatctgtttggactcatgaattcctgtataattcaatgggttatagtctattatttattttgatgctaaaactatctaggatttggccagtgggagttcttcctcctggtccttttaacttccttccatcatccattgagtatttccttatgatctggcacaaaaagatttccagactcatcttgtacttccccagccccagccctggaatcagccattttgccaaagagccctgcctgattccttttagtagaggatggtaacttaggatccaggatctgggtagatgaggtgctcactgctactgagatgtcattgcttctagaccctctcagtagagaaagcttgggtacatatacatatacacacatacacacacatatacactcacacacatttacatctggaagtatttatatagctgtgtgtgtatataaatcatgggttcatactgatccctccaaccacagtctaatacctcagtgttctttctcgcattttcccttccatgtttgttaatacctcctccaacagcaagaagcccattttccttaatatattgatttttttgctcagtttgcctgtttgctccatgtaactggttttccagccacactggccatctcttccacctgtcacctctgtctctccttcaccacccccattctcaactgcaggcctctggttcatacctgtgttagcccaccaccttccctcacctttccatgtcctcaccaccttgagttttcagccaccatactgtgtcctccacgtggggaagggaaagaggcgagtctcaggtgaatcttatctaatgacatatttgagatgattgggctggtctctggaaaaccagaagcttgcctagtgaagtatttcattcttccttttttcctgttttctttttttaatatttgtgtttatgcgtttcttttcattttgaattgaaatcatattttgtatttcaatttctgcttagcagagatagaaaagagaaacaagctttcgagatagatttttaggggtcttgacaataagttaaatccagaaataaacagggctcatcttagtccattggtgctgctattaaggaacacctgaggctgaatgatttgaaaagaaaagaggtctatttggttcatggttctgcaggctgtataaaaagcatggcaccagcacctgcatctggtgagggcctcatgctgcttccactcatgggggaaggtgaagggatccagcctgtgcagaggtcacatggcgaagaggagctagggggtggcaacgggctcttcaccagcagatcagaaactaacagtaaggacttactcaccctctccccaggtcccacccccagcattggggatcagatttcaacatgaggtttggagggtcaaataccctaaccgataggagggccaaaacaaaaaagaaatgattgttagcaaaacaagactcagggaagaagattacattaactttaggtaattcgttagggtttgtttcaagttcttatgttgtgttttaacttgggtcagttgatgcacaactagaagtcatttcatggacatattaaagatacctctgggtgctagtgacctgtagttttttatgctttactcagtctttcttggtgaacctcttctactcagtccctgaagtccaaatcctattattctctattcccttttcagaggtaggcaacatttattggaggactaatggctttcttgacactaagtaaacatcacatttaccttatctgttctctaggctcttcttgtatagggttccttccaatagttattgattttgaaagataattgttaccccataatgtgtgtgtgtatgtgtgtgtgtgttcacatgcatgtgagaccccaagcccaagaagacaagtcagagctgttcaggtttaggagacataccttgggttcaaattctgtaaacctcactttacttgtctgtaaaatggggattcagtgaggtaatatatgttaaaaagtgcttggcatatagtaagagctcagtaacaattaggtataattatttttactgctgtcaccataaatattaaaaagagatactaaaaaaattttaatgggcaaaggatttgaatattttcccaaagaagatataaaacagccaataagcacgtgaaaagatgctcaacatcactagtcattagggacgtgcaaatcaaaactactgtgagataccactttacactcattaggacagctattatttaaaaaaaaaaacaaaaaaaaacaaaaaaaaaaaacacagcaaatgagcagtggagaaattggaactcttgttgcgcactgttggtagggatgtaatgtaaaatggtacagccactgtggacaacagtttggcagtttctcaaaaagttaaacataaaattaccatatggtccaataactccactactaagaatatacccaaaagaactgaaagcaagtacttaaacttacttatacaccaatgttcatagcagcatattcataatagccaaaaagataggaacagcccaaatgtccatcaacaaatgataaaatgtagtatatacgtacaatgacatatttttcagacacaaaaaggaaggaaattctaatacatattaccacatagatgaaccagacatagaaatacacatactaggccaggcacggtggtggctcacgcctgtaatcccagcactttgggaggccaaggcgggcagatcatgtgaggtcaggagttcaagagcagcctggccaacatgacaaaaccctgtctccactaaaaatataaaaattagctgggcgtgttggtgggtggctgtaatcccagctactcgggaggctgaggcaggagaatcacttgaacccgggaggtggaggtttcagtgagccgagattggaccactgcactcctgcctgggcaacagagtgagactccacctcaaaaaaataaagacatatactgtattattccacttatatgaggtacctagaattaacaaattcttagagatagaaaatagaatagtggttacctgggggcggtgaggggaagatgtggagtgattgtttaatgggtacagagtttctgtttggaatgatgaaatccttctggaaatggatagtggtaatggttgcacaatatggtgaatgtacttaattccaacgaattatgcacttaaaactgttaaatgataaattttattttatattatccacacgtacaaagaaattactgagatattaaaatgatggtaagatgaaaaacctacctatacatgttcttacaaggttgttttttcccccatagtgtccattggtgatagacattgactcccttctccccgcctccccacacaatctgtcagagaaatgttgcagaataacatttgtatgctaaagaagtcacaggggccaggtgcggttgctcacctgtaatcccagtactttaggaggccgaggcgggcggatcacgaggtcaggagatcgagaccatcctggctaacacggtgaaaccccatctctactaaaaatacaaaaaaattagccaggcatggtggcaggcacctgtagtcccagctactcaggaggctgaggcaggagaatggcgtgaacccgggaagcggagcttgcagtgagctgagatcacgccactgcactccagcctgggcaacagagcgagactccatctcaaaaaaaaaaaaaagaagtcacaggaaggggaaggttggaggggttcaatgaatctataacagaggttggcctataggccaaatctagcctgcaatttataatagtttttactttttttcttgtttggtggggtttgttttgttttttagaaacagggtcttgctctgttgcccaggctggagtgcagtcgtgcgatcacagctcactgcagccttaactttccgggctcaggtgattctgagtagctgagactataggcacatgccaccatgcccagctaatagtttttgcattttttaaagggtttaaaaaacaatgatgaatatattacaacagccacatgtggtgcaaaccctaaattatttactaactagccttgtacagaagaagtttgccaacacctagtctatagcattgctatggactgaattatgtctcctcccacaaaaaattcataccttgaagccctaacccccagcgcgatggtatttggcaatgggacctttgggaaataagtttagatgaggtcatgcggaggtggagccctcacgatgggattagcacccttatgaaaaaagataccatgtgaaggagggcacatctagaaggtggccatctgcaagtcaggaaaagacccctcaccagaaaccaatcatgctgccatcctgatctcagacttccagcctccataactgtgagaaaatacttttctcttgtttaagccccccagtctatggtgttctgttatggcagcctgagcagactaagacaaacgtacagtttttccaaaagcaaagcctagtcctaccctcttagattttaccaaatctcttcacaaatgaaaggggttttaagaagaggaaagaatgcttgctgtaaagcttggtcagggaatttctttgaaataaccagcgcagtaagcagcgggttccaaaatgctaagaagaatagggtttctacaatagtggttttcttatgtggcaccatctgtttttctttgactgtaataaaaatgacagcttttcatgtactgatactccctgtgccttttaaagtcaaacatatgatgctatttgtgtgtaaaggtttttctcttgcacccatttgtttctccagcttgaatttctatgtaaactcccttggctaaattacacaagccgcctacacccagccgcctcctccctcgctttagagcagggggtggaaaccttccgtctgcagcatggagtatccaatacacagctcactgtgccaggcaaagaaagattccctaaccggaagggcttcatggtacccgctcccctatttgtgcccatcattctgaatatgcaactttgaaacggctttatgacatttttggcaacctatcctaaacctggcttttgtctcccttttctccttagtaatccttggtaaatcttcatcatctcccttttccctctttgccctaaatgccccttttatcttaaaaggcaataatatgtatttaaagcaaactcctttttttttctttttttaagagagggggggtctcactatgttgcacaggctagtctcgaactcctggccttaagctatcctctcacctcagcctcccagatacttttttattaaataactttacagaagtataatttacaaaattcaaccatgttaagtgtataattaaatggtttttagtaaatgtaccaagctgtgcaaccatcaccataatctaactttagaacatttccatcacccaaatatgatccctcatgcccttttttaaatttttttttattttttaaaatttttgtgggtacatagtaggtatctgtatttatggggtgcatgagatgttttgatacagggatgcaatgtgaaataagcacatcatggagaccttatgcccttttataattagttcccactcccagcccctggcaaccactattctactttctgtctctagatttgtcttttctggatatttcatataaatggaatcatataatgtatgatgatttgcttttggcttctttcattcaacatgatgttttggaggcttgtctgtgttgtagcatgtgtcaatatttcttacctttatgttgctgaatagtattccactgtacaggtatatatatatatcacttgtcgtttatccattcaccagttgatggatatttgggttgttttcacttttcagttatgactaatactctatgaacatttgcattaaaatctttgagcagacttattaaacctccttttttcttcttttaagagacagggtcttgctcgtcacccaggctggagtgcagtggcaccatcatagctcactttaacgtcaaattcctgggctcaagcaatccttccacctcacctcccaagtaggtgggaccacaggtgtgcaccaccaccctggctactttttaattttattgtagaaacggaatctcactatgctgcccaggctgatcgcagctcctggcctcaagtgatcctcctgcctcagcctcccaaaacactgggattataggcaagagccactcagtcataagcctcttattcttgataattaataaaatcatatgtttatatgtttctagttataaattcaaaaagcagctgagtagaacttcttataatccaaatccgttgcccctcaaaaaacccctcctgagctaaattagcttttcttacttctctgaggctattgatgagtcactggcacttaacagaaaggaggctccccacttaccataaaaatgttcccaattgttgttttcaaaatagaaaagtggccaggtgtagtggctcacacttgtaatcccagcattttgggaggccgaggagggaggatcacttgagtctaggagttcaagaccagcctgggcaacatagtgaaaccccatttctacaaaaaataagaaaaaaaaattagctgggtgtggtggcacacacctgtagtcccagctactcttgagactgaggtgggaggatcagtcctgaggaggctgtcctgggaggttgaaggttgaagctgtggtgagctgtgattgtgctactgcctttcagcctgggtaacagaacaagacccagtctcaagaaaaaaagaatggggaggaaaagaaaaatataagttatcatccaatttaaggggcattgattccacacatccctgtgtccagacctctgtcaggactgaggaagccaaatgatgagacctgggcccttgaagaccttgccatcaagcagggagtaattgccagagaactgttcacgtttcacatgctcagcagtcagcaatgatgacaggagagcttgtcagttattctctcctctctggccttttggatgaaggaaaaaattatttttaagaagattatcaaagcctctacccatttttttcaccaactagaataatttcagctcatgcaaggaagtcagtattagccagcgtttcacgccttgcctgtggagggatcatgggcacgcatctttccaaagaacagcagcagccctggccgccccaggccagctcagccccctgtccttggtaggaccttcctgggcagtcctggtttggatatgtccagggcctacaagcacacaactttgtgcggtggccaatgtgattagtcgcctggtttgttactcagtttttcttaggttgaacccagcattttactccctgccagttttactagtctcatgtccatatgcctcttgctcatggtatccttttacatattttaaagtacttaccctctctttccttttccaaagtcagctctgctagttgaagagttcttctagcagactctgttccctaaatggggtctcatctatttacagtgtagtaattgggataagactgttaatgtggctgaatcctggagtgttgtttgtttgaacagccacctcacaccctgttggctcctgtgaggcttatggttcaccaaaaactccagatctcttgatttcataaggtgggtcttctccattctgatctggagtcattttgttgttgctaagtcatgtaattacatttagacttattaaatttatgttactgtgggtttgggggttttttcatttattttttgtggtaaaagacatacaacatttaccattttaccacttctaagtgtatagttcagttgcataaatactgtcccattgttgtgcaaccatcatcaccatccatctccagaacttttttaatcctcccaaactggaactccataccaattaaacaataattctctatttctcatcttcccagctgctggcaaccttctgtctctactctttgtctctgcctcaccctaggtaccacatatgagtagaatcacacagtattcacctttttgtgactggcttattttacttagcatgatgtcttcaaggttcatctatgttgtagcatgtgtaagaatttcctcccttttaaggctgcataatactccactgtatgtatataataatatcccgctgtatgtatagaccacatcttgcttatccatccatcagtacacacctgggtttctttgccttttgactgttgtgaataatgctgctataaacatgagtgtacaaatatctcttcgagtctcattgatcatgctggttttaagttatgcatttgtccattttgagttattggttgtataattatctataaatcacataaggtcaatctctttatccaaatcccttcttgataacaatgttgcatttcctattgattggaagaaatgattttgcacaaaatggtcatttcctgcatccctagtcttttttaaaagacttatgccatcgtcttcacagctgggctctgggaacagactgctttcatacttagcctgagtctgagtttgtcatagttcttttggctgaggtctaacttggggacggatgggaggtgaataataaccaatctctaggctgggtcaaagcaggaggttttgggcggttttgggttttgtttgttttttttttttacctatttgaaggtcactaagactacacggaaactatcaggcaccataaagaagggaactgagtctcggagtaacccacttaggactgaattcatttgctccgcaattatttattgagctcttacttgtgaaaagcacaaagtgtttttggaaaacagaagatgaataaacacgttccctgctttgaagatgtttacagtacaaaatattagaggaacttcctattataacccagagctctttaggcaaggcttccactcttagctgtaaaaacatatctccttaagataaagaggattataaaatacatcagaaagcaaagtgtgcttttatatttatattatattttgttatagatggattcaagtaaggatttggagacagactgaaaaatcttaccatgaaagctttagaggtggttagcttttgcttttctttggctaatatgagagcaccaggaaaacagaaagtactcttgctcttgacagtataaaattcttattatttttagagaatagtaactgcatttatgaaattctttgtcagagcaatttagttaatagatatgtaaatgactacttatttcattgtgtaggtggaccgctccatgtacactttctgaggaagaacataagtgctaaaaactattaacattgcaaatggaaagaagcaaaagttaaggctagaatgccattcccttgctgtattagatattaggagtgggacagaaagtccatcttgtcatcaagatttgttcggtttatggggtgggatttcttatttacatcccactcttggacggtcttttttttttttttttttgatgcatggaaactaatataaattggggtgcaagggtgtttcttgctgattttcaagcacaaaaggtcattacaaacccagctgggaagggactgggggaggtgctgaaagttaaaaccacggcagtaaattttcaacacaagggaatacctcctaaaaatcacctaggggctcttttaaacctttattgtttttttcagcataaaaacaacttcagaggagactggggatttcaaagctctctggctctaactgcctcctgggaacagcatggaagcttccctaatcatggaggagttaatgcaggcctctgggggaagaagtctctaatgggaggaaataaatgggcccttgccttgcagatggtcccaagccctcccctcactggaattcttcttgctctgtgagctagcctcatcttcagttgtgcttttttttttttttttgagacagtctcactctgtcacccaggctggggtgcagtggcgctatctcggctcactgcaaactccgcctcccgggttcaagcgactctcctgcctcagcctcctgagtaactgggattacaggcatacgccaccacacttggctaattttctgtattttttgtggaaacagggtgttaccatgttggccaggctggtctcaaactcctgacctcatgtgatccacccacctcagcctcccaaagtgctgggattacaggcgtgaccactgacatcagtccacattctccgcatgaggctggcaaacctgtaaatccccacccctcgtgtttgttacccccaccctgctgctctcactcctggtgactgaggccctttgcacttggccctcatctctgggatgtacacagctgtcatcctaggccccagctctacacgcaagctctttctgccatacaggggtcctgaagatagagaccagcggctgtgccgactcactccctggctctgccgggtgctgcacactgtcttcattaacgttgtctgtgtgttttttttcttttgttttcctcttccttcaggtacagagtgaagacagtgtcctcctgtttgttattgcatggacgatcacggaaatcatccgttactccttttatacattcagtctattaaaccatctgccttacctcatcaaatgggccaggtaaaaaagcacatttcaaaaggctcacttttgaaatgatctgtcattgaatttgccctttattgcctaaatattgcctcaaagtttctaaaaataaaattgagacgggttgggtagaaattttgtctgtagatttcatcagaataggagtctgtacttaactttgactaacggaaatactgttttaaggtttttatattttacttaaattattttaattgggatcagttcttttcaattaaattatgcagtattttcttttttaaaaaatttcatcaccaagtagcaatcaatagagatttgccgtaacatcccttttttgtccatatcatcacattttactgatgagcttctgccattgtgatgggtttttttggaccaagtcctattctcctagtctcaattttgccaagaagttgtgactcttaaattaatttttaggtaatgacaaacattacatgtcagttttagcttatcacttttgttttgctttgattgtttttacaagtaatgatgactttggtaaaaggctagtagttcatctgcttaccttaatgagtccatgagacagttgtaggcagttttctgagctgggaaggactttgagggagagtgacaaagcagaaggatccaagtccctggagccgaaatgccttatttggtggaaggaaagcagtggttcctagagtgtttatgagttcagtaattaaattagggacataatccgattgtttccaacattttgagtatgggaactcctttgttattttattatttttctcatttgcaatgaacatttttattaggaaaggggaagaatgggaaacatagcagttactaaccaacctggacagccactgtggaagctttttaccctggttgttagggaagtctgttgaccaaggcctgattttactgttggagaaagattctttcatccactgttctccatggcctctgaaagatttttttccaccatcctacttagtgtggctaaaattggcagtggggaatatgtcttcccttccacttcagagattttcatcacaattcctgtgcccagaagtttgtagtccgttgcacattgtgagccacaaacagccaaaggctgtttaaagtctgagctgatgattcctttagcaatacttatagtggcttacagttccatgggacagtgactgctctctgaattctttgtggaatatggagaactcctttttaaagagaaaacaattatgcagattcccctcccatgtgacgataattgtaattgtggggtgttttgattggaaaattacatagtaaccaaaagctattatgaattttaaatttttttaattgtatatatttgatttttcacaatagcatgtacaaacatttgaaaaatagtagcagtatacagatgcttatgctattttttttgttgttcagtctttgtgtgtggtgtggaattcctagaccacatgttccaacacctccgccactaccaccccaaccccatcccaagacccacagggcaggacccgtcagtataaaccatgactcagttcccctactttaccaacatttggcatcactttagttattttagagcataattttgaagagttgtttattttgtcagaccaaattttgaggctgcctgaacggcctttattttgtcgttagaacatttggaaacatatacctgctgtaggctggtttcagaaactggcttgtaaaacctgaatttgagtagcaggtaaacaggaaaatgtataaacaatcattttctaaaagaccagtactgattagaagggtgggaagtgcagcttccttctaaagctgactttgagcctcagtaatgaatattttgttttgttttaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaagtaagtaaacagttatgcgtatatttaattatgttttaaaatttggctctacaataactaaatatctttgactgtctttgcactatatccaagtaaatgtaaatctcatttattgggaattcttggtttttattgaatgctgactatcaaaaggaatttttttccagtagtaattgaataaagatgaacccttctcaatacagttgccaaaatgcagcccttctcagcatgtgggtttgaaactgaataccaggctaggttaagtatgtattggggaaagtactgaatggaaaacaaaaaagccattaaaggccttaccttgattgtagttttctgtgtcttaagaactgcttgttacagtatttgaaaaacatgataaaaagatttttgcattggttactatatcaaaatagacatttaacttcattttgaagggattggtagttaactagaaacataacaaaataataatagatttatttttttctaaatttttcattttcttgttgagcactgattgggacacagtgttctcttcaagatggtttccaattattttaatagtactgctgaagatttaagtatatggataatcaaatgtgcctatcagtgtattcagtgacagagaaaaagacatgtttgatgtctctgtgaagtgagccctactttctgaggatgaggagtttagtcctttgctggaattctgatgttcaattataaatcctatgattgatttctatataccaaaagatcttcttataaccaacgacatacagtgttagtggttcttctcattttgctatttctataaccactgtaactctgaatcttattttaatctagaaaagatactgtattcttccctaaaccccaggttaaatcagacagggttggacttctcctcattgcatggcatcatcggaatgaatcaccctaacaaagcgacatgcttgtgtccctctgtggaaaattgcatttcatgcattgtgagaaaaaaactacatccagatttcatgtgagtgtttatcttgcagaaattcttggatacagttctgcttcatgattcattttccactctttattcatgttgagtcctctctagtgctggaatcatagcgaccagaggccatctctcttcaaatgtaaaaagtggttgattttcaaacagatgataaatgtgaaatcatctaaactactaagtaataaaaattaactggtagtttatcacctttctaattttgttttttttttttagagtttcattttccagtctctagagcagcagttcacagttgcagttttaccacacccggagtaactaacacatattatcccagtgggcaccacaggctttatttgaattcaccatagtcaaatgaataggagatatgtaccatattgggtgactgggaaaggggcagggaggtttttatgaaatcagatccataacaagctgcttccacactgacaaaaatctaggcgttcttacctgagagttcctgcaagacttccaacctctctaggaagcagggcttccttccaggaaccactccccagggcagcctccatctgtctgcatgtttgtctctttatgctctggtagccaaccagtgctgagctttgcctcttccttctgagctcttggtgtagtggcagtgcctgggtaccacacgcagcctccatgatgatagcgttcctgagggaaacccactcctgtgagcttttcatcttggtcttgaaagagatagaggaaagagaaaacactgaccccagagccagctgtcttttagagcagcagtccccacaacctttttggcatcagggaccggtttcatggaagacagcttttccctgggcggtggaggggatggtttcaggatgaaactgttctaccttagatcatcaggcattagattctcataagaaacatataacctagatcccttgaatgtgcagtttacaacagggttcacacttctatgagaatctaaagccactgctggtctgacaggaggcagagctcaggcagtaatgctcatttgcccaccactcacctcctgctgtgcagctctgttccaacaggtggcggttggggacccctctttcagagagtagggaaggactctcctcccaacagaagtctgctttctttaccttaagtaattcccccttgcagtctcagcctccttttggtaagagaacttggctcagttaaagtctaacataatttctttttctaaggcagctaacctcttgtagaccggagaaaagggtggatctcaaataatgattaaaagattccctgcaaaccattgactcctcacccaggttcaagatggcacacagactacctctcctgatgcgagtcaccctggtgcctgctggcctcactgtgctgtggcctgagccagcagctctggatgttctcagtggttcaggttgttactgttgaggccagagtgtacagttcattctggccagctgcacatttccaactttccaaagctttgtatttatcagaagaaaatgcagaattaggagaggttgctgttgacatgcagtctcctttaccaaatttggttttctttctaaacaaggtagcgttcttttaatctttagtggcaagttgatgatacacatgtattatataaagtaacacctccttttcatgggcctcatctgttgttgcgttgttgcacacatagcctaaattgtggctcatgaggcttgaccccaggagtttcctcatattggggtgccctggccaggtgctcctctcctgttctgctgtagttgcaatatatacaggattagtacaacacagtccctgcaggactcagtagatgtctaaggcctgtttacattccacccccaaattggtgaaaattggttatggtggagggagccaaaaaagggcaagatacattgatgaggggtgaggacctggagaagctggcgctttccaggttgtcagtgactgtaaccacacctctgatttttagagaaaccaaggagacttggcccaggcagagagcatatctggtgctgtcgtcctccacagttctctccccagaggggaagagagccccaagagggctggccatcttcttaaagaaaggagggcccagcagcacccacacccccctcgtccccaacacacagggactgtcacacacacgtgcccagcagtgtccccattctgtgttccctgaattgggacagcagaaggtggaattctcaatagcctgttgtcgggttgaggggttttttcagtgctattcctcagtgtagctcatgttgttaaaagtggcagccgtgcatctgaaaagctttcagtctcatggtcgggttcagtctgaacatgtaggtgattcagatggagacagaatcatagttctggtcagccagaagccactgcctgaactgtggagaataggccagacaccctaggcccttggcctcccatccacattcctttctctgggtactgaggaatctctgggagatgtaaaggagtgaaagtgccatcatctgacccttctgataggtggcaggccctgcccatggaaatgaaggtctgcgtggccatcttcttccttgaactgccaccaagggcttaatgcatgacttccaggtcattctccttccccgggccctctgaaccagctgtgagactgcagccacccactatggggttgtgtgaacacaaatgcaaccagtgggaaggtcttgtgcatgcccagctcacagattcccttcattacagtaaatctatagaaatgggactggccccacatttttaaatgattaccattaacattcctaatggtttaattatatctttacttccagtttttagattatagagcttgtcagattttctggctttcgtgccaaaatagttctctgcctgtcgaattatatgcttaagtggggtcttttctgtgaacgacgtcctgcctggcagtagcaatggcgtggatggcagccctgttccacgtgctgcctcctctgcaggttagcagatctttgtcacacacgcactggtgtcccggcgtactttgggaggatcatttgaaatctggccagcttggaacccatttaaaaaggaagaaacttgtcaggagagagttgggagtagtagaaattatcttccaaaaaatattcgtgacagtataaaaaagagagactgggctgggcttggtagctcatgcctatagtcctagcactttgggaggctgaggcgggcacaccccttgaccccaggggttccagacaagcctgggcaacgtaggagatctcatctctacaaaaaattcaaattagttgggtgtgaagtggtgtgcacctgtagtcccagctactcaggaggctgagtggggaggattgactgagcccaggaggtccagaccatgagccaagatcacaccactgcataccagcctgggtgacaaagtaagactctgtctaaaaaaataataacaataaaatagagattggagctgttggagagatgaggagaggaaggatattgtacaacaaagagcattttacctggagttgtttacacacagtaaccttgtgaaggccaggtggctcaaagtggtatttcctagcagggacactataggcattttgggtgggatacttcttagtagtgggtactgtcatgcattatggcatgttttagcatccctggtctcatatgccaaatgccagtaacctttccctttctcccttatttccaaatagtcaaactatcgaaatagttccaaatagttccgagggaggcagtactatcccattcatttgagaaccagtgctttctaaagtattctacaaaatgaccaagaacagaagaatccccagtgcctaagacactggcttgcttttcataaggccttttttttttttttttaacatccaaacctggcttagttgtgttcaaagcaaatgttgtggcattcctcctcctcctcaagtctttacccgaaactacttcccaagagaggttgctcttcccaaagaatcacctgccctgggaccatatggggctaggctgagggtcaggagccaagagcctggtcccaactctgtctgtggcttactgtgagaccctaggcaagttgcttaccctctctggggctcaaattcttcctctttgaaataggaataataacttcatcactagaattcttcacctggttgttgtgaagttaatcagaataaatgtggagataatacatgaatgagcgtacagaatattatttggctgttctgtggcatcgatataggtcatgatagtgacaatagtgtctgtcattgtattccacaccacttcttccctcagctaaagcaggaaaagaaaggaggtaagtctctctgtgttttttcttcctttccccaagcccactttgttaccttccttggttgctggatgagaaattagtcagagggtcagagaggacctcaacttcatatgctttaaatagagcatatgcaattttaaaccatcctcttaaccaatttttcttttcttttcagtttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaacactaagtacttgagagttacagtctgaataatgaagtcgtaccagctgaatagcccagcttgcagtatagttatgtttcagtctgcagtgtgtttagcattcccttgtcaaagtgcttgactgcatgctggaaactttgtatttttgaagcggcaaactctgttctctggaatgctctgaagttatggctgggacctatcccctcacatctaatgaatgaattataaaatgtatatgtctatgaagcttcggggtagtgcctgtaatcagaaaacaacttagaacccttttgtttgtttccaattgagtcattactgcctgccactaagaaacgtgcttgaatctaataagtatgtgtgtaccgtaaagaatatatcttatctggagctcagcctcaatcatgtcttaacaaaatgacaggtctcagaaagggggagctcaatagctcaaaagtgacaagtccttttcacagcaccattctcagaacacctctgagtaacgtgtttgccagtagctattctcactgatgcactgatggccctgaagaagcggatccagtcacataggaaaggaggctgtgttagtgaaagcacatggaaggtgttgctttagaaaggtagtcaggaaaaacattcaggaatagatttatacaccattattgttttatttttaaattttcattcactcttctgtttggatacttttgctaattaacttcctatgttaatttccaccaagctataagtccatagtcagtaaaacattccccttgggctgtcatgagctaaaagcagtgtcatctccgcatgttggagcagccaagaaatagtttggtactaccgacattgtctaatccatgtcacatcctcatacaatttaattgctcaaccatgcatttaaaactcctcaagaaaggattggtactgcaactgtaggtaaactgaaaaaaaataagaaagaaagagttggatgaaaatgtgaaagcccaagtttagatgtgcattaagtattaaatagcacagtatcttcttcatggagccttttttcctcccccatcccctgcagctgcctttttttgggggcagggtgggggttgatgttgaactttaagagtttaaaagtttagcttattgagtagttgtcatttaaaatataattgcgaatatcagaaaactcatactggaaaactaaattttttttttctcttgagacggagtctcgctctgttgcccaggctggagtgcagtggcgcgatctcagctcactgcaagctccacctcccgggttcacgccatcctcctgcctcagcctcctgagtagctgggactacaggtgcctgccaccacacccagctaattttttttgtatttttagtagagacggggtttcaccgtgttagccaggatggtcttgatctcctgacctcgtgatccacccgcctcagcctcccaaagtgctgggattgcaggcatgagccactgcacccaacccctggaaaactaaatttttaagtgcttatttttatagaagtttgaaaatttaatgcaggcaggtgtgtaataaattatttttgaattgaacattaaaattctgcttcttaaagtcagcactcaacttggacatgttgaaattagaatctattcttgtatttgatagacaaaatatgtgggaaagattttttgcatgacttttctctcattttattcttccataatgtatttctactataaaatagaatcaacttgggttatatttgtcatttactttgttctgttagattttttcagttgtttttggaaaaattctagaaatcaggatgaaaaatgcagcttttccagggttgctggactgggggttttatttgggcctccttattataatttgtcactacttataaaaaacattctgttgcaaacagtggtgttgcattgaattgaactttggcaatgagaacacagcacacagctcccttttcaaaaagggtctcaaccccagtgtgtatttttgtacatcaacatttagaatacttatggcagataagtaaggcatgtcactgtgtccttcagtaacctctctcagtaactggtttctttatccctaacatgaattcatttctcctttgaagtcatttattattttataaattgagaacaaccacaccaccaaatgtcacaccttcttataaagtgtgaacaaggaaggtcatgtttttgtgggtattttgtcagacttagaggtttcatttcagggcatagtcaaaggcatcatcctcccaactacccacttgattatgtatttcagatccctccgtgggggccttcttctgacagagaattctttgaggtccgcagtagtgcttttgtcagcacagactgctaatctacatcttgctgcgttctgtttgctgaggttgggcttattcatttaacacataccaaccattatccagaggcaccatggagagttagtcatggaataaagcactgtccttgcagatgaaaaaagtctccagagcagacttctgacaggaaaggtttagatgctggagagttgaagaggtgtaagaagagatcgtgccctcatttttcacttatttttttggttattcatttataataaaaggttggcattgatatggtacaacctgcaaattacttgcagttctgagtttcagataaaacattataaaacattaaattcaatacatactgctcctttgaaatttgggtaaaaaattgtacaaccgtatatatagtcatttttgtattttttctatgttgtgaaaaccaaaattgtaattttataagtctttgattcactaaaattatataatttaaatgtattttttgtatatttagaaataaggagtccagagactacgcttaactttctatgcatgcatttgaaagctgtttttacctgataatgtagtaataagttgtattcataaaatactgatctgtgttgcatttcaaaataaactggtgtgtgctctgcctggatttg
